US009249427B2

(12) United States Patent
Picker et al.

(10) Patent No.: US 9,249,427 B2
(45) Date of Patent: Feb. 2, 2016

(54) RECOMBINANT HCMV AND RHCMV VECTORS AND USES THEREOF

(71) Applicant: OREGON HEALTH & SCIENCE UNIVERSITY, Portland, OR (US)

(72) Inventors: Louis Picker, Portland, OR (US); Jay A. Nelson, Lake Oswego, OR (US); Klaus Frueh, Portland, OR (US); Michael A. Jarvis, Portland, OR (US); Scott G. Hansen, Portland, OR (US)

(73) Assignee: Oregon Health & Science University, Portland, OR (US)

( * ) Notice: Subject to any disclaimer, the term of this patent is extended or adjusted under 35 U.S.C. 154(b) by 0 days.

(21) Appl. No.: 13/694,280

(22) Filed: Nov. 14, 2012

(65) Prior Publication Data

US 2013/0136768 A1    May 30, 2013

Related U.S. Application Data

(63) Continuation-in-part of application No. PCT/US2011/036657, filed on May 16, 2011, which is a continuation-in-part of application No. PCT/US2011/029930, filed on Mar. 25, 2011.

(60) Provisional application No. 61/376,911, filed on Aug. 25, 2010, provisional application No. 61/334,976, filed on May 14, 2010.

(51) Int. Cl.
| | |
|---|---|
| *A61K 39/21* | (2006.01) |
| *C12N 15/63* | (2006.01) |
| *A61P 31/18* | (2006.01) |
| *C12N 15/38* | (2006.01) |
| *C12N 15/48* | (2006.01) |
| *C12N 15/49* | (2006.01) |
| *C07K 14/045* | (2006.01) |
| *C07K 14/16* | (2006.01) |
| *C12N 15/869* | (2006.01) |
| *A61K 39/12* | (2006.01) |
| *C12N 15/86* | (2006.01) |
| *A61K 39/00* | (2006.01) |
| *A61K 39/08* | (2006.01) |
| *A61K 39/13* | (2006.01) |
| *A61K 39/145* | (2006.01) |
| *A61K 39/275* | (2006.01) |

(52) U.S. Cl.
CPC .......... *C12N 15/869* (2013.01); *A61K 39/0011* (2013.01); *A61K 39/08* (2013.01); *A61K 39/12* (2013.01); *A61K 39/13* (2013.01); *A61K 39/145* (2013.01); *A61K 39/21* (2013.01); *A61K 39/275* (2013.01); *C12N 15/86* (2013.01); *A61K 2039/5254* (2013.01); *A61K 2039/5256* (2013.01); *C07K 14/045* (2013.01); *C07K 14/16* (2013.01); *C07K 14/161* (2013.01); *C07K 14/162* (2013.01); *C07K 14/163* (2013.01); *C12N 2710/16111* (2013.01); *C12N 2710/16134* (2013.01); *C12N 2710/16141* (2013.01); *C12N 2710/16143* (2013.01); *C12N 2710/16162* (2013.01); *C12N 2710/24134* (2013.01); *C12N 2740/15022* (2013.01); *C12N 2740/15034* (2013.01); *C12N 2760/14134* (2013.01); *C12N 2760/16134* (2013.01); *C12N 2770/32634* (2013.01)

(58) Field of Classification Search
CPC ... A61K 39/12; A61K 39/245; A61K 35/763; A61K 38/162; A61K 2039/525; A61K 2039/5256; A61K 2039/6075; C12N 15/86; C12N 7/00; C12N 2710/00011; C12N 2710/16111; C12N 2710/16143; C12N 15/869; C07K 14/005; C07K 16/088; C07K 14/045
See application file for complete search history.

(56) References Cited

U.S. PATENT DOCUMENTS

| | | | |
|---|---|---|---|
| 5,273,876 A | 12/1993 | Hock et al. | |
| 5,720,957 A | 2/1998 | Jones et al. | |
| 5,830,745 A | 11/1998 | Hock et al. | |
| 6,033,671 A | 3/2000 | Frueh et al. | |
| 7,892,822 B1 * | 2/2011 | Koszinowski et al. | 435/320.1 |
| 2002/0176870 A1 | 11/2002 | Schall et al. | |
| 2003/0118568 A1 | 6/2003 | Crew | |

(Continued)

FOREIGN PATENT DOCUMENTS

| | | |
|---|---|---|
| EP | 0521427 A1 | 1/1993 |
| WO | 88/10311 A1 | 12/1988 |

(Continued)

OTHER PUBLICATIONS

Bresnahan WA, Shenk TE. UL82 virion protein activates expression of immediate early viral genes in human cytomegalovirus-infected infected cells. Proc Natl Acad Sci U S A. Dec. 19, 2000;97(26):14506-11.*

(Continued)

*Primary Examiner* — Benjamin P Blumel
*Assistant Examiner* — Rachel Gill
(74) *Attorney, Agent, or Firm* — Schwabe Williamson & Wyatt

(57) ABSTRACT

The present invention relates to recombinant rhesus cytomegalovirus (RhCMV) and human cytomegalovirus (HCMV) vectors encoding heterologous antigens, such as pathogen-specific antigens or tumor antigens, which may be used, for example, for the treatment or prevention of infectious disease or cancer. The recombinant RhCMV or HCMV vectors elicit and maintain high level cellular immune responses specific for the heterologous antigen while including deletions in one or more genes essential or augmenting for CMV replication, dissemination or spread.

24 Claims, 44 Drawing Sheets

(56) References Cited

U.S. PATENT DOCUMENTS

| | | | |
|---|---|---|---|
| 2004/0086489 A1 | 5/2004 | Schall et al. | |
| 2004/0248300 A1* | 12/2004 | Preston | 435/456 |
| 2005/0064394 A1* | 3/2005 | Liu et al. | 435/5 |
| 2005/0118192 A1* | 6/2005 | Boursnell et al. | 424/199.1 |
| 2006/0019369 A1 | 1/2006 | Hahn | |
| 2008/0199493 A1 | 8/2008 | Picker et al. | |
| 2009/0148477 A1 | 6/2009 | Bruder et al. | |
| 2009/0203144 A1 | 8/2009 | Beaton et al. | |
| 2009/0297555 A1 | 12/2009 | Kemble et al. | |
| 2013/0136768 A1 | 5/2013 | Picker et al. | |
| 2013/0142823 A1* | 6/2013 | Picker et al. | 424/199.1 |
| 2013/0156808 A1 | 6/2013 | Jonjic | |
| 2013/0202638 A1 | 8/2013 | Thirion et al. | |

FOREIGN PATENT DOCUMENTS

| | | | |
|---|---|---|---|
| WO | 96/04383 A1 | 2/1996 | |
| WO | 02/062296 A2 | 8/2002 | |
| WO | 2006/031264 A2 | 3/2006 | |
| WO | 2011/093858 A1 | 8/2011 | |
| WO | WO 2011/119920 | 9/2011 | |
| WO | 2011/138040 A2 | 11/2011 | |
| WO | WO 2011138040 A2 * | 11/2011 | |
| WO | 2012/170765 A2 | 12/2012 | |

OTHER PUBLICATIONS

Hansen SG, Powers CJ, Richards R, Ventura AB, Ford JC, Siess D, Axthelm MK, Nelson JA, Jarvis MA, Picker LJ, Früh K. Evasion of CD8+ T cells is critical for superinfection by cytomegalovirus. Science. Apr. 2, 2010;328(5974):102-6.*

Mohr CA, Cicin-Sain L, Wagner M, Sacher T, Schnee M, Ruzsics Z, Koszinowski UH. Engineering of cytomegalovirus genomes for recombinant live herpesvirus vaccines. Int J Med Microbiol. Jan. 2008;298(1-2):115-25. Epub Aug. 16, 2007.*

Mohr CA, Arapovic J, Mühlbach H, Panzer M, Weyn A, Dölken L, Krmpotic A, Voehringer D, Ruzsics Z, Koszinowski U, Sacher T. A spread-deficient cytomegalovirus for assessment of first-target cells in vaccination. J Virol. Aug. 2010;84(15):7730-42. Epub May 12, 2010.*

Hansen SG, Vieville C, Whizin N, Coyne-Johnson L, Siess DC, Drummond DD, Legasse AW, Axthelm MK, Oswald K, Trubey CM, Piatak M Jr, Lifson JD, Nelson JA, Jarvis MA, Picker LJ. Effector memory T cell responses are associated with protection of rhesus monkeys from mucosal simian immunodeficiency virus challenge. Nat Med. Mar. 2009;15(3):293-9. Feb. 5, 2009.*

Mahmood K, Prichard MN, Duke GM, Kemble GW, Spaete RR. Human cytomegalovirus plasmid-based amplicon vector system for gene therapy. Genet Vaccines Ther. Jan. 26, 2005;3(1):1.*

Murphy E, Yu D, Grimwood J, Schmutz J, Dickson M, Jarvis MA, Hahn G, Nelson JA, Myers RM, Shenk TE. Coding potential of laboratory and clinical strains of human cytomegalovirus. Proc Natl Acad Sci U S A. Dec. 9, 2003;100(25):14976-81. Epub Dec. 1, 2003.*

Chang WL, Barry PA. Cloning of the full-length rhesus cytomegalovirus genome as an infectious and self-excisable bacterial artificial chromosome for analysis of viral pathogenesis. J Virol. May 2003;77(9):5073-83.*

Grimwood,J., Schmutz,J., Dickson,M., Jarvis,M., Hahn,G. Nelson,J.A., Murphy,E., Yu,D., Myers,R.M. and Shenk,T. NCBI GenBank Direct Submission. Acc. No. AC146906. Sub. Nov. 5, 2003.*

Oxxon Therapeutics Licenses Rights to Xenova's DISC-HSV and DISC-GM-CSF Vector Technologies. BusinessWire. Jan. 13, 2005.*

Dudek T, Knipe DM. Replication-defective viruses as vaccines and vaccine vectors. Virology. Jan. 5, 2006;344(1):230-9.*

Borst E, Messerle M. Development of a cytomegalovirus vector for somatic gene therapy. Bone Marrow Transplant. May 2000;25 Suppl 2:S80-2.*

McGregor A, Liu F, Schleiss MR. Molecular, biological, and in vivo characterization of the guinea pig cytomegalovirus (CMV) homologs of the human CMV matrix proteins pp71 (UL82) and pp65 (UL83). J Virol. Sep. 2004;78(18):9872-89.*

Dunn W, Chou C, Li H, Hai R, Patterson D, Stolc V, Zhu H, Liu F. Functional profiling of a human cytomegalovirus genome. Proc Natl Acad Sci U S A. Nov. 25, 2003;100(24):14223-8. Epub Nov. 17, 2003.*

Lilja AE, Chang WL, Barry PA, Becerra SP, Shenk TE. Functional genetic analysis of rhesus cytomegalovirus: Rh01 is an epithelial cell tropism factor. J Virol. Mar. 2008;82(5):2170-81. Epub Dec. 19, 2007.*

Marshall KR, Rowley KV, Rinaldi A, Nicholson IP, Ishov AM, Maul GG, Preston CM. Activity and intracellular localization of the human cytomegalovirus protein pp71. J Gen Virol. Jul. 2002;83(Pt 7):1601-12.*

Kalejta RF. Human cytomegalovirus pp71: a new viral tool to probe the mechanisms of cell cycle progression and oncogenesis controlled by the retinoblastoma family of tumor suppressors. J Cell Biochem. Sep. 1, 2004;93(1):37-45.*

Cantrell SR, Bresnahan WA. Human cytomegalovirus (HCMV) UL82 gene product (pp71) relieves hDaxx-mediated repression of HCMV replication. J Virol. Jun. 2006;80(12):6188-91.*

Scott G. Hansen, et al., Profound Early Control of Highly Pathogenic SIV by an Effector Memory T-Cell Vaccine, Nature (2011) vol. 476, No. 7348, p. 523-527.

Wang, X., et al., Murine Cytomegaloviurs Abortively Infects Human Dendritic Cells, Leading to Expression and Presentation of Virally Vectored Genes, Journal of Virology (2003)vol. 77, No. 13, p. 7182-7192.

Davison et al , "New Genes from Old: Redeployment of dUTPase by Herpesviruses," Journal of Virology, 2005, vol. 79, No. 20, pp. 12880-12892.

Karrer et al., "Expansion of Protective CD8+ T-Cell Responses Driven by Recombinant Cytomegaloviruses," Journal of Virology, Mar. 2004, vol. 78, No. 5, pp. 2255-2264.

Murphy, Cynthia G. et al.,"Vaccine Protection against Simian Immunodeficiency Virus by Recombinant Strains of Herpes Simplex Virus," Journal of Virology, Sep. 2000, vol. 74, No. 17, pp. 7745-7754.

Rizvanov, Albert et al., "Generation of a Recombinant Cytomegalovirus for Expression of a Hantavirus Glycoprotein," Journal of Virology, 2003, vol. 77, No. 22, pp. 12203-12210.

Hansen, Scott G., et al., "Complete Sequence and Genomic Analysis of Rhesus Cytomegalovirus," Journal of Virology, Jun. 2003, vol. 77, No. 12, pp. 6620-6636.

Borst, Eva Maria et al., "Construction of a Cytomegalovirus-Based Amplicon: A Vector with a Unique Transfer Capacity," Human Gene Therapy, Jul. 1, 2003, vol. 14, pp. 959-970.

Ulmer, Jeffrey B., "Tuberculosis DNA Vaccines," Scandinavian Journal of Infectious Disease, 2001, vol. 33, pp. 246-248.

Onuffer, James J., "Chemokines, Chemokine Receptors and Small-molecule Antagonists: Recent Developments," Trends in Pharmacological Sciences, Oct. 2002, vol. 23, No. 10, pp. 459-467.

Redwood, Alec J. et al., "Use of a Murine Cytomegalovirus K181-Derived Bacterial Artificial Chromosome as a Vaccine Vector for Immunocontraception," Journal of Virology, Mar. 2005, vol. 79, No. 5, pp. 2998-3008.

Tessmer, Marlowe S. et al., "Salivary Gland NK Cells are Phenotypically and Functionally Unique," PLoS Pathogens, Jan. 2011, vol. 7, Issue 1, pp. 1-9.

Powers, Colin et al., "Rhesus CMV: An Emerging Animal Model for Human CMV," Med Microbiol Immunol., Jun. 2008, vol. 197, No. 2, pp. 109-115.

Campadelli-Flume, et al., Editors, "Chapter 15: Betaherpes Viral Genes and Their Functions" Human Herpesviruses: Biology, Therapy, and Immunoprophylaxis. Cambridge: Cambridge University Press, 2007.

Basta, Sameh, et al., "Inhibitory Effects of Cytomegalovirus Proteins US2 and US11 Point to Contributions from Direct Priming and Cross-Priming in Induction of Vaccinia Virus-Specific CD8+ T Cells," The Journal of Immunology, 2002, vol. 168, pp. 5403-5408.

(56) References Cited

OTHER PUBLICATIONS

Jones, Thomas R. et al., "Replacement Mutagenesis of the Human Cytomegalovirus Genome: US10 and US11 Gene Products are Nonessential," Journal of Virology, Nov. 1991, vol. 65, No. 11, pp. 5860-5872.

Wiertz, Emmanuel J.H.J. et al, "The Human Cytomegalovirus US11 Gene Product Dislocates MHC Class I Heavy Chains from the Endoplasmic Reticulum to the Cytosol," Cell, Mar. 8, 1996, vol. 84, pp. 769-779.

Jones, Thomas R. et al., "Multiple Independent Loci Within the Human Cytomegalovirus Unique Short Region Down-Regulate Expression of Major Histocompatibility Complex Class I Heavy Chains," Journal of Virology, Aug. 1995, vol. 69, No. 8, pp. 4830-4841.

Chau, Nha H. et al., "Transcriptional Regulation of the Human Cytomegalovirus US11 Early Gene," Journal of Virology, Feb. 1999, vol. 73, No. 2, pp. 863-870.

Besold, K. et al., "Immune Evasion Proteins gpUS2 and gpUS11 of Human Cytomegalovirus Incompletely Protect Infected Cells from CD8 T Cell Recognition," Virology, 2009, vol. 391, pp. 5-19.

Office Action for U.S. Appl. No. 11/597,457, mailed Aug. 4, 2015.

Cantrell, Stacy R. et al., "Interaction Between the Human Cytomegalovirus UL82 Gene Product (pp71) and hDaxx Regulates Immediate-Early Gene Expression and Viral Replication," Journal of Virology, Jun. 2005, vol. 79, No. 12, pp. 7792-7802.

Bresnahan, Wade et al., "Replication of Wild-Type and Mutant Human Cyomegalovirus in Life-Extended Human Diploid Fibroblasts," Journal of Virology, Nov. 2000, vol. 74, No. 22, pp. 10816-10818.

Schleiss, Mark R. et al., "Genetically Engineered Live-attenuated Cytomegalovirus (CMV) Vaccines Improve Pregnancy Outcome in the Guinea-pig Model of Congenital CMV Infection," Retrovirology, Apr. 2008, vol. 5, Suppl I, pp. 1-3.

Kaech, Susan M. et al., "Effector and Memory T-Cell Differentiation: Implications for Vaccine Development," Nature Reviews, Apr. 2002, vol. 2 pp. 251-262.

Halary, Franck et al., "Human Cytomegalovirus Binding to DC-SIGN is Required for Dendritic Cell Infection and Target Cell trans-Infection," Immunity, Nov. 2002, vol. 17, pp. 653-664.

Moutaftsi, Magdalena et al., "Human Cytomegalovirus Inhibits Maturation and Impairs Function of Monocyte-derived Dendritic Cells," Blood, Apr. 15, 2002, vol. 99, No. 8, pp. 2913-2921.

Gorman, Shelley et al., "Prior Infection with Murine Cytomegalovirus (MCMC) limits the Immunocontraceptive Effects of an MCMV Vector Expressing the Mouse-zona-pellucida-3 Protein," Vaccine, Jun. 2008, vol. 26, pp. 3860-3869.

Plotkin, Stanley A. et al., "Vaccines for the Prevention of Human Cytomegalovirus Infection," Reviews of Infectious Diseases, Sep.-Oct. 1990, vol. 12, Supplement 7, pp. S827-S838.

Olaleye, O.D. et al., "Cytomegalovirus Infection Among Tuberculosis Patients in a Chest Hospital in Nigeria," Comp. Immun. Microbiol. Infect. Dis. 1990, vol. 13, No. 2, pp. 101-106.

Hagemeier, SC, "Functional Analysis of the Human Cytomegalovirus UL82 Gene Product PP71 During Virus Replication," Doctoral Dissertation, The University of Texas Southwestern Medical at Dallas, May 2007, pp. 1-181.

Brondke, H. "Human Herpesvirus 5, Towne Strain," US6 (NCBI GenBank Acc. No. AAS49004), Dep. Apr. 8, 2004.

Brondke, H. "Human Herpesvirus 5, Towne Strain," US3 (NCBI GenBank Acc. No. AAS49002), Dep. Apr. 8, 2004.

Ryckman, Brent J. et al., "Characterization of the Human Cytomegalovirus gH/gL/US128-131 Complex That Mediates Entry into Epithelian and Endothelial Cells," Journal of Virology, Jan. 2008, vol. 82, No. 1, pp. 60-70.

Hahn, Gabriele et al., "Human Cytomegalovirus UL 131-128 Genes are Indispensible for Virus Growth in Endothelial Cells and Virus Transfer to Leukocytes," Journal of Virology, Sep. 2004, vol. 78, No. 18, pp. 10023-10033.

Oxford, Kristie et al., "Protein Coding Content of the ULb' Region of Wild-type Rhesus Cytomegalovirus," Virology, Mar. 30, 2008, vol. 373, No. 1, pp. 181-183.

\* cited by examiner

FIG. 28A

MCMV/ZEBOV-NP_CTL

MCMV IE2 C-term    ZEBOV NP epitope

—⋀—[RKKIQ]VYQVNNLEEIC

MCMV genome

M122 (IE2 locus)

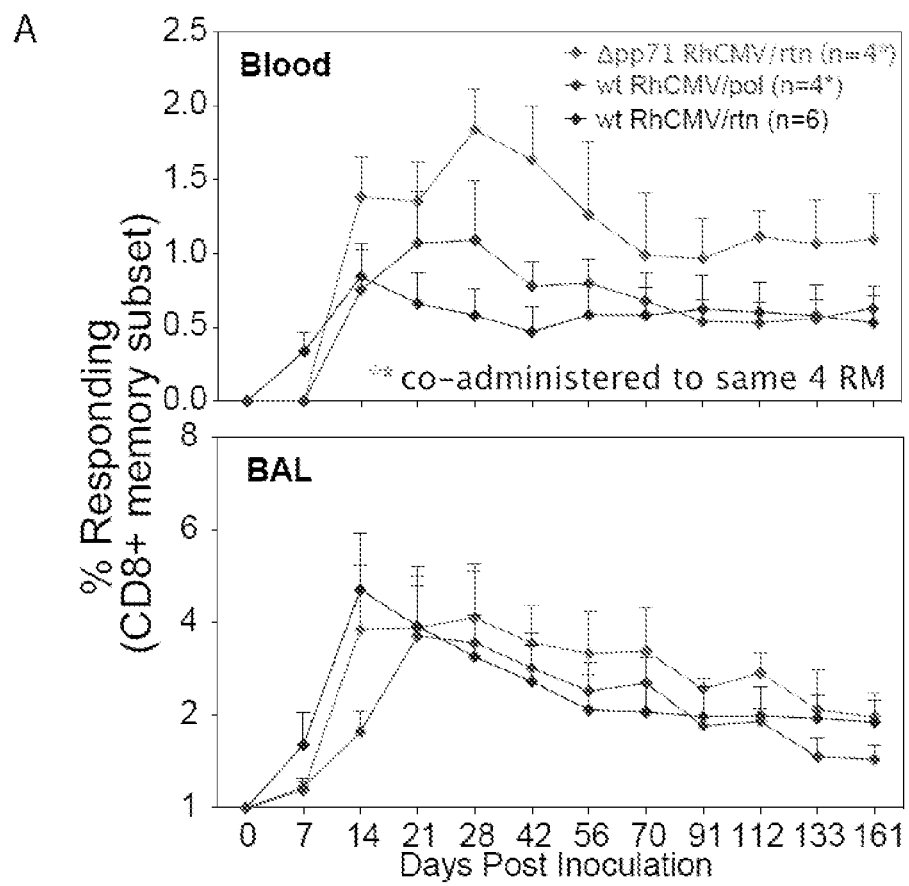
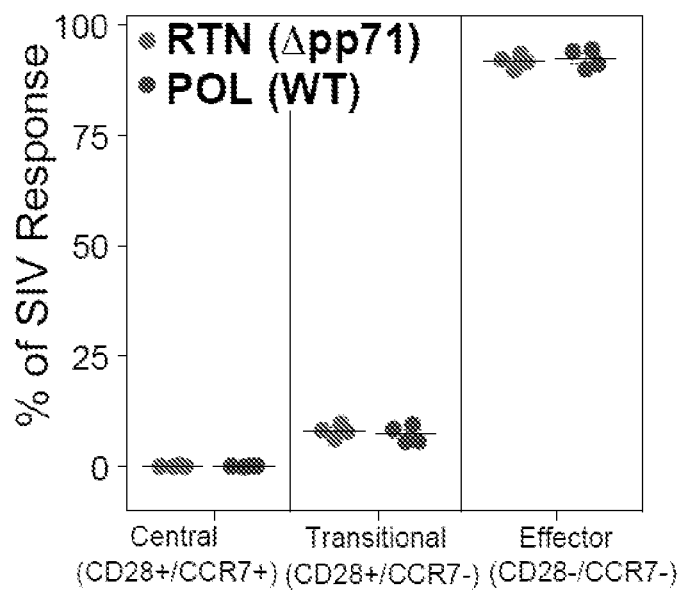
FIG. 38 A-B

A.
MCMV/TetC
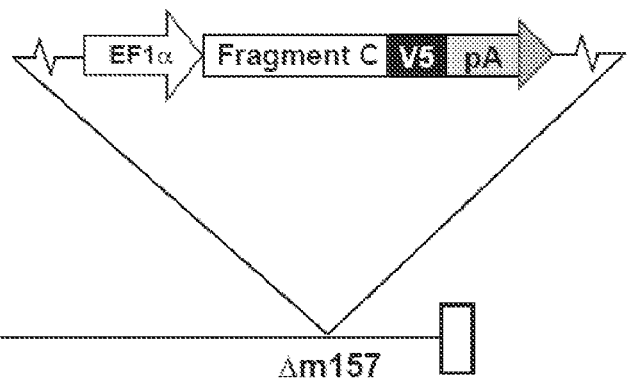
MCMV genome
B.
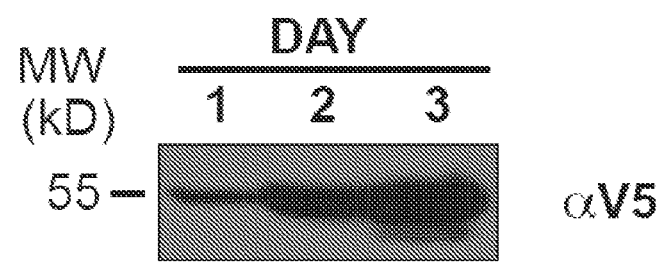
FIG. 39 A-B

RECOMBINANT HCMV AND RHCMV VECTORS AND USES THEREOF

RELATED APPLICATIONS AND INCORPORATION BY REFERENCE

This application is a continuation-in-part application of international patent application PCT/US2011/036657 filed May 16, 2011 and published as WO 2011/143653 on Nov. 17, 2011, which claims priority to U.S. provisional patent application Ser. Nos. 61/334,976 filed May 14, 2010 and 61/376,911 filed Aug. 25, 2010 and PCT Application PCT/US2011/029930 filed Mar. 25, 2011.

The foregoing applications, and all documents cited therein or during their prosecution ("appln cited documents") and all documents cited or referenced in the appln cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

FEDERAL FUNDING LEGEND

This invention was supported, in part, by grant numbers AI088442, AI21640, AI059457, AI070890, AI070890-03S1 and AI060392 awarded by the National Institute of Allergy and Infectious Disease of the National Institutes of Health, and grant number RR00163 from the National Center of Research Resources of the National Institutes of Health. The federal government may have certain rights to this invention.

FIELD OF THE INVENTION

This invention relates to recombinant cytomegalovirus (CMV) vectors, such as human CMV (HCMV) and rhesus macaque CMV (RhCMV) vectors, encoding heterologous antigens and/or being deficient in genes that are non-essential for growth in vivo and/or being deficient in genes that affect replication, dissemination within the host, and spreading between hosts, and/or targeting to different cell types (tropism). In particular, the invention relates to use of recombinant CMV vectors as vaccines for the treatment or prevention of infectious disease or cancer.

BACKGROUND OF THE INVENTION

Since the emergence of the AIDS epidemic in the early 1980s, investigators have been focused on the development of an effective vaccine for HIV. However, this effort has been wrought with difficulties for a variety of reasons, including 1) explosive initial HIV replication causing rapid systemic infection, 2) potent genetic mechanisms mediating innate and adaptive immune evasion, 3) genetic malleability and immune escape, 4) host immune suppression, and 5) the ability of HIV to integrate within the host genome and latently infect long-lived cells. These inherent characteristics of HIV have made it difficult to use traditional vaccine approaches to generate a protective immune response using HIV antigens either expressed as recombinant proteins or in combination with non-replicating viral vector expression systems (prime-boost) (Barouch, D. H. 2008. Challenges in the development of an HIV-1 vaccine. *Nature* 455:613-619). One of the goals of this project is to generate an effective and safe HIV vaccine using HCMV as a vaccine vector.

CMV is an ubiquitous virus and a member of the beta subclass of the herpesvirus family. It is a large, double stranded DNA virus (genome of approximately 230 kB) that establishes life-long latent or persistent infection. In developed countries such as the United States, approximately 70% of the population is infected by HCMV depending on socio-economic status. In contrast to gamma herpesviruses such as Epstein-Barr virus and Kaposi's sarcoma-associated herpesvirus, HCMV is non-transforming and non-oncogenic. A live, attenuated CMV vaccine (based on the human CMV Towne strain, which lacks a portion of the CMV genome) has been administered by subcutaneous injection to over 800 subjects in a phase II and III safety and efficacy trials (Arvin et al. 2004 Clin. Infect. Dis. 39:233-239). While this vaccine was found to be safe, it was not completely efficacious. More recently, in an attempt to increase its efficacy, some of the missing genes in the Towne-based vaccine strain were replaced. This vaccine has been tested in phase II safety studies, and was found to be safe (Arvin et al. 2004, Clin. Infect. Dis. 39:233-239).

Although HCMV is generally benign in healthy individuals, the virus can cause devastating disease in immunocompromised populations resulting in high morbidity and mortality (for review, see (Pass, R. F. 2001. Cytomegalovirus, p. 2675-2705. In P. M. H. David M. Knipe, Diane E. Griffin, Robert A. Lamb Malcolm A. Martin, Bernard Roizman and Stephen E. Straus (ed.), Fields Virology, 4th ed. Lippincott Williams & Wilkins, Philadelphia and Kenneson, A., and Cannon, M. J. 2007. Review and meta-analysis of the epidemiology of congenital cytomegalovirus (CMV) infection. Rev Med Virol 17:253-276)). Recent increases in the number of patients undergoing immunosuppressive therapy following solid organ (SOT) or allogeneic hematopoietic cell transplantation (HCT), as well as the expanded use of HCT for diseases such as sickle cell anemia, multiple sclerosis and solid cancers have increased the number of patient populations susceptible to HCMV disease (Chou, S. 1999. Transpl Infect Dis 1:105-14, Nichols, W. G., and M. Boeckh. 2000. J Clin Virol 16:25-40 and Sepkowitz, K. A. 2002. Clin Infect Dis 34:1098-107). HCMV is also the most common congenital viral infection, and the leading infectious cause of central nervous system maldevelopment in neonates (Fowler, K. B. et al. 1997. J Pediatr 130:624-30, Larke, R. P. et al. 1980. J Infect Dis 142:647-53 and Peckham, C. S. et al. 1983. Lancet 1:1352-5). In this regard, HCMV is considered the major cause of sensorineural deafness in neonates independent of infectious status (Fowler, K. B. et al. 1997. J Pediatr 130:624-30). HCMV therefore remains a major cause of mortality in multiple patient populations emphasizing the need for new antiviral pharmacologic and vaccine strategies. Immunity induced by natural wild-type (WT) CMV infection has consistently been shown unable to prevent CMV re-infection (see below). This unique characteristic of CMV presumably explains the poor efficacy of candidate vaccines in trials to prevent CMV infection (Pass, R. F. et al. 2009. N Engl J Med 360:1191-9). Nevertheless, immunity to HCMV acquired through natural infection has been shown to significantly decrease maternal to fetal transmission of HCMV during pregnancy. This observation would indicate that induction of an immunity in pregnant women that is comparable to that induced by natural CMV infection, but that is induced in a safe manner, may be able to decrease maternal to fetal transmission and have a significant impact on clinical CMV disease in the neonate. HCMV-specific T cell immunity has also been shown to afford protection against CMV disease in transplant patients, presenting another population wherein the ability to safely induce an immunity comparable to that acquired by natural CMV infection would have a clinical impact on CMV disease (Leen, A. M., and H. E. Heslop. 2008. Br J Haematol 143:169-79, Riddell, S. R., and P. D. Greenberg. 2000. J Antimicrob Chemother 45 Suppl T3:35-43 and Riddell, S. R. et al. 1994. Bone Marrow Transplantation 14:78-84). Cytomegalovirus is highly immunogenic, but has evolved immune evasion mechanisms to enable virus persistence and re-infection of the sero-positive host:

The immunological resources specifically devoted to controlling HCMV infection are enormous, with CMV being one of the most immunogenic viruses known. High antibody titers are directed against the main HCMV envelope glycoprotein (gB) during primary infection of healthy individuals (Alberola, J. et al. 2000. J Clin Virol 16:113-22 and Rasmussen, L. et al. 1991. J Infect Dis 164:835-42), and against multiple viral proteins (both structural and non-structural) during MCMV infection of mice (Farrell, H. E., and G. R. Shellam. 1989. J Gen Virol 70 (Pt 10):2573-86). A large proportion of the host T cell repertoire is also directed against CMV antigens, with 5-10 fold higher median $CD4^+$ T cell response frequencies to HCMV than to acute viruses (measles, mumps, influenza, adenovirus) or even other persistent viruses such as herpes simplex and varicella-zoster viruses (Sylwester, A. W. et al. 2005. J Exp Med 202:673-85). A high frequency of $CD8^+$ responses to defined HCMV epitopes or proteins is also commonly observed (Gillespie, G. M. et al. 2000. J Virol 74:8140-50, Kern, F. et al. 2002. J Infect Dis 185:1709-16, Kern, F. et al. 1999. Eur J Immunol 29:2908-15, Kern, F. et al. 1999. J Virol 73:8179-84 and Sylwester, A. W. et al. 2005. J Exp Med 202:673-85). In a large-scale human study quantifying $CD4^+$ and $CD8^+$ T cell responses to the entire HCMV genome, the mean frequencies of CMV-specific $CD4^+$ and $CD8^+$ T cells exceeded 10% of the memory population for both subsets (Sylwester, A. W. et al. 2005. J Exp Med 202: 673-85). In an embodiment of the invention, it was not unusual for CMV-specific T cells to account for >25% of the memory T cell repertoire of a specific individual or at specific tissue sites. The clinical importance of this high level of CMV-specific immunity is most clearly shown by the occurrence of multi-organ CMV disease in immune-suppressed individuals during transplantation, and the ability of adoptive transfer of T cells to protect these patients from CMV disease (Riddell, S. R. et al. 1994. Bone Marrow Transplantation 14:78-84).

In summary, despite the apparent safety of live, attenuated CMV vaccines, significant concerns remain with live CMV-based vaccine strategies. Given the problems that can arise in immunosuppressed individuals, such as AIDS patients, organ transplant recipients, or infants who were infected in utero and that potential recipients of a CMV-based vaccine may be or become immunodeficient, significantly limiting the utility of a live CMV vaccine. Thus, a continuing need exists for a CMV vaccine vector that is safe and efficacious in all individuals.

Citation or identification of any document in this application is not an admission that such document is available as prior art to the present invention.

SUMMARY OF THE INVENTION

The present invention relates to recombinant vectors, advantageously viral vectors such as RhCMV or HCMV vectors which may comprise a nucleic acid sequence encoding a heterologous antigen, wherein the heterologous antigen is a human pathogen-specific antigen or a tumor antigen. The antigen may be a viral antigen, a bacterial antigen, a fungal antigen, a protozoan antigen or an antigen expressed by a hematological cancer.

The RhCMV or HCMV vectors of the present invention may contain deletions. The deletion may be in gene regions non-essential for growth in vivo. The gene regions may be in the RL11 family, the pp65 family, the US12 family and the US28 family. The deleted gene may be US2, US3, US6, US11, UL82, UL94, UL32, UL99, UL115 or UL44, or a homolog thereof.

The RhCMV vector may have deletions of Rh182-189, Rh158-166. The RhCMV vector may also have deletions in gene regions in the RL11 family, the pp65 family, the US12 family and the US28 family. In particular, the RhCMV vector may have deletions in Rh13-Rh29, Rh111-RH112, Rh191-Rh202 and Rh214-Rh220, specifically Rh13.1, Rh19, Rh20, Rh23, Rh24, Rh112, Rh190, Rh192, Rh196, Rh198, Rh199, Rh200, Rh201, Rh202 and Rh220.

The RhCMV or HCMV vector may also be a tropism defective vector. Advantageously, the tropism-defective vector may lack genes required for optimal growth in certain cell types or may contain targets for tissue-specific micro-RNAs in genes essential for viral replication. In particular, the tropism defective vector may have an epithelial, central nervous system (CNS), macrophage deficient tropism or a combination thereof.

The HCMV vector may also have deletions in gene regions in the RL11 family, the pp65 family, the US12 family and the US28 family. In particular, the HCMV vector may have deletions in RL11, UL6, UL7, UL9, UL11, UL83 (pp65), US12, US13, US14, US17, US18, US19, US20, US21 and UL28.

Further objects of the invention include any or all of: to provide expression products from such recombinants, methods for expressing products from such recombinants, compositions containing the recombinants or the expression products, methods for using the expression products, methods for using the compositions, DNA from the recombinants, and methods for replicating DNA from the recombinants.

The present invention also relates to a method of treating a subject with an infectious disease, or at risk of becoming infected with an infectious disease, or with cancer, or at risk of developing cancer, comprising selecting a subject in need of treatment and administering to the subject the recombinant RhCMV or HCMV vector disclosed herein.

Accordingly, it is an object of the invention to not encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. §112, first paragraph) or the EPO (Article 83 of the EPC), such that Applicants reserve the right and hereby disclose a disclaimer of any previously described product, process of making the product, or method of using the product.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

BRIEF DESCRIPTION OF THE DRAWINGS

The following detailed description, given by way of example, but not intended to limit the invention solely to the specific embodiments described, may best be understood in conjunction with the accompanying drawings.

FIG. 28 (a) is a schematic representation of MCMV/ZE-BOV-NP$_{CTL}$ and MCMV-derived vector carrying the CTL-epitope of the NP protein of ebolavirus Zaire (SEQ ID NO: 16). (b) shows a graphical representation of the results of an immunogenicity study in H2b-restricted 129S1/SvlmJ/Cr mice when immunized with different MCM vector constructs. (c) shows a graphical representation of the typical responses from MCMV/ZEBOV-NP$_{CTL}$ vaccinated mice. The majority of ZEBOV NP-responding T cells are polyfunctional (expressing both IFNγ and TNFα) and are specific for the NP epitope (not observed following incubation with the PSA peptide or unstimulated controls). Consistent with MCMV infection, all mice demonstrate T cell responses to MCMV M45.

FIG. 30 is a graph showing that MCMV/ZEBOV-NP$_{CTL}$ induces a ZEBOV-specific T cell response in C57BL/6 mice.

FIG. 31 (a) is a graph showing the protective efficacy of MCMV/ZEBOV-NP$_{CTL}$ in terms of survival (%). (b) is a graph showing the efficacy of MCMV/ZEBOV-NP$_{CTL}$ in terms of change in body weight (%). (c) is a graph showing the protective efficacy of MCMV/ZEBOV-NP$_{CTL}$ in terms of viremia (FFU/ml).

FIG. 39 shows construction and in vitro characterization of MCMV/TetC. (a) Schematic representation of MCMV/TetC. A V5 epitope-tagged 50 kD fragment C of tetanus toxin was placed under control of the EF1α promoter and inserted into the MCMV genome to replace the M157 gene within the MCMV BAC, pSMfr3. (b) In vitro growth analysis of reconstituted viruses showed replication kinetics comparable to WT MCMV. Error bars show the standard deviation (s.d.).

SEQUENCE LISTING

Figure 1:
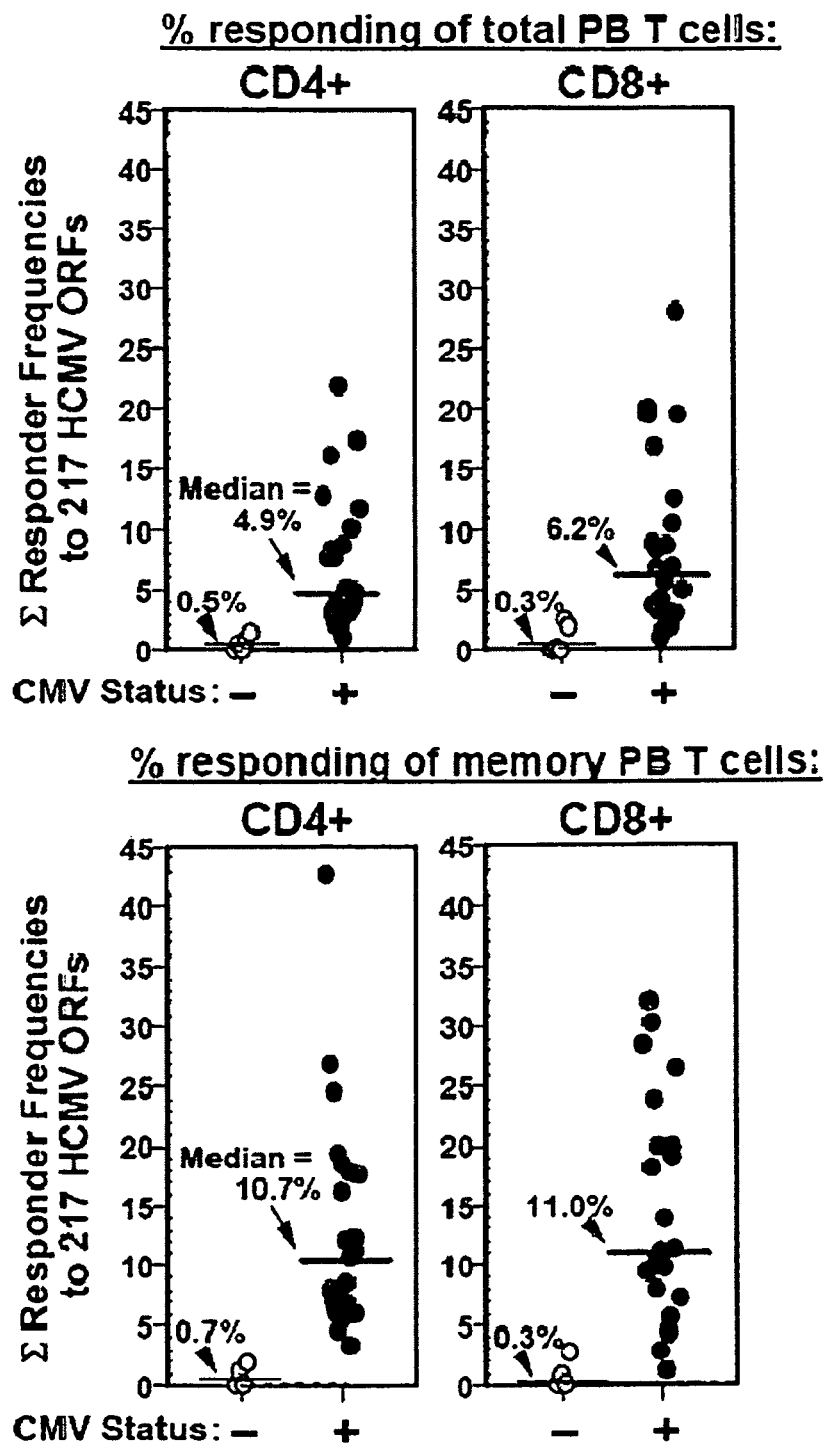
FIG. 1 is a pair of graphs showing the percentage of $CD4^+$ and $CD8^+$ T cells in CMV-positive and CMV-negative subjects that respond to HCMV ORFs. Shown is the percentage of responsive T cells from total peripheral blood (PB) T cells (top) or from memory PB T cells (bottom).

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand.

The instant application contains a "lengthy" Sequence Listing which has been submitted via CD-R in lieu of a printed paper copy, and is hereby incorporated by reference in its entirety. Said CD-R, recorded on Jan. 31, 2012, are labeled "CRF," "Copy 1—SEQUENCE LISTING PART," "Copy 2—SEQUENCE LISTING PART," and "Copy 3—SEQUENCE LISTING PART," respectively, and each contains only one identical 2,727,936 byte file (43275992.txt).

In the accompanying sequence listing:

SEQ ID NO: 1 is the nucleotide sequence of RhCMV (Cercopithecine herpesvirus 8).

SEQ ID NO: 2 is the nucleotide sequence of HCMV (AD169 lab strain).

SEQ ID NO: 3 is the nucleotide sequence of HCMV (wild type strain Merlin).

SEQ ID NO: 4 is the nucleotide sequence of the Towne BAC HCMV isolate.

SEQ ID NO: 5 is the nucleotide sequence of the PH-BAC HCMV isolate.

SEQ ID NO: 6 is the nucleotide sequence of the Toledo-BAC HCMV isolate.

SEQ ID NO: 7 is the nucleotide sequence of the TR-BAC HCMV isolate.

SEQ ID NO: 8 is the nucleotide sequence of the FIX-BAC HCMV isolate.

SEQ ID NO: 9 is the nucleotide sequence of the AD 169-BAC HCMV isolate.

SEQ ID NO: 10 is the nucleotide sequence of SIV.

SEQ ID NO: 11 is the amino acid sequence of SIV gag-pol.

SEQ ID NO: 12 is the amino acid sequence of the SIV gag protein.

DETAILED DESCRIPTION OF THE INVENTION

Paradoxically, the high levels of CMV-specific immunity are unable to either eradicate the virus from the healthy infected individual, or confer protection of the CMV seropositive individual against re-infection. This ability of CMV to escape eradication by the immune system, and to re-infect the sero-positive host has long been believed to be linked to the multiple viral immunomodulators encoded by the virus (for review, see (Mocarski, E. S., Jr. 2002. Trends Microbiol 10:332-9)). Consistent with persistent replication/chronic reactivation within the host, CMV also induces and maintains a characteristic and unique T cell immune response. Memory T cells induced by vaccination or infection can be broadly characterized into either effector ($T_{EM}$) or central ($T_{CM}$) memory, which follow from the distinct functions of these two memory populations (Cheroutre, H., and L. Madakamutil. 2005. Cell Mol Life Sci 62:2853-66, Mackay, C. R. et al. 1990. J Exp Med 171:801-17, Masopust, D. et al. 2001. Science 291:2413-7, Sallusto, F. et al. 1999. Nature 401:708-12 and Wherry, E. J. et al. 2003. Nat Immunol 4:225-34). Embodiments of the invention that relate to immunomodulators and the unique T-cell response elicited by HCMV are further described in PCT/US2011/029930.

Other embodiments of the invention relate to attenuated CMV vaccines which are unable or impaired in their ability to replicate in cells and tissues associated with CMV transmission and disease. The basis for this vaccine approach is the unique ability of HCMV to induce large and durable effector memory T cell ($T_{EM}$) responses to viral antigens provides HCMV-based vectors with the potential to generate high frequency effector site-based T cell responses that would intercept and suppress HIV replication very early in infection, when the virus is most vulnerable to immune control. Immunization of rhesus macaques (RMs) with replication competent RhCMV/SIV vaccine vectors induce a large, long-lasting $T_{EM}$ response to SIV antigens that provided protective immunity to 50% of the animals following rectal challenge with highly pathogenic SIVmac239 (Hansen, S. G., Vieville, C., Whizin, N., Coyne-Johnson, L., Siess, D. C., Drummond, D. D., Legasse, A. W., Axthelm, M. K., Oswald, K., Trubey, C. M., et al. 2009. Effector memory T cell responses are associated with protection of rhesus monkeys from mucosal simian immunodeficiency virus challenge. Nat Med 15:293-299) Both the anti-SIV immune response and protection mediated by these RhCMV/SIV vectors was unprecedented compared to current vaccine candidates, and now provides the basis for the development of an effective HIV vaccine.

In addition, embodiments of the present invention relate to the unique ability of RhCMV to re-infect sero+ RM in spite of the presence of a significant anti-RhCMV immune response. In contrast, most current HIV vaccine vectors (i.e., pox and adenovirus-based vectors) are compromised by anti-vector immunity allowing for only a single effective use of these vaccine platforms. This inherent property of CMV vectors can be attributed to the extensive repertoire of immune evasion genes encoded by this virus (Hansen, S. G., Powers, C. J., Richards, R., Ventura, A. B., Ford, J. C., Siess, D., Axthelm, M. K., Nelson, J. A., Jarvis, M. A., Picker, L. J., et al. 2010. Evasion of CD8+ T cells is critical for superinfection by cytomegalovirus. Science 328:102-106). Another further advantage of CMV-based vectors is the potential to insert large cassettes expressing SIV/HIV antigens in which theoretically over 50 kb of the viral genome can be replaced with foreign DNA. Together, these characteristics of CMV-based vaccine vectors have enabled development of a RhCMV/SIV vaccine that is capable of inducing a robust $T_{EM}$ response to multiple SIV antigens and completely controlling viral replication in mucosally SIV-challenged RM prior to the establishment of progressive, systemic infection: a feat that has not been achieved with previous vaccine approaches.

RhCMV/SIV vector may be an effective SIV vaccine but the major concern of using a fully replication competent HCMV as an HIV vaccine vector is one of safety. Since CMV establishes a life-long infection of the host, the window for realization of any pathogenic potential of a CMV-based vaccine extends from the time of vaccination for the life of the individual. During this window (potentially >80 years) it is expected that some vaccinees will encounter periods of immune-suppression, whether this be as a consequence of iatrogenic immune conditioning prior to transplantation, or as a consequence of disease, as with HIV infection or cancer. HCMV is also frequently shed into saliva, urine and breast milk from healthy CMV-infected individuals for periods of time that range from months to years. This potential of vaccine spread from vaccinated to non-vaccinated individuals is a characteristic of live-attenuated vaccines, such as the oral polio vaccine (OPV) (Heymann, D. L., Sutter, R. W., and Aylward, R. B. 2006. A vision of a world without polio: the OPV cessation strategy. Biologicals 34:75-79). With clear precedent from experience with OPV in the Global Polio Eradication Initiative, a potential for environmental spread will pose an additional major hurdle to development of an HCMV/HIV vaccine. These characteristics of CMV must be addressed before a CMV-based vaccine will be acceptable for general use in the human population.

Embodiments of this invention address issues of virus shedding and pathogenesis and relate to two potentially complementary approaches to generate a safe and effective vaccines using the CMV vectors. One approach focuses on development of CMV vectors that are either completely or conditionally spread defective or severely restricted in their replication, but that remain capable of inducing a protective immune response against a heterologous antigen. The second approach focuses on the generation of replication competent CMV vectors that are unable to infect epithelial cells—a cell type important for virus shedding, as well as a major cell type in the lung associated with CMV pneumonia. Some embodiments of the invention may relate to additional safety features into these vectors, including a block in replication in neural and myeloid cells. The optimal CMV vector will be unable to shed from vaccinated individuals, nor cause disease in fetuses or immunocompromised adult RMs, but will still induce a protective immune response against infectious diseases or tumors. Disclosed herein is the generation of an HCMV-based HIV vaccine candidate that will be potentially highly effective against HIV infection, acceptably safe for all human target populations, non-transmissible from person to person by contact, and therefore ready for translation into human clinical trials.

The present invention relates to HCMV and RhCMV recombinant vectors that encode heterologous antigens that elicit and maintain high level cellular and humoral immune responses specific for the encoded antigen. The present invention also relates to attenuated CMV vaccines which are limited in their ability to replicate in cells and tissues associated with CMV transmission and disease.

Further objects of the invention include any or all of: providing expression products from such recombinants, methods for expressing products from such recombinants, compositions containing the recombinants or the expression products, methods for using the expression products, methods for using the compositions, DNA from the recombinants, and methods for replicating DNA from the recombinants.

Thus, provided herein are recombinant RhCMV or HCMV vectors including a nucleic acid sequences encoding heterologous antigens. In some embodiments, the heterologous antigen is a pathogen-specific antigen. In other embodiments, the heterologous antigen is a tumor antigen. In some embodiments, the disclosed vectors include a deletion in one or more CMV genes encoding an immunomodulatory protein. In some embodiments, the disclosed CMV vectors include a deletion in one or more genes essential for CMV replication. Further provided are compositions comprising the recombinant RhCMV or HCMV vectors and a pharmaceutically acceptable carrier as well as the use of such composition in treating a subject.

Also provided is a method of treating a subject with an infectious disease, or at risk of becoming infected with an infectious disease, and a method of treating a subject with cancer, or at risk of developing cancer. The methods include selecting a subject in need of treatment and administering to the subject a recombinant RhCMV or HCMV vector encoding a heterologous antigen, or a composition thereof.

Further provided are recombinant RhCMV or HCMV vectors including a deletion in one or more RhCMV or HCMV genes that are essential for or augments replication. In some embodiments, at least one essential or augmenting gene is UL82, UL94, UL32, UL99, UL115 or UL44, or a homolog thereof. In some embodiments, the recombinant RhCMV or HCMV vectors further include a heterologous antigen, such as a pathogen-specific antigen or a tumor antigen. Recombinant RhCMV and HCMV vectors having a deletion in an essential gene and encoding a heterologous antigen can be used, for example, as vaccines for the treatment of infectious disease or cancer. In the absence of a heterologous antigen, the recombinant RhCMV and HCMV vectors having a deletion in an essential gene can be used, for example, for vaccination against CMV.

Further provided are attenuated virus vaccines that are unable to replicate in cells and tissues associated with CMV transmission and disease. Live RhCMV/SIV vectors with a near wildtype genetic background provide an effective vaccine that induces SIV protective immunity in rhesus macaques. For a human CMV (HCMV)/HIV vaccine to be safe for all potential subjects in a general population, including individuals with unsuspected immune compromise, the CMV vaccine vector needs to be attenuated without losing the ability to induce protective immunity. CMV can replicate in a wide variety of cells and tissues in the host, including: neurons in the central nervous system (CNS), epithelial cells, hepatocytes, lung and kidney. Myeloid and endothelial cells are considered persistent sites for CMV in the host. During overt CMV disease in immunocompromised individuals, direct infection resulting in destruction of epithelial and endothelial cells in the lung, liver and retina is responsible for disease in these target organs. During congenital infection, direct CMV infection of neuronal cells is believed to account for the associated hearing deficits and mental retardation. Embodiments of the invention relate to modulating the ability of CMV to replicate in these critical cell types in order to increase vector safety without compromising vaccine efficacy, said attenuated viruses and their use as vaccines.

Embodiments of the invention relate to HCMV as a vector for inducing protective immunity to HIV, which is based on the highly innovative hypothesis that a high frequency, effector memory-biased T cell response has distinct advantages over conventional vaccine generated memory in protecting against lentiviral infections, combined with the recognition that HCMV provides just such a response. This characteristic of HCMV is unique to this virus, even when compared to other persistent viruses such as herpes simplex virus (HSV) and Epstein-Barr virus (Asanuma, H., Sharp, M., Maecker, H. T., Maino, V. C., and Arvin, A. M. 2000. Frequencies of memory T cells specific for varicella-zoster virus, herpes simplex virus, and cytomegalovirus by intracellular detection of cytokine expression. J Infect Dis 181:859-866; Harari, A., Vallelian, F., Meylan, P. R., and Pantaleo, G. 2005. Functional heterogeneity of memory CD4 T cell responses in different conditions of antigen exposure and persistence. J Immunol 174:1037-1045; Harari, A., Enders, F. B., Cellerai, C., Bart, P. A., and Pantaleo, G. 2009. Distinct profiles of cytotoxic granules in memory CD8 T cells correlate with function, differentiation stage, and antigen exposure. J Virol 83:2862-2871; Sylwester, A. W., Mitchell, B. L., Edgar, J. B., Taormina, C., Pelte, C., Ruchti, F., Sleath, P. R., Grabstein, K. H., Hosken, N. A., Kern, F., et al. 2005. Broadly targeted human cytomegalovirus-specific CD4+ and CD8+ T cells dominate the memory compartments of exposed subjects. J Exp Med 202: 673-685.).

Even though CMV is benign in immunocompetent individuals, in order to extend these findings into an HCMV/HIV vaccine for human testing, we certain aspects of the CMV vector need to attenuate. Classically, attenuated viral vaccines have been generated through serial passaging of viruses through cells in culture. This approach is tedious and evidence with oral polio vaccine (OPV) emphasizes the safety concerns regarding reversion of virus vaccines attenuated by such 'blind' passage into a pathogenic phenotype (Rahimi, P., Tabatabaie, H., Gouya, M. M., Zahraie, M., Mahmudi, M., Ziaie, A., Rad, K. S., Shahmahmudi, S., Musavi, T., Azad, T. M., et al. 2007. Characterization of mutations in the VP(1) region of Sabin strain type 1 polioviruses isolated from vaccine-associated paralytic poliomyelitis cases in Iran. J Clin Virol 39:304-307; Kew, O., Morris-Glasgow, V., Landaverde, M., Burns, C., Shaw, J., Garib, Z., Andre, J., Blackman, E., Freeman, C. J., Jorba, J., et al. 2002. Outbreak of poliomyelitis in Hispaniola associated with circulating type 1 vaccine-derived poliovirus. Science 296:356-359.).

Early live attenuated vaccines to HCMV were generated over 30 years ago through serial passage of virus in tissue culture. These HCMV vaccines were tested in human volunteers and transplant patients (Quinnan, G. V., Jr., Delery, M., Rook, A. H., Frederick, W. R., Epstein, J. S., Manischewitz, J. F., Jackson, L., Ramsey, K. M., Mittal, K., Plotkin, S. A., et al. 1984. Comparative virulence and immunogenicity of the Towne strain and a nonattenuated strain of cytomegalovirus. Ann Intern Med 101:478-483; Plotkin, S. A., Smiley, M. L., Friedman, H. M., Starr, S. E., Fleisher, G. R., Wlodaver, C., Dafoe, D. C., Friedman, A. D., Grossman, R. A., and Barker, C. F. 1984. Towne-vaccine-induced prevention of cytomegalovirus disease after renal transplants. Lancet 1:528-530; Plotkin, S. A., Starr, S. E., Friedman, H. M., Gonczol, E., and Weibel, R. E. 1989. Protective effects of Towne cytomegalovirus vaccine against low-passage cytomegalovirus administered as a challenge. J Infect Dis 159:860-865).

While the HCMV vaccine may be considered safe, concerns still remain regarding both pathogenicity as well as the ability of the virus to spread to unvaccinated sero-negative individuals. The ability to rationally design an HCMV vaccine that is less pathogenic and not shed into the environment is now available with the advent of technological breakthroughs to clone and genetically manipulate CMV. With a long-term goal of generating a CMV vaccine vector encoding HIV antigens that is safe and unable to spread to other individuals. Embodiments of this invention relate to the rational design and use of the latest bacterial genetic techniques to generate a CMV-based vector that has a restricted tropism for cells involved in shedding as well as an altered ability to replicate in tissues associated with both adult and congenital CMV disease.

One embodiment of the invention relates to alteration of the cell-tropism of the CMV vector so as to prevent infection of specific cell types involved in potential tissue damage and/or shedding into urine or secretions. CMV is capable of infecting a wide variety of cells in the host, including: epithelial cells in gut, kidney, lung and retina, neuronal cells in the CNS, hepatocytes, as well as endothelial cells and myeloid lineage cells that are considered persistent sites of the virus (Dankner, W. M., McCutchan, J. A., Richman, D. D., Hirata, K., and Spector, S. A. 1990. Localization of human cytomegalovirus in peripheral blood leukocytes by in situ hybridization. J Infect Dis 161:31-36; Einhorn, L., and Ost, A. 1984. Cytomegalovirus infection of human blood cells. J Infect Dis 149:207-214; Gnann, J. W., Jr., Ahlmen, J., Svalander, C., Olding, L., Oldstone, M. B., and Nelson, J. A. 1988. Inflammatory cells in transplanted kidneys are infected by human cytomegalovirus. Am J Pathol 132:239-248; Howell, C. L., Miller, M. J., and Martin, W. J. 1979. Comparison of rates of virus isolation from leukocyte populations separated from blood by conventional and Ficoll-Paque/Macrodex methods. J Clin Microbiol 10:533-537; Myerson, D., Hackman, R. C., Nelson, J. A., Ward, D. C., and McDougall, J. K. 1984. Widespread presence of histologically occult cytomegalovirus. Hum Pathol 15:430-439; Schrier, R. D., Nelson, J. A., and Oldstone, M. B. 1985. Detection of human cytomegalovirus in peripheral blood lymphocytes in a natural infection. Science 230:1048-1051; Sinzger, C., Grefte, A., Plachter, B., Gouw, A. S., The, T. H., and Jahn, G. 1995. Fibroblasts, epithelial cells, endothelial cells and smooth muscle cells are major targets of human cytomegalovirus infection in lung and gastrointestinal tissues. J Gen Virol 76:741-750.).

HCMV encodes >200 genes and several of the genes that are dispensable for basic virus replication have been identified as tropism determinants that enable the virus to enter and replicate in macrophages, endothelial cells, and epithelial cells. One locus of HCMV genes, UL128-131A, has been shown to be essential for entry into endothelial and epithelial cells (Gerna, G., Percivalle, E., Lilleri, D., Lozza, L., Fornara, C., Hahn, G., Baldanti, F., and Revello, M. G. 2005. Dendritic-cell infection by human cytomegalovirus is restricted to strains carrying functional UL131-128 genes and mediates efficient viral antigen presentation to CD8+ T cells. J Gen Virol 86:275-284; Hahn, G., Revello, M. G., Patrone, M., Percivalle, E., Campanini, G., Sarasini, A., Wagner, M., Gallina, A., Milanesi, G., Koszinowski, U., et al. 2004. Human cytomegalovirus UL131-128 genes are indispensable for virus growth in endothelial cells and virus transfer to leukocytes. J Virol 78:10023-10033; Wang, D., and Shenk, T. 2005. Human cytomegalovirus UL131 open reading frame is required for epithelial cell tropism. J Virol 79:10330-10338; Wang, D., and Shenk, T. 2005. Human cytomegalovirus virion protein complex required for epithelial and endothelial cell tropism. Proc Natl Acad Sci USA 102:18153-18158; Ryckman, B. J., Rainish, B. L., Chase, M. C., Borton, J. A., Nelson, J. A., Jarvis, M. A., and Johnson, D. C. 2008. Characterization of the human cytomegalovirus gH/gL/UL128-131 complex that mediates entry into epithelial and endothelial cells. J Virol 82:60-70; Ryckman, B. J., Jarvis, M. A., Drummond, D. D., Nelson, J. A., and Johnson, D. C. 2006. Human cytomegalovirus entry into epithelial and endothelial cells depends on genes UL128 to UL150 and occurs by endocytosis and low-pH fusion. J Virol 80:710-722.).

The RhCMV homologues for HCMV UL128 and 130 are inactivated in the RhCMV strain 68-1 used as the backbone vector for our RhCMV/SIV studies (Lilja, A. E., and Shenk, T. 2008. Efficient replication of rhesus cytomegalovirus variants in multiple rhesus and human cell types. *Proc Natl Acad Sci USA* 105:19950-19955). Interestingly, RhCMV 68-1 still grows in epithelial and endothelial cells (albeit at a reduced rate compared to low passage RhCMV virus with intact UL128/130) (Lilja, A. E., Chang, W. L., Barry, P. A., Becerra, S. P., and Shenk, T. E. 2008. Functional genetic analysis of rhesus cytomegalovirus: Rh01 is an epithelial cell tropism factor. J Virol 82:2170-2181; Rue, C. A., Jarvis, M. A., Knoche, A. J., Meyers, H. L., DeFilippis, V. R., Hansen, S. G., Wagner, M., Fruh, K., Anders, D. G., Wong, S. W., et al. 2004. A cyclooxygenase-2 homologue encoded by rhesus cytomegalovirus is a determinant for endothelial cell tropism. Journal of Virology 78:12529-12536.), but does show reduced shedding compared to low passage RhCMV suggesting that reducing epithelial/endothelial cell tropism may attenuate the virus. Mutational analysis of RhCMV 68-1 has identified 4 other RhCMV genes [Rh01 (HCMV TLR1), Rh159 (HCMV UL148), Rh160 (UL132) and Rh203 (HCMVUS22)] that are also required for epithelial cell tropism. Embodiments of the invention relate to the mutation of the remainder of these epithelial cell tropism genes to highly reduce, if not abrogate, the ability of CMV to infect epithelial cells, thereby preventing its ability to be shed into urine or glandular secretions (i.e., saliva and breast milk), yet likely not compromise the ability of a CMV vector to induce a protective immune response to HIV/SIV.

Moreover, since CMV infection of epithelial cells in the lung and retina results in pneumonia and retinitis, respectively, elimination of all the CMV epithelial cell tropism genes may significantly reduce the resultant vector's pathogenic potential. Aspects of the invention relate to this highly targeted and innovative approach that will significantly enhance both the safety of the RhCMV/HCMV vector for use as an SIV/HIV vaccine, as well as prevent shedding and the potential spread of the vaccine vector into the unvaccinated population.

Further embodiments relate to exploiting the tissue-specific expression of cellular microRNAs (miRNAs) to attenuate the virus in tissues associated with disease in adult and congenital infection. miRNAs are small noncoding 21-22 bp RNAs that are highly conserved and expressed in all animal cells from *drosophila* to humans and therefore RM (Bartel, D. P. 2004. MicroRNAs: genomics, biogenesis, mechanism, and function. Cell 116:281-297). miRNAs are an ancient system for posttranscriptional regulation that are involved in a wide range of biological processes and regulate gene expression by binding target sequences in the 3' UTR of mRNAs causing either inhibition of translation of destabilization of the mRNA (Bartel, D. P. 2009. MicroRNAs: target recognition and regulatory functions. *Cell* 136:215-233). These RNA species are also encoded in DNA viruses such as CMV and expression and function of these miRNAs is characterized as described in Dunn, W., Trang, P., Zhong, Q., Yang, E., van Belle, C., and Liu, F. 2005. Human cytomegalovirus expresses novel microRNAs during productive viral infection. Cell Microbiol 7:1684-1695; Grey, F., Antoniewicz, A., Allen, E., Saugstad, J., McShea, A., Carrington, J. C., and Nelson, J. 2005. Identification and characterization of human cytomegalovirus-encoded microRNAs. J Virol 79:12095-12099; Grey, F., Meyers, H., White, E. A., Spector, D. H., and Nelson, J. 2007. A human cytomegalovirus-encoded microRNA regulates expression of multiple viral genes involved in replication. PLoS Pathog 3:e163 and Pfeffer, S., Sewer, A., Lagos-Quintana, M., Sheridan, R., Sander, C., Grasser, F. A., van Dyk, L. F., Ho, C. K., Shuman, S., Chien, M., et al. 2005. Identification of microRNAs of the herpesvirus family. Nat Methods 2:269-276.

Mammalian miRNAs can either be expressed ubiquitously in all tissues of the host, expressed only during certain times during embryogenesis in which these miRNA species play a major role in developmental processes, or can be expressed only in a tissue-specific manner (such as miR-142-3p in myeloid lineage cells, miR-124 in CNS tissue, and miR-122 in liver) (Brown, B. D., Gentner, B., Cantore, A., Colleoni, S., Amendola, M., Zingale, A., Baccarini, A., Lazzari, G., Galli, C., and Naldini, L. 2007. Endogenous microRNA can be broadly exploited to regulate transgene expression according to tissue, lineage and differentiation state. Nat Biotechnol 25:1457-1467; Barnes, D., Kunitomi, M., Vignuzzi, M., Saksela, K., and Andino, R. 2008. Harnessing endogenous miRNAs to control virus tissue tropism as a strategy for developing attenuated virus vaccines. Cell Host Microbe 4:239-248; Lee, C. Y., Rennie, P. S., and Jia, W. W. 2009. MicroRNA regulation of oncolytic herpes simplex virus-1 for selective killing of prostate cancer cells. Clin Cancer Res 15:5126-5135; Perez, J. T., Pham, A. M., Lorini, M. H., Chua, M. A., Steel, J., and tenOever, B. R. 2009. MicroRNA-mediated species-specific attenuation of influenza A virus. Nat Biotechnol 27:572-576.).

Tissue specific expression of miRNAs is exploited to generate an attenuated polio vaccine through the introduction of multiple miRNA target sequences of miR-124 that is specifically expressed in the CNS into the 3'UTR of the poliovirus genome (Barnes, D., Kunitomi, M., Vignuzzi, M., Saksela, K., and Andino, R. 2008. Harnessing endogenous miRNAs to control virus tissue tropism as a strategy for developing attenuated virus vaccines. Cell Host Microbe 4:239-248). Addition of the miR-124 target sequences to the poliovirus genome was observed to significantly attenuate virus infection in mice. Similarly, multiple target sequences of miR-93 that is ubiquitously expressed in all mammalian but not avian tissues were added to the nucleoprotein gene of influenza resulting in a species-restricted influenza mutant that was able to grow in chicken eggs but not in mice (Perez, J. T., Pham, A. M., Lorini, M. H., Chua, M. A., Steel, J., and tenOever, B. R. 2009. MicroRNA-mediated species-specific attenuation of influenza A virus. Nat Biotechnol 27:572-576).

Embodiments of this invention relate to this attenuation approach being effective for larger viruses, such as murine CMV (MCMV). Unlike the small RNA viruses, CMV encodes over 200 genes of which approximately 50% are essential and necessary for replication or encode structural proteins of the virus. One of these essential MCMV genes is the immediate early (IE) 3 gene (the mouse correlate of IE2 in HCMV or RhCMV) that encodes a transcriptional regulatory protein necessary for subsequent activation of early and late genes in the virus. Deletion of this gene completely blocks viral replication in cells and mouse tissues (Angulo, A., Ghazal, P., and Messerle, M. 2000. The major immediate-early gene ie3 of mouse cytomegalovirus is essential for viral growth. J Virol 74:11129-11136;). It is described herein that introduction of target sequences of tissue-specific miRNAs into the 3'UTR of this gene would attenuate viral replication in these cells.

A further embodiment relates to target sequences of miR-142-3p being expressed only in myeloid lineage cells (Brown, B. D., Gentner, B., Cantore, A., Colleoni, S., Amendola, M., Zingale, A., Baccarini, A., Lazzari, G., Galli, C., and Naldini, L. 2007. Endogenous microRNA can be broadly exploited to regulate transgene expression according to tissue, lineage and differentiation state. Nat Biotechnol 25:1457-1467). Myeloid lineage cells have been shown to represent a reservoir of latent virus, and are thought to harbor and disseminate virus throughout the host (Jarvis, M. A., and Nelson, J. A. 2002. Mechanisms of human cytomegalovirus persistence and latency. Front Biosci 7:d1575-1582). Further studies with MCMV (Snyder, C. M., Allan, J. E., Bonnett, E. L., Doom, C. M., and Hill, A. B. Cross-presentation of a spread-defective MCMV is sufficient to prime the majority of virus-specific CD8+ T cells. PLoS One 5:e9681) indicate that cross-priming is the primary mechanism by which CMV-encoded proteins prime the immune response, replication in myeloid dendritic cells may have a surprisingly minimal impact on CMV immunogenicity.

Figure 21:
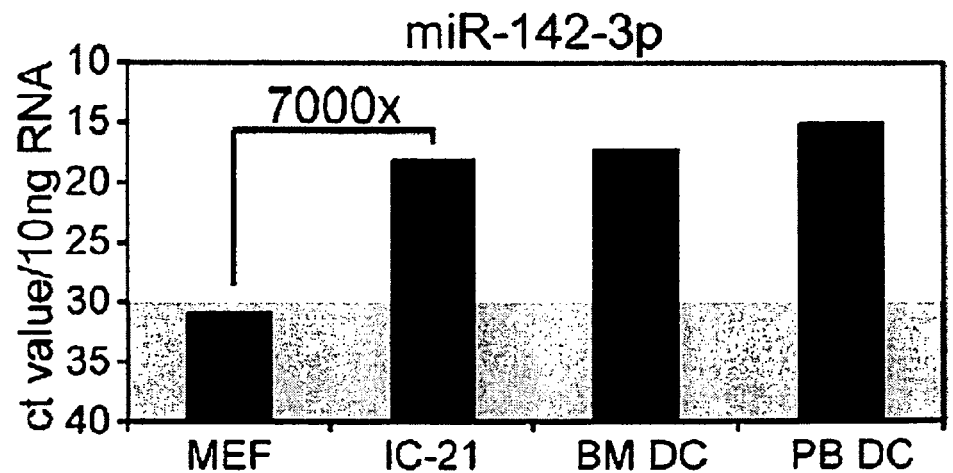
FIG. 21 is a graph showing miR-142-3p levels by quantitative RT-PCR analysis from Total RNA from mouse embryo fibroblast cells (MEF), IC-21 macrophage cells (IC-21), peripheral blood dendritic cells (PB DC) and bone marrow dendritic cells (BM DC). Levels of miR-142-3p were at least 7000 fold higher in macrophage/dendritic cells than in MEFs. miR-142-3p levels for MEFs lie within standard background levels for ABI miRNA RT-PCR assays (gray section)
Figure 22:
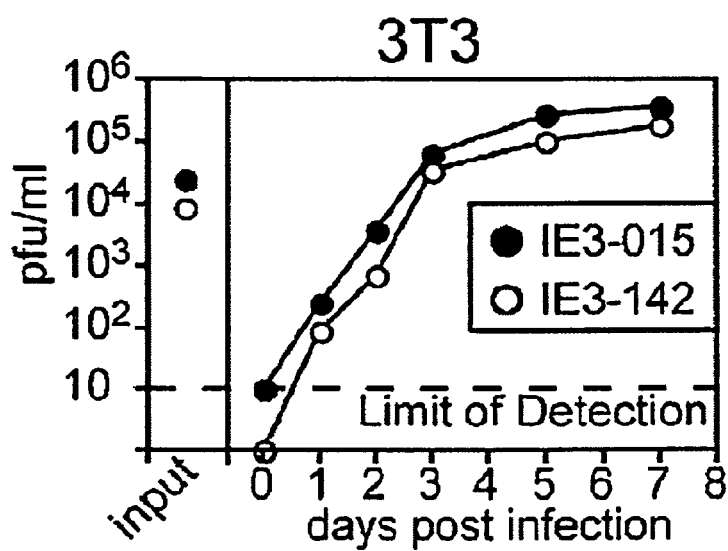
FIG. 22 is a graph showing the level of murine CMV (MCMV) replication of IE3-015 control virus and IE3-142 were compared following MOI=0.1 infection of 3T3 fibroblast cells. Standard plaque assays carried out on 3T3 fibroblast cells.
Figure 23:
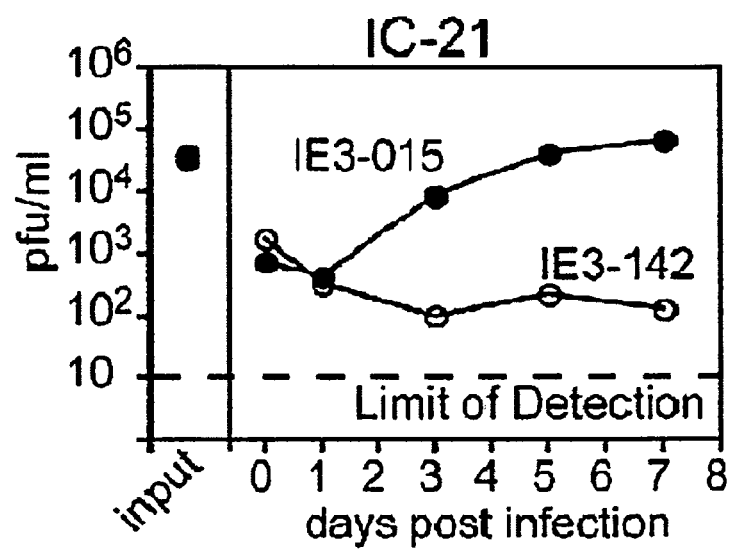
FIG. 23 is a graph showing the level of MCMV replication of IE3-015 control virus and IE3-142 were compared following MOI=0.1 infection of IC-21 macrophage cells.
Figure 24:
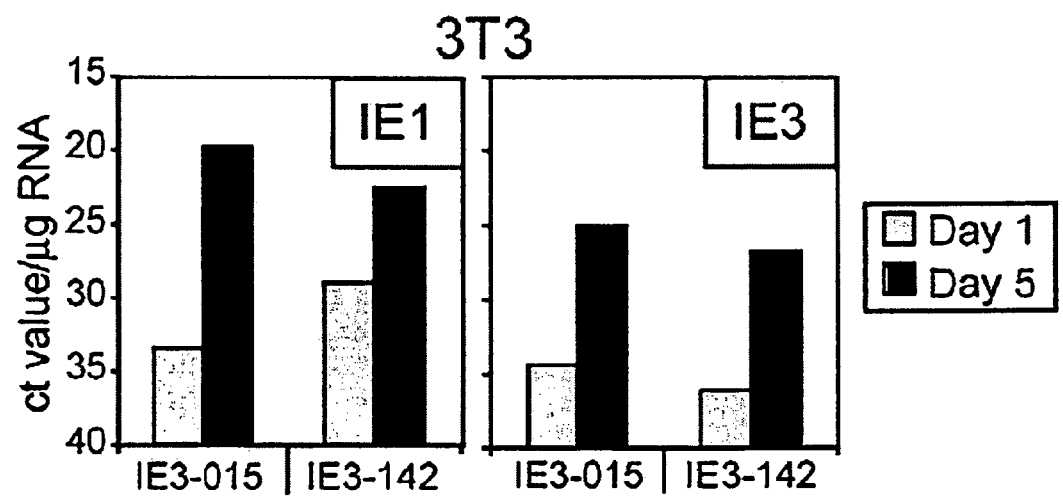
FIG. 24 is a graph showing IE1 and IE3 mRNA levels following infection of 3T3 fibroblast with MCMV
Figure 25:
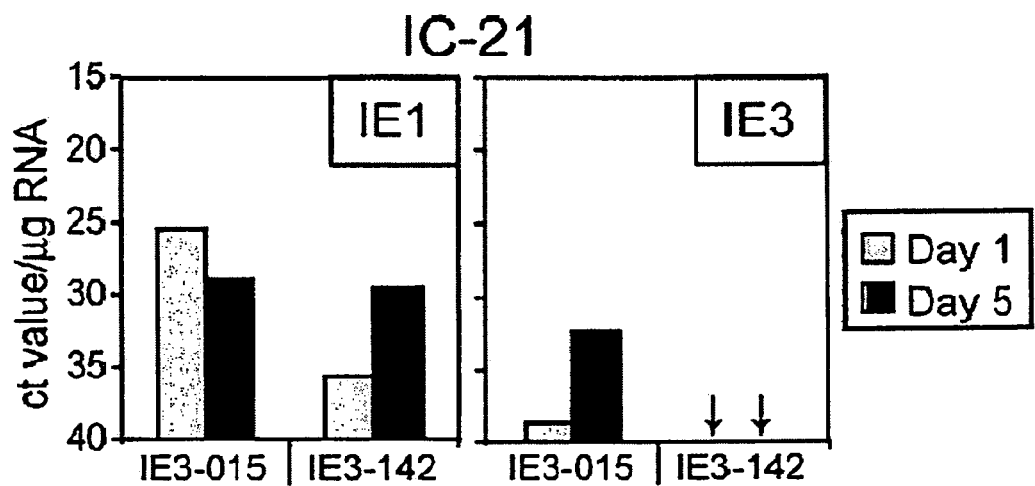
FIG. 25 is a graph showing IE1 and IE3 mRNA levels following infection of IC-21 macrophage cells with MCMV
Figure 26:
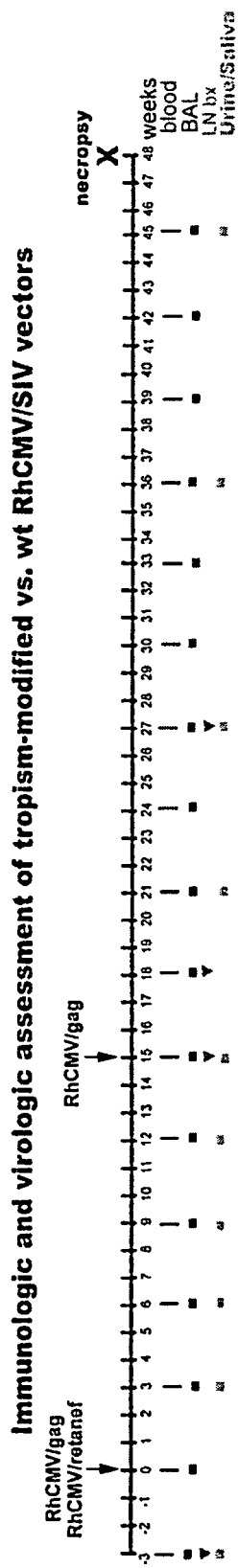
FIG. 26 is a schematic showing the protocol for assessment of RhCMV shedding immunogenicity and in adult/juvenile RM.

Bacterial artificial chromosome (BAC)-based technology is used to generate a recombinant MCMV virus that contained four repeated target sequences (four 21mers) with exact complementarity to the cellular miRNA, miR-142-3p, within the 3'UTR of the essential viral gene IE3 (IE3-142). To confirm the extent to which miR-142-3p expression could repress IE3-142 replication, virus growth assays are performed in the macrophage cell line, IC-21. RT-PCR analysis confirmed that IC-21 cells express high levels of miR-142-3p (FIG. 21) making the cell line suitable to test the effectiveness of the strategy. Preliminary experiments confirmed the utility of the approach for cell-type specific attenuation of CMV. Although IE3-142 replicated to wild type levels in fibroblasts, growth was completely blocked in IC-21 macrophage cells (FIGS. 22 and 23). A control virus, IE3-015, which contains only vector sequence within the IE3 insertion site, replicates to wild-type levels in IC-21 cells. RT-PCR analysis indicates that IE3 expression was completely abrogated following infection of IC-21 cells, but not following infection of fibroblast cells (lacking miR-142-3p expression) indicating that disruption of IE3 expression is not due to insertion of the target sequence.

Embodiments of the invention relate to strategy to attenuate CMV based on the showing that viruses can be attenuated for tissue-specific growth by using miRNA target sequences and the attenuation of MCMV in myeloid cells through the targeting of cell specific miRNAs to essential viral genes. Since the CNS is a major target for CMV pathogenesis in both congenital and adult disease, RhCMV/SIV vaccines and HCMV/HIV are generated that contain target sequences of highly conserved miRNAs specifically expressed by neurons fused to essential CMV genes to prevent replication in the CNS. Target sequences of the myeloid miRNA miR-124 to prevent replication and dissemination of the CMV vector in this cell type are also used. Together, these attenuated viruses will provide a further level of safety that will enable the use of this vaccine in all human target populations.

Besides the translational application of using miRNA tissue-specific expression to generate safe CMV vectors, the tools are available for the first time to ask important scientific questions, most notably including the determination of which cell types are required for establishment and persistence of CMV infection, induction of T cell immunity, and disease as described herein. Embodiments of the invention relate to the infection of particular cell types that may be crucial for generation of the high frequency $T_{EM}$-biased T cell immunity characteristic of CMV elicited responses, and determination of how restriction of viral tropism changes the character of CMV disease.

Some non-limiting abbreviations include:
BAC Bacterial artificial chromosome
BAL Bronchioalveolar lavage
CM Central memory
CMV Cytomegalovirus
CytoG Cytotoxic gene
Dox Doxycycline
ELISA Enzyme linked immunosorbent assay
EM Effector memory
HCMV Human cytomegalovirus
HCV Hepatitis C virus
HIV Human immunodeficiency virus
ICS Intracellular cytokine staining
i.p. Intraperitoneal
MCMV Murine cytomegalovirus
MEF Murine embryonic fibroblast
MOI Multiplicity of infection
NHP Non-human primate
NP Nucleoprotein
NS Non-structural
ORF Open reading frame
PB Peripheral blood
PBMC Peripheral blood mononuclear cell
PCR Polymerase chain reaction
PFU Plaque forming unit
RhCMV Rhesus cytomegalovirus
RM Rhesus macaque
s.c. Subcutaneous
SIV Simian immunodeficiency virus
Tet Tetracycline
WT Wild-type Unless otherwise noted, technical terms are used according to conventional usage. Definitions of common terms in molecular biology may be found in Benjamin Lewin, Genes V, published by Oxford University Press, 1994 (ISBN 0-19-854287-9); Kendrew et al. (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8).

In order to facilitate review of the various embodiments of the invention, the following terminology may be used:

Adjuvant: A substance or vehicle that non-specifically enhances the immune response to an antigen or other composition. Adjuvants can include a suspension of minerals (alum, aluminum hydroxide, or phosphate) on which antigen is adsorbed; or water-in-oil emulsion in which antigen solution is emulsified in mineral oil (for example, Freund's incomplete adjuvant), sometimes with the inclusion of killed mycobacteria (Freund's complete adjuvant) to further enhance antigenicity. Immunostimulatory oligonucleotides (such as those including a CpG motif) can also be used as adjuvants (for example, see U.S. Pat. Nos. 6,194,388; 6,207, 646; 6,214,806; 6,218,371; 6,239,116; 6,339,068; 6,406,705; and 6,429,199). Adjuvants also include biological molecules, such as costimulatory molecules. Exemplary biological adjuvants include IL-2, RANTES, GM-CSF, TNF-α, IFN-γ, G-CSF, LFA-3, CD72, B7-1, B7-2, OX-40L and 41 BBL.

Administration: The introduction of a composition into a subject by a chosen route. For example, if the chosen route is intravenous, the composition is administered by introducing the composition into a vein of the subject. Administration can be local or systemic. Examples of local administration include, but are not limited to, topical administration, subcutaneous administration, intramuscular administration, intrathecal administration, intrapericardial administration, intra-ocular administration, topical ophthalmic administration, or administration to the nasal mucosa or lungs by inhalational administration. Systemic administration includes any route of administration designed to distribute an active compound or composition widely throughout the body via the circulatory system. Thus, systemic administration includes, but is not limited to intraperitoneal, intra-arterial and intravenous administration. Systemic administration also includes, but is not limited to, topical administration, subcutaneous administration, intramuscular administration, or administration by inhalation, when such administration is directed at absorption and distribution throughout the body by the circulatory system.

Animal: A living multi-cellular vertebrate or invertebrate organism, a category that includes, for example, mammals and birds. The term mammal includes both human and non-human mammals. The term "primate" includes both human and non-human primates. "Non-human primates" are simian primates such as monkeys, chimpanzees, orangutans, baboons, and macaques. Similarly, the term "subject" includes both human and veterinary subjects, such as non-human primates.

Antibody: Antibodies includes immunoglobulin molecules and immunologically active portions of immunoglobulin molecules, for instance, molecules that contain an antigen binding site that specifically binds (immunoreacts with) an antigen. A naturally occurring antibody (for example, IgG, IgM, IgD) includes four polypeptide chains, two heavy (H) chains and two light (L) chains inter-connected by disulfide bonds. However, it has been shown that the antigen-binding function of an antibody can be performed by fragments of a naturally occurring antibody. Thus, these antigen-binding fragments are also intended to be designated by the term "antibody." Specific, non-limiting examples of binding fragments encompassed within the term antibody include (i) an Fab fragment consisting of the VL, VH, CL, and CH1 domains; (ii) an Fd fragment consisting of the VH and CH1 domains; (iii) an Fv fragment consisting of the VL and VH domains of a single arm of an antibody, (iv) a dAb fragment (Ward et al., Nature 341:544-546, 1989) which consists of a VH domain; (v) an isolated complementarity determining region (CDR); and (vi) an F(ab')2 fragment, a bivalent fragment comprising two Fab fragments linked by a disulfide bridge at the hinge region.

Antigen: A compound, composition, or substance that can stimulate the production of antibodies or a T cell response in an animal, including compositions that are injected or absorbed into an animal. An antigen reacts with the products of specific humoral or cellular immunity, including those induced by heterologous immunogens. The term "antigen" includes all related antigenic epitopes. "Epitope" or "antigenic determinant" refers to a site on an antigen to which B and/or T cells respond. In one embodiment, T cells respond to the epitope, when the epitope is presented in conjunction with an MHC molecule. Epitopes can be formed both from contiguous amino acids or noncontiguous amino acids juxtaposed by tertiary folding of a protein. Epitopes formed from contiguous amino acids are typically retained on exposure to denaturing solvents whereas epitopes formed by tertiary folding are typically lost on treatment with denaturing solvents. An epitope typically includes at least 3, and more usually, at least 5, about 9, or about 8-10 amino acids in a unique spatial conformation. Methods of determining spatial conformation of epitopes include, for example, x-ray crystallography and 2-dimensional nuclear magnetic resonance.

In some embodiments, an antigen is a polypeptide specifically expressed in tumor cells (i.e., a tumor antigen). In some cases, tumor antigens are also expressed in normal cells, but the expression level in normal cells is significantly lower than the expression level in tumor cells. In some embodiments, the antigen is a pathogen-specific antigen. In the context of the present disclosure, a pathogen-specific antigen is an antigen that elicits an immune response against the pathogen and/or is unique to a pathogen (such as a virus, bacterium, fungus or protozoan).

Antigenic fragment: Refers to any portion of a protein of polypeptide that is capable of eliciting an immune response.

Antigen-specific T cell: A CD8+ or CD4+ lymphocyte that recognizes a particular antigen. Generally, antigen-specific T cells specifically bind to a particular antigen presented by MHC molecules, but not other antigens presented by the same MHC.

Attenuated: In the context of a live virus, the virus is attenuated if its ability to infect a cell or subject and/or its ability to produce disease is reduced (for example, eliminated) compared to a wild-type virus. Typically, an attenuated virus retains at least some capacity to elicit an immune response following administration to an immunocompetent subject. In some cases, an attenuated virus is capable of eliciting a protective immune response without causing any signs or symptoms of infection. In some embodiments, the ability of an attenuated virus to cause disease in a subject is reduced at least about 10%, at least about 25%, at least about 50%, at least about 75% or at least about 90% relative to wild-type virus.

Cancer, tumor, neoplasia and malignancy: A neoplasm is an abnormal growth of tissue or cells that results from excessive cell division. Neoplastic growth can produce a tumor. The amount of a tumor in an individual is the "tumor burden" which can be measured as the number, volume, or weight of the tumor. A tumor that does not metastasize is referred to as "benign." A tumor that invades the surrounding tissue and/or can metastasize is referred to as "malignant." Malignant tumors are also referred to as "cancer."

Hematologic cancers are cancers of the blood or bone marrow. Examples of hematological (or hematogenous) cancers include leukemias, including acute leukemias (such as acute lymphocytic leukemia, acute myelocytic leukemia, acute myelogenous leukemia and myeloblastic, promyelocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (indolent and high grade forms), multiple myeloma, Waldenstrom's macroglobulinemia, heavy chain disease, myelodysplastic syndrome, hairy cell leukemia and myelodysplasia. In some cases, lymphomas are considered solid tumors.

Solid tumors are abnormal masses of tissue that usually do not contain cysts or liquid areas. Solid tumors can be benign or malignant. Different types of solid tumors are named for the type of cells that form them (such as sarcomas, carcinomas, and lymphomas). Examples of solid tumors, such as sarcomas and carcinomas, include fibrosarcoma, myxosarcoma, liposarcoma, chondrosarcoma, osteosarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, human papilloma virus (HPV)-infected neoplasias, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme) astrocytoma, CNS lymphoma, germinoma, medulloblastoma, Schwannoma craniopharyogioma, ependymoma, pinealoma, hemangioblastoma, acoustic neuroma, oligodendroglioma, menangioma, neuroblastoma, retinoblastoma and brain metastasis).

CMV (cytomegalovirus): A member of the beta subclass of the family of herpesviruses. CMV is a large (~230 kB genome), double stranded DNA virus, with host-range specific variants such as MCMV (murine CMV), RhCMV (rhesus CMV) and HCMV (human CMV). In the context of the present invention, "RhCMV" refers to any strain, isolate or variant of rhesus CMV. In particular examples, RhCMV comprises the nucleotide sequence of SEQ ID NO: 1, or a sequence that is at least 80%, at least 85%, at least 90%, at least 95%, or at least 99% identical to SEQ ID NO: 1. As used herein, "HCMV" includes any strain, isolate or variant of human CMV. In particular examples, HCMV comprises the nucleotide sequences of any one of SEQ ID NOs: 2-9, or a sequence that is at least 80%, at least 85%, at least 90%, at least 95%, or at least 95% identical to any one of SEQ ID NOs: 2-9.

Chemotherapy: In cancer treatment, chemotherapy refers to the administration of one or more agents to kill or slow the reproduction of rapidly multiplying cells, such as tumor or cancer cells. In a particular example, chemotherapy refers to the administration of one or more anti-neoplastic agents to significantly reduce the number of tumor cells in the subject, such as by at least 50%.

Chemotherapeutic agent: An agent with therapeutic usefulness in the treatment of diseases characterized by abnormal cell growth or hyperplasia. Such diseases include cancer, autoimmune disease as well as diseases characterized by hyperplastic growth such as psoriasis. One of skill in the art can readily identify a chemotherapeutic agent (for instance, see Slapak and Kufe, Principles of Cancer Therapy, Chapter 86 in Harrison's Principles of Internal Medicine, 14th edition; Perry et al., Chemotherapy, Ch. 17 in Abeloff, Clinical Oncology 2nd ed., ©2000 Churchill Livingstone, Inc; Baltzer L, Berkery R (eds): Oncology Pocket Guide to Chemotherapy, 2nd ed. St. Louis, Mosby-Year Book, 1995; Fischer D S, Knobf M F, Durivage H J (eds): The Cancer Chemotherapy Handbook, 4th ed. St. Louis, Mosby-Year Book, 1993).

Decrease or deplete: To reduce the quality, amount, or strength of something. In one example, a therapy (such as the methods provided herein) decreases a tumor (such as the size of a tumor, the number of tumors, the metastasis of a tumor, the reoccurrence of a tumor or combinations thereof), or one or more symptoms associated with a tumor, for example as compared to the response in the absence of the therapy. In a particular example, a therapy decreases the size of a tumor, the number of tumors, the metastasis of a tumor, the reoccurrence of a tumor or combinations thereof, subsequent to the therapy, such as a decrease of at least 10%, at least 20%, at least 50%, or even at least 90%. Similarly, in other embodiments, a therapy decreases the infectious load or titer of a pathogen, or one or more symptoms associated with infection.

Deletion: The removal of a sequence of DNA, the regions on either side of the removed sequence being joined together.

Effective amount: A quantity sufficient to achieve a desired effect in a subject being treated. An effective amount of a composition, such as a vaccine, can be administered in a single dose, or in several doses, during a course of treatment. However, the effective amount of the compound will be dependent on the compound applied, the subject being treated, the severity and type of the affliction, and the manner of administration of the compound.

Epitope: An epitope of interest is an antigen or immunogen or immunologically active fragment thereof from a pathogen or toxin of veterinary or human interest. An epitope of interest can be an antigen of pathogen or toxin, or from an antigen of a pathogen or toxin, or another antigen or toxin which elicits a response with respect to the pathogen, of from another antigen or toxin which elicits a response with respect to the pathogen.

Expression: Translation of a nucleic acid into a protein, for example the translation of a mRNA encoding a tumor-specific or pathogen-specific antigen into a protein.

Expression Control Sequences: Nucleic acid sequences that regulate the expression of a heterologous nucleic acid sequence to which it is operatively linked, for example the expression of a heterologous polynucleotide spliced in a CMV genome and encoding an antigenic protein operably linked to expression control sequences. Expression control sequences are operatively linked to a nucleic acid sequence when the expression control sequences control and regulate the transcription and, as appropriate, translation of the nucleic acid sequence. Thus expression control sequences can include appropriate promoters, enhancers, transcription terminators, a start codon (ATG) in front of a protein-encoding gene, splicing signal for introns, maintenance of the correct reading frame of that gene to permit proper translation of mRNA, and stop codons. The term "control sequences" is intended to include, at a minimum, components whose presence can influence expression, and can also include additional components whose presence is advantageous, for example, leader sequences and fusion partner sequences. Expression control sequences can include a promoter.

A promoter is a minimal sequence sufficient to direct transcription. Also included are those promoter elements which are sufficient to render promoter-dependent gene expression controllable for cell-type specific, tissue-specific, or inducible by external signals or agents; such elements may be located in the 5' or 3' regions of the gene. Both constitutive and inducible promoters are included (see for example, Bitter et al., Methods in Enzymology 153:516-544, 1987). For example, when cloning in bacterial systems, inducible promoters such as pL of bacteriophage lambda, plac, ptrp, ptac (ptrp-lac hybrid promoter) and the like may be used. In one embodiment, when cloning in mammalian cell systems, promoters derived from the genome of mammalian cells (such as metallothionein promoter) or from mammalian viruses (such as the retrovirus long terminal repeat; the adenovirus late promoter; the vaccinia virus 7.5K promoter) can be used. Promoters produced by recombinant DNA or synthetic techniques may also be used to provide for transcription of the nucleic acid sequences.

A polynucleotide can be inserted into an expression vector, including a viral vector, containing a promoter sequence, which facilitates the efficient transcription of the inserted genetic sequence of the host. The expression vector typically contains an origin of replication, a promoter, as well as specific nucleic acid sequences that allow phenotypic selection of the transformed cells.

Heterologous: A heterologous polypeptide (such as a heterologous antigen) or polynucleotide refers to a polypeptide or polynucleotide derived from a different source or species. In some embodiments herein, the heterologous sequence is from a different genetic source, such as a virus or other organism, than the second sequence. In particular examples, the heterologous sequence is a nucleic acid sequence encoding a tumor antigen or a pathogen-specific antigen.

Immunogenic (or antigenic) peptide: A peptide which comprises an allele-specific motif or other sequence, such as an N-terminal repeat, such that the peptide will bind an MHC molecule and induce a cytotoxic T lymphocyte ("CTL") response, or a B cell response (for example antibody production) against the antigen from which the immunogenic peptide is derived. In one embodiment, immunogenic peptides are identified using sequence motifs or other methods, such as neural net or polynomial determinations known in the art. Typically, algorithms are used to determine the "binding threshold" of peptides to select those with scores that give them a high probability of binding at a certain affinity and will be immunogenic. The algorithms are based either on the effects on MHC binding of a particular amino acid at a particular position, the effects on antibody binding of a particular amino acid at a particular position, or the effects on binding of a particular substitution in a motif-containing peptide. Within the context of an immunogenic peptide, a "conserved residue" is one which appears in a significantly higher frequency than would be expected by random distribution at a particular position in a peptide. In one embodiment, a conserved residue is one where the MHC structure may provide a contact point with the immunogenic peptide.

Immune response: A change in immunity, for example a response of a cell of the immune system, such as a B-cell, T cell, macrophage, monocyte, or polymorphonucleocyte, to an immunogenic agent in a subject. The response can be specific for a particular antigen (an "antigen-specific response"). In a particular example, an immune response is a T cell response, such as a CD4+ response or a CD8+ response. In another example, the response is a B-cell response, and results in the production of specific antibodies to the immunogenic agent. In some examples, such an immune response provides protection for the subject from the immunogenic agent or the source of the immunogenic agent. For example, the response can treat a subject having a tumor, for example by interfering with the metastasis of the tumor or reducing the number or size of a tumor. In another example, the immune response can treat a subject with an infectious disease. An immune response can be active and involve stimulation of the subject's immune system, or be a response that results from passively acquired immunity. A "repeatedly stimulated" immune response is a long-term immune response resulting from the periodic and repetitive stimulation of the immune system by the repeated production of an antigen within a host. In some examples, an increased or enhanced immune response is an increase in the ability of a subject to fight off a disease, such as a tumor or infectious disease.

Immunity: The state of being able to mount a protective response upon exposure to an immunogenic agent. Protective responses can be antibody-mediated or immune cell-mediated, and can be directed toward a particular pathogen or tumor antigen. Immunity can be acquired actively (such as by exposure to an immunogenic agent, either naturally or in a pharmaceutical composition) or passively (such as by administration of antibodies or in vitro stimulated and expanded T cells). In some embodiments disclosed herein, immunity is acquired by administration (such as by intraperitoneal or intravenous administration) of a recombinant CMV vector that is expressing a particular antigen, such as a pathogen-specific antigen or a tumor antigen.

Infectious disease: A disease caused by a pathogen, such as a fungus, parasite, protozoan, bacterium or virus.

Inhibiting or treating a disease. Inhibiting the full development or recurrence of a disease or condition. "Treatment" refers to a therapeutic intervention that ameliorates a sign or symptom of a disease or pathological condition after it has begun to develop. The term "ameliorating," with reference to a disease or pathological condition, refers to any observable beneficial effect of the treatment. The beneficial effect can be evidenced, for example, by a delayed onset or recurrence of clinical symptoms of the disease in a susceptible subject, a reduction in severity of some or all clinical symptoms of the disease, a slower progression of the disease, a reduction in the number of metastases (if the disease is cancer), an decrease in titer of a pathogen (if the disease is an infectious disease), an improvement in the overall health or well-being of the subject, or by other parameters well known in the art that are specific to the particular disease. A "prophylactic" treatment is a treatment administered to a subject who does not exhibit signs of a disease or exhibits only early signs for the purpose of decreasing the risk of developing pathology.

Isolated or non-naturally occurring: An "isolated" or "non-naturally occurring" biological component (such as a nucleic acid molecule, protein or organelle) has been substantially separated or purified away from at least one other biological components in the cell of the organism in which the component naturally occurs, e.g., other chromosomal and extra-chromosomal DNA and RNA, proteins and organelles. Nucleic acids and proteins that are "non-naturally occurring" or have been "isolated" include nucleic acids and proteins purified by standard purification methods. The term also embraces nucleic acids and proteins prepared by recombinant expression in a host cell as well as chemically synthesized nucleic acids.

Operably linked: A first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Generally, operably linked DNA sequences are contiguous and, where necessary to join two protein-coding regions, in the same reading frame.

Open reading frame (ORF): A series of nucleotide triplets (codons) coding for amino acids without any internal termination codons. These sequences are usually translatable into a peptide.

Pathogen: A biological agent that causes disease or illness to its host. Pathogens include, for example, bacteria, viruses, fungi and protozoa. Pathogens are also referred to as infectious agents.

Examples of pathogenic viruses include, but are not limited to those in the following virus families: Retroviridae (for example, human immunodeficiency virus (HIV), human T-cell leukemia viruses; Picornaviridae (for example, polio virus, hepatitis A virus, hepatitis C virus, enteroviruses, human coxsackie viruses, rhinoviruses, echoviruses, foot-and-mouth disease virus); Caliciviridae (such as strains that cause gastroenteritis, including Norwalk virus); Togaviridae (for example, alphaviruses (including chikungunya virus, equine encephalitis viruses, Simliki Forest virus, Sindbis virus, Ross River virus), rubella viruses); Flaviridae (for example, dengue viruses, yellow fever viruses, West Nile virus, St. Louis encephalitis virus, Japanese encephalitis virus, Powassan virus and other encephalitis viruses); Coronaviridae (for example, coronaviruses, severe acute respiratory syndrome (SARS) virus; Rhabdoviridae (for example, vesicular stomatitis viruses, rabies viruses); Filoviridae (for example, Ebola virus, Marburg virus); Paramyxoviridae (for example, parainfluenza viruses, mumps virus, measles virus, respiratory syncytial virus); Orthomyxoviridae (for example, influenza viruses); Bunyaviridae (for example, Hantaan viruses, Sin Nombre virus, Rift Valley fever virus, bunya viruses, phleboviruses and Nairo viruses); Arenaviridae (such as Lassa fever virus and other hemorrhagic fever viruses, Machupo virus, Junin virus); Reoviridae (e.g., reoviruses, orbiviurses, rotaviruses); Birnaviridae; Hepadnaviridae (hepatitis B virus); Parvoviridae (parvoviruses); Papovaviridae (papilloma viruses, polyoma viruses, BK-virus); Adenoviridae (adenoviruses); Herpesviridae (herpes simplex virus (HSV)-1 and HSV-2; cytomegalovirus; Epstein-Barr virus; varicella zoster virus; and other herpes viruses, including HSV-6); Poxyiridae (variola viruses, vaccinia viruses, pox viruses); and Iridoviridae (such as African swine fever virus); Astroviridae; and unclassified viruses (for example, the etiological agents of spongiform encephalopathies, the agent of delta hepatitis (thought to be a defective satellite of hepatitis B virus).

Examples of bacterial pathogens include, but are not limited to: *Helicobacter pylori, Escherichia coli, Vibrio cholerae, Borelia burgdorferi, Legionella pneumophilia, Mycobacteria* sps (such as. *M. tuberculosis, M. avium, M. intracellulare, M. kansaii, M. gordonae*), *Staphylococcus aureus, Neisseria gonorrhoeae, Neisseria meningitidis, Listeria monocytogenes, Streptococcus pyogenes* (Group A *Streptococcus*), *Streptococcus agalactiae* (Group B *Streptococcus*), *Streptococcus* (viridans group), *Streptococcus faecalis, Streptococcus bovis, Streptococcus* (anaerobic sps.), *Streptococcus pneumoniae*, pathogenic *Campylobacter* sp., *Enterococcus* sp., *Haemophilus influenzae, Bacillus anthracis, corynebacterium diphtheriae, corynebacterium* sp., *Erysipelothrix rhusiopathiae, Clostridium perfringers, Clostridium tetani, Enterobacter aerogenes, Klebsiella pneumoniae, Pasturella multocida, Bacteroides* sp., *Fusobacterium nucleatum, Streptobacillus moniliformis, Treponema pallidium, Treponema pertenue, Leptospira, Bordetella pertussis, Shigella flexnerii, Shigella dysenteriae* and *Actinomyces israelli*.

Examples of fungal pathogens include, but are not limited to: *Cryptococcus neoformans, Histoplasma capsulatum, Coccidioides immitis, Blastomyces dermatitidis, Chlamydia trachomatis, Candida albicans*.

Examples of pathogens such as parasitic/protozoan pathogens include, but are not limited to: *Plasmodium falciparum, Plasmodium vivax, Trypanosoma cruzi* and *Toxoplasma gondii*. The invention relates to a parasite that may be a protozoan organism or organisms which cause diseases that include, but not limited to, Acanthamoeba, Babesiosis, Balantidiasis, Blastocystosis, Coccidia, Dientamoebiasis, Amoebiasis, Giardia, Isosporiasis, Leishmaniasis, Primary amoebic meningoencephalitis (PAM), Malaria, Rhinosporidiosis, Toxoplasmosis—Parasitic pneumonia, Trichomoniasis, Sleeping sickness and Chagas disease. The parasite may be a helminth organism or worm or organisms which cause diseases that include, but not limited to, Ancylostomiasis/Hookworm, Anisakiasis, Roundworm—Parasitic pneumonia, Roundworm—Baylisascariasis, Tapeworm—Tapeworm infection, Clonorchiasis, Dioctophyme renalis infection, Diphyllobothriasis—tapeworm, Guinea worm—Dracunculiasis, Echinococcosis—tapeworm, Pinworm—Enterobiasis, Liver fluke—Fasciolosis, Fasciolopsiasis—intestinal fluke, Gnathostomiasis, Hymenolepiasis, Loa boa filariasis, Calabar swellings, Mansonelliasis, Filariasis, Metagonimiasis—intestinal fluke, River blindness, Chinese Liver Fluke, Paragonimiasis, Lung Fluke, Schistosomiasis—bilharzia, bilharziosis or snail fever (all types), intestinal schistosomiasis, urinary schistosomiasis, Schistosomiasis by *Schistosoma japonicum*, Asian intestinal schistosomiasis, Sparganosis, Strongyloidiasis—Parasitic pneumonia, Beef tapeworm, Pork tapeworm, Toxocariasis, Trichinosis, Swimmer's itch, Whipworm and Elephantiasis Lymphatic filariasis. The parasite may be an organism or organisms which cause diseases that include, but not limited to, parasitic worm, Halzoun Syndrome, Myiasis, Chigoe flea, Human Botfly and Candiru. The parasite may be an ectoparasite or organisms which cause diseases that include, but are not limited to, Bedbug, Head louse—Pediculosis, Body louse—Pediculosis, Crab louse—Pediculosis, Demodex—Demodicosis, Scabies, Screwworm and *Cochliomyia*.

Pharmaceutically acceptable carriers: The pharmaceutically acceptable carriers useful with this disclosure are conventional. Martin, Remington's Pharmaceutical Sciences, published by Mack Publishing Co., Easton, Pa., 19th Edition, 1995, describes compositions and formulations suitable for pharmaceutical delivery of the nucleotides and proteins herein disclosed.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically-neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

Plaque forming units (PFU): A measure of virus dose or titer, determined by its ability to form plaques on a permissive cell line.

Polypeptide: A polymer in which the monomers are amino acid residues that are joined together through amide bonds. When the amino acids are alpha-amino acids, either the L-optical isomer or the D-optical isomer can be used, the L-isomers being preferred. The term polypeptide or protein as used herein encompasses any amino acid sequence and includes modified sequences such as glycoproteins. The term polypeptide is specifically intended to cover naturally occurring proteins, as well as those that are recombinantly or synthetically produced.

The term polypeptide fragment refers to a portion of a polypeptide that exhibits at least one useful epitope. The phrase "functional fragment(s) of a polypeptide" refers to all fragments of a polypeptide that retain an activity, or a measurable portion of an activity, of the polypeptide from which the fragment is derived. Fragments, for example, can vary in size from a polypeptide fragment as small as an epitope capable of binding an antibody molecule to a large polypeptide capable of participating in the characteristic induction or programming of phenotypic changes within a cell. An epitope is a region of a polypeptide capable of binding an immunoglobulin generated in response to contact with an antigen.

Conservative amino acid substitution tables providing functionally similar amino acids are well known to one of ordinary skill in the art. The following six groups are examples of amino acids that are considered to be conservative substitutions for one another:

1) Alanine (A), Serine (S), Threonine (T);
2) Aspartic acid (D), Glutamic acid (E);
3) Asparagine (N), Glutamine (Q);
4) Arginine I, Lysine (K);
5) Isoleucine (I), Leucine (L), Methionine (M), Valine (V); and
6) Phenylalanine (F), Tyrosine (Y), Tryptophan (W).

In some circumstances, variations in the cDNA sequence that result in amino acid changes, whether conservative or not, are minimized in order to preserve the functional and immunologic identity of the encoded protein. The immunologic identity of the protein may be assessed by determining whether it is recognized by an antibody; a variant that is recognized by such an antibody is immunologically conserved. Any cDNA sequence variant will preferably introduce no more than twenty, and preferably fewer than ten amino acid substitutions into the encoded polypeptide. Variant amino acid sequences may, for example, be 80%, 90%, or even 95% or 98% identical to the native amino acid sequence. Programs and algorithms for determining percentage identity can be found at the NCBI website.

Purified: The term "purified" does not require absolute purity; rather, it is intended as a relative term. Thus, for example, a purified protein preparation is one in which the protein referred to is more pure than the protein in its natural environment within a cell or within a production reaction chamber (as appropriate).

Recombinant: A recombinant nucleic acid is one that has a sequence that is not naturally occurring or has a sequence that is made by an artificial combination of two otherwise separated segments of sequence. This artificial combination can be accomplished by chemical synthesis or, more commonly, by the artificial manipulation of isolated segments of nucleic acids, e.g., by genetic engineering techniques.

Replication-deficient: As used herein, a replication-deficient CMV is a virus that once in a host cell, cannot undergo viral replication, or is significantly limited in its ability to replicate its genome and thus produce progeny virions. In other examples, replication-deficient viruses are dissemination-deficient, i.e. they are capable of replicating their genomes, but unable to infect another cell either because virus particles are not released from the infected cell or because non-infectious viral particles are released. In other examples, replication-deficient viruses are spread-deficient, i.e. infectious virus is not secreted from the infected host are therefore the virus is incapable to spread from host to host. In some embodiments, a replication-deficient CMV is a CMV comprising a deletion in one or more genes essential for viral replication ("essential genes") or required for optimal replication ("augmenting genes"). CMV essential and augmenting genes have been described in the art and are disclosed herein. In particular examples, the CMV essential or augmenting gene is UL82, UL94, UL32, UL99, UL115 or UL44 (or the RhCMV homolog thereof).

Sample or biological sample: A biological specimen obtained from a subject, such as a cell, fluid of tissue sample. In some cases, biological samples contain genomic DNA, RNA (including mRNA and microRNA), protein, or combinations thereof. Examples of samples include, but are not limited to, saliva, blood, serum, urine, spinal fluid, tissue biopsy, surgical specimen, cells (such as PBMCs, white blood cells, lymphocytes, or other cells of the immune system) and autopsy material.

Sequence identity: The similarity between two nucleic acid sequences, or two amino acid sequences, is expressed in terms of the similarity between the sequences, otherwise referred to as sequence identity. Sequence identity is frequently measured in terms of percentage identity (or similarity or homology); the higher the percentage, the more similar the two sequences are.

Methods of alignment of sequences for comparison are well known in the art. Various programs and alignment algorithms are described in: Smith and Waterman (Adv. Appl. Math. 2: 482, 1981); Needleman and Wunsch (J. Mol. Biol. 48: 443, 1970); Pearson and Lipman (PNAS USA 85: 2444, 1988); Higgins and Sharp (Gene, 73: 237-244, 1988); Higgins and Sharp (CABIOS 5: 151-153, 1989); Corpet et al. (Nuc. Acids Res. 16: 10881-10890, 1988); Huang et al. (Comp. Appls Biosci. 8: 155-165, 1992); and Pearson et al. (Meth. Mol. Biol. 24: 307-31, 1994). Altschul et al. (Nature Genet., 6: 119-129, 1994) presents a detailed consideration of sequence alignment methods and homology calculations. The alignment tools ALIGN (Myers and Miller, CABIOS 4:11-17, 1989) or LFASTA (Pearson and Lipman, 1988) may be used to perform sequence comparisons (Internet Program© 1996, W. R. Pearson and the University of Virginia, fasta20u63 version 2.0u63, release date December 1996). ALIGN compares entire sequences against one another, while LFASTA compares regions of local similarity. These alignment tools and their respective tutorials are available on the Internet at the NCSA Website. Alternatively, for comparisons of amino acid sequences of greater than about 30 amino acids, the Blast 2 sequences function can be employed using the default BLOSUM62 matrix set to default parameters, (gap existence cost of 11, and a per residue gap cost of 1). When aligning short peptides (fewer than around 30 amino acids), the alignment should be performed using the Blast 2 sequences function, employing the PAM30 matrix set to default parameters (open gap 9, extension gap 1 penalties). The BLAST sequence comparison system is available, for instance, from the NCBI web site; see also Altschul et al., J. Mol. Biol. 215:403-410, 1990; Gish. & States, Nature Genet. 3:266-272, 1993; Madden et al. Meth. Enzymol. 266:131-

141, 1996; Altschul et al., Nucleic Acids Res. 25:3389-3402, 1997; and Zhang & Madden, Genome Res. 7:649-656, 1997.

Orthologs of proteins are typically characterized by possession of greater than 75% sequence identity counted over the full-length alignment with the amino acid sequence of specific protein using ALIGN set to default parameters. Proteins with even greater similarity to a reference sequence will show increasing percentage identities when assessed by this method, such as at least 80%, at least 85%, at least 90%, at least 92%, at least 95%, or at least 98% sequence identity. In addition, sequence identity can be compared over the full length of particular domains of the disclosed peptides.

When significantly less than the entire sequence is being compared for sequence identity, homologous sequences will typically possess at least 80% sequence identity over short windows of 10-20 amino acids, and may possess sequence identities of at least 85%, at least 90%, at least 95%, or at least 99% depending on their similarity to the reference sequence. Sequence identity over such short windows can be determined using LFASTA; methods are described at the NCSA Website. One of skill in the art will appreciate that these sequence identity ranges are provided for guidance only; it is entirely possible that strongly significant homologs could be obtained that fall outside of the ranges provided.

An alternative indication that two nucleic acid molecules are closely related is that the two molecules hybridize to each other under stringent conditions. Stringent conditions are sequence-dependent and are different under different environmental parameters. Generally, stringent conditions are selected to be about 5° C. to 20° C. lower than the thermal melting point I for the specific sequence at a defined ionic strength and pH. The Tm is the temperature (under defined ionic strength and pH) at which 50% of the target sequence hybridizes to a perfectly matched probe. Conditions for nucleic acid hybridization and calculation of stringencies can be found in Sambrook et al. (In Molecular Cloning: A Laboratory Manual, Cold Spring Harbor, N. Y., 1989) and Tijssen (Laboratory Techniques in Biochemistry and Molecular Biology Part I, Ch. 2, Elsevier, New York, 1993).

Hybridization conditions resulting in particular degrees of stringency will vary depending upon the nature of the hybridization method of choice and the composition and length of the hybridizing nucleic acid sequences. Generally, the temperature of hybridization and the ionic strength (especially the Na+ concentration) of the hybridization buffer will determine the stringency of hybridization, though waste times also influence stringency. Calculations regarding hybridization conditions required for attaining particular degrees of stringency are discussed by Sambrook et al. (ed.), Molecular Cloning: A Laboratory Manual, 2nd ed., vol. 1-3, Cold Spring Harbor Laboratory Press, Cold Spring Harbor, N. Y., 1989, chapters 9 and 11, herein incorporated by reference. The following is an exemplary set of hybridization conditions:
Very High Stringency (Detects Sequences that Share 90% Identity)
  Hybridization: 5×SSC at 65° C. for 16 hours
  Wash twice: 2×SSC at room temperature (RT) for 15 minutes each
  Wash twice: 0.5×SSC at 65° C. for 20 minutes each
High Stringency (Detects Sequences that Share 80% Identity or Greater)
  Hybridization: 5×-6×SSC at 65° C.-70° C. for 16-20 hours
  Wash twice: 2×SSC at RT for 5-20 minutes each
  Wash twice: 1×SSC at 55° C.-70° C. for 30 minutes each
Low Stringency (Detects Sequences that Share Greater than 50% Identity)
  Hybridization: 6×SSC at RT to 55° C. for 16-20 hours
  Wash at least twice: 2×-3×SSC at RT to 55° C. for 20-30 minutes each.

Nucleic acid sequences that do not show a high degree of identity may nevertheless encode similar amino acid sequences, due to the degeneracy of the genetic code. It is understood that changes in nucleic acid sequence can be made using this degeneracy to produce multiple nucleic acid sequences that each encode substantially the same protein.

Subject: Living multi-cellular vertebrate organisms, a category that includes both human and non-human mammals. This term encompasses both known and unknown individuals, such that there is no requirement that a person working with a sample from a subject know who the subject is, or even from where the sample was acquired.

Tumor or cancer antigen: An antigen that can stimulate tumor-specific T-cell immune responses. Exemplary tumor antigens include, but are not limited to, RAGE-1, tyrosinase, MAGE-1, MAGE-2, NY-ESO-1, Melan-A/MART-1, glycoprotein (gp) 75, gp100, beta-catenin, PRAME, MUM-1, WT-1, CEA, and PR-1. Additional tumor antigens are known in the art (for example see Novellino et al., Cancer Immunol. Immunother. 54(3):187-207, 2005) and are described below (see Table 2). Cancer antigen and tumor antigen are used interchangeably herein. The antigens may be related to cancers that include, but are not limited to, Acute lymphoblastic leukemia; Acute myeloid leukemia; Adrenocortical carcinoma; AIDS-related cancers; AIDS-related lymphoma; Anal cancer; Appendix cancer; Astrocytoma, childhood cerebellar or cerebral; Basal cell carcinoma; Bile duct cancer, extrahepatic; Bladder cancer; Bone cancer, Osteosarcoma/Malignant fibrous histiocytoma; Brainstem glioma; Brain tumor; Brain tumor, cerebellar astrocytoma; Brain tumor, cerebral astrocytoma/malignant glioma; Brain tumor, ependymoma; Brain tumor, medulloblastoma; Brain tumor, supratentorial primitive neuroectodermal tumors; Brain tumor, visual pathway and hypothalamic glioma; Breast cancer; Bronchial adenomas/carcinoids; Burkitt lymphoma; Carcinoid tumor, childhood; Carcinoid tumor, gastrointestinal; Carcinoma of unknown primary; Central nervous system lymphoma, primary; Cerebellar astrocytoma, childhood; Cerebral astrocytoma/Malignant glioma, childhood; Cervical cancer; Childhood cancers; Chronic lymphocytic leukemia; Chronic myelogenous leukemia; Chronic myeloproliferative disorders; Colon Cancer; Cutaneous T-cell lymphoma; Desmoplastic small round cell tumor; Endometrial cancer; Ependymoma; Esophageal cancer; Ewing's sarcoma in the Ewing family of tumors; Extracranial germ cell tumor, Childhood; Extragonadal Germ cell tumor; Extrahepatic bile duct cancer; Eye Cancer, Intraocular melanoma; Eye Cancer, Retinoblastoma; Gallbladder cancer; Gastric (Stomach) cancer; Gastrointestinal Carcinoid Tumor; Gastrointestinal stromal tumor (GIST); Germ cell tumor: extracranial, extragonadal, or ovarian; Gestational trophoblastic tumor; Glioma of the brain stem; Glioma, Childhood Cerebral Astrocytoma; Glioma, Childhood Visual Pathway and Hypothalamic; Gastric carcinoid; Hairy cell leukemia; Head and neck cancer; Heart cancer; Hepatocellular (liver) cancer; Hodgkin lymphoma; Hypopharyngeal cancer; Hypothalamic and visual pathway glioma, childhood; Intraocular Melanoma; Islet Cell Carcinoma (Endocrine Pancreas); Kaposi sarcoma; Kidney cancer (renal cell cancer); Laryngeal Cancer; Leukemias; Leukemia, acute lymphoblastic (also called acute lymphocytic leukemia); Leukemia, acute myeloid (also called acute myelogenous leukemia); Leukemia, chronic lymphocytic (also called chronic lymphocytic leukemia); Leukemia, chronic myelogenous (also called chronic myeloid leukemia); Leukemia, hairy cell; Lip and Oral Cavity Cancer; Liver Cancer (Primary); Lung Cancer, Non-Small Cell; Lung Cancer, Small Cell; Lymphomas; Lymphoma, AIDS-related; Lymphoma, Burkitt; Lymphoma, cutaneous T-Cell; Lymphoma, Hodgkin; Lymphomas, Non-Hodgkin (an old classification of all lymphomas except Hodgkin's); Lymphoma, Primary Central Nervous System; Marcus Whittle, Deadly Disease; Macroglobulinemia, Waldenström; Malignant Fibrous Histiocytoma of Bone/Osteosarcoma; Medulloblastoma, Childhood; Melanoma; Melanoma, Intraocular (Eye); Merkel Cell Carcinoma; Mesothelioma, Adult Malignant; Mesothelioma, Childhood; Metastatic Squamous Neck Cancer with Occult Primary; Mouth Cancer; Multiple Endocrine Neoplasia Syndrome, Childhood; Multiple Myeloma/Plasma Cell Neoplasm; Mycosis Fungoides; Myelodysplastic Syndromes; Myelodysplastic/Myeloproliferative Diseases; Myelogenous Leukemia, Chronic; Myeloid Leukemia, Adult Acute; Myeloid Leukemia, Childhood Acute; Myeloma, Multiple (Cancer of the Bone-Marrow); Myeloproliferative Disorders, Chronic; Nasal cavity and paranasal sinus cancer; Nasopharyngeal carcinoma; Neuroblastoma; Non-Hodgkin lymphoma; Non-small cell lung cancer; Oral Cancer; Oropharyngeal cancer; Osteosarcoma/malignant fibrous histiocytoma of bone; Ovarian cancer; Ovarian epithelial cancer (Surface epithelial-stromal tumor); Ovarian germ cell tumor; Ovarian low malignant potential tumor; Pancreatic cancer; Pancreatic cancer, islet cell; Paranasal sinus and nasal cavity cancer; Parathyroid cancer; Penile cancer; Pharyngeal cancer; Pheochromocytoma; Pineal astrocytoma; Pineal germinoma; Pineoblastoma and supratentorial primitive neuroectodermal tumors, childhood; Pituitary adenoma; Plasma cell neoplasia/Multiple myeloma; Pleuropulmonary blastoma; Primary central nervous system lymphoma; Prostate cancer; Rectal cancer; Renal cell carcinoma (kidney cancer); Renal pelvis and ureter, transitional cell cancer; Retinoblastoma; Rhabdomyosarcoma, childhood; Salivary gland cancer; Sarcoma, Ewing family of tumors; Sarcoma, Kaposi; Sarcoma, soft tissue; Sarcoma, uterine; Sézary syndrome; Skin cancer (nonmelanoma); Skin cancer (melanoma); Skin carcinoma, Merkel cell; Small cell lung cancer; Small intestine cancer; Soft tissue sarcoma; Squamous cell carcinoma—see Skin cancer (nonmelanoma); Squamous neck cancer with occult primary, metastatic; Stomach cancer; Supratentorial primitive neuroectodermal tumor, childhood; T-Cell lymphoma, cutaneous (Mycosis Fungoides and Sézary syndrome); Testicular cancer; Throat cancer; Thymoma, childhood; Thymoma and Thymic carcinoma; Thyroid cancer; Thyroid cancer, childhood; Transitional cell cancer of the renal pelvis and ureter; Trophoblastic tumor, gestational; Unknown primary site, carcinoma of, adult; Unknown primary site, cancer of, childhood; Ureter and renal pelvis, transitional cell cancer; Urethral cancer; Uterine cancer, endometrial; Uterine sarcoma; Vaginal cancer; Visual pathway and hypothalamic glioma, childhood; Vulvar cancer; Waldenström macroglobulinemia and Wilms tumor (kidney cancer), childhood.

Under conditions sufficient for/to: A phrase that is used to describe any environment that permits the desired activity.

Vaccine: An immunogenic composition that can be administered to a mammal, such as a human, to confer immunity, such as active immunity, to a disease or other pathological condition. Vaccines can be used prophylactically or therapeutically. Thus, vaccines can be used reduce the likelihood of developing a disease (such as a tumor or infection) or to reduce the severity of symptoms of a disease or condition, limit the progression of the disease or condition (such as a tumor or infection), or limit the recurrence of a disease or condition. In particular embodiments, a vaccine is a recombinant CMV (such as a recombinant HCMV or recombinant RhCMV) expressing a heterologous antigen, such as a pathogen-specific antigen or a tumor antigen.

Vector: Nucleic acid molecules of particular sequence can be incorporated into a vector that is then introduced into a host cell, thereby producing a transformed host cell. A vector may include nucleic acid sequences that permit it to replicate in a host cell, such as an origin of replication. A vector may also include one or more selectable marker genes and other genetic elements known in the art, including promoter elements that direct nucleic acid expression. Vectors can be viral vectors, such as CMV vectors. Viral vectors may be constructed from wild type or attenuated virus, including replication deficient virus. Vectors can also be non-viral vectors, including any plasmid known to the art.

Virus: Microscopic infectious organism that reproduces inside living cells. A virus consists essentially of a core of nucleic acid (the viral genome) surrounded by a protein coat (capsid), and has the ability to replicate only inside a living cell. "Viral replication" is the production of additional virus particles by the occurrence of at least one viral life cycle. A virus may subvert the host cells' normal functions, causing the cell to behave in a manner determined by the virus. For example, a viral infection may result in a cell producing a cytokine, or responding to a cytokine, when the uninfected cell does not normally do so.

In a "lytic" or "acute" viral infection, the viral genome is replicated and expressed, producing the polypeptides necessary for production of the viral capsid. Mature viral particles exit the host cell, resulting in cell lysis. Particular viral species can alternatively enter into a "'lysogenic" or "latent" infection. In the establishment of latency, the viral genome is replicated, but capsid proteins are not produced and assembled into viral particles.

Unless otherwise explained, all technical and scientific terms used herein have the same meaning as commonly understood by one of ordinary skill in the art to which this disclosure belongs. The singular terms "a," "an," and "the" include plural referents unless context clearly indicates otherwise. Similarly, the word "or" is intended to include "and" unless the context clearly indicates otherwise. Hence "comprising A or B" means including A, or B, or A and B. It is further to be understood that all base sizes or amino acid sizes, and all molecular weight or molecular mass values, given for nucleic acids or polypeptides are approximate, and are provided for description. Although methods and materials similar or equivalent to those described herein can be used in the practice or testing of the present disclosure, suitable methods and materials are described below. All publications, patent applications, patents, and other references mentioned herein are incorporated by reference in their entirety. In case of conflict, the present specification, including explanations of terms, will control. In addition, the materials, methods, and examples are illustrative only and not intended to be limiting.

Described herein are recombinant RhCMV and HCMV vectors encoding heterologous antigens, such as pathogen-specific antigens or tumor antigens. The recombinant vectors disclosed herein elicit and maintain high level cellular and humoral immune responses specific for the heterologous antigen. Thus, the disclosed CMV vectors are suitable for use as vaccines to treat or prevent infectious disease and cancer. Also disclosed are recombinant RhCMV and HCMV vectors lacking at least one essential or augmenting gene (replication-deficient viruses). Replication-deficient CMVs can include a heterologous antigen, such as a pathogen-specific antigen or a tumor antigen, and thus can be used as vaccines to treat or prevent the corresponding infection or cancer. In other cases, the replication-deficient CMVs, which are attenuated, lack a heterologous antigen and can be used as a vaccine against CMV.

Thus, provided herein are recombinant RhCMV or HCMV vectors comprising a nucleic acid sequence encoding a heterologous antigen. In some embodiments, the heterologous antigen is a pathogen-specific antigen. In other embodiments, the heterologous antigen is a tumor antigen.

In some embodiments, the pathogen-specific antigen is a viral antigen. The viral antigen can be from any virus that is known to be pathogenic, or against which it is desirable to elicit an immune response. In some examples, the viral antigen is an antigen from influenza virus, monkeypox virus, West Nile virus, Chikungunya virus, Ebola virus, hepatitis C virus, poliovirus, dengue virus serotype 1, dengue virus serotype 2, dengue virus serotype 3 or dengue virus serotype 4, Papillomavirus, SIV, HIV, HCMV, Kaposi's sarcoma associated herpesvirus, varcella zoster virus, Epstein-barr virus, Herpes simplex 1 virus and Herpes simplex 2 virus. Specific antigens from these and other viruses are well known in the art. Thus, a suitable antigen can be selected by one of ordinary skill in the art.

In particular examples, the influenza virus antigen is hemagglutinin or neuraminidase, or an epitope or antigenic fragment thereof; the monkeypox virus antigen is A35R, or an epitope or antigenic fragment thereof; the West Nile virus antigen is capsid (C), membrane (prM/M), envelope (E), NS1, NS2A, NS2B, NS3, NS4A, NS4B or NS5, or an epitope of antigenic fragment thereof; the Chikungunya virus antigen is capsid (C), envelope glycoprotein 1 (E1), envelope glycoprotein 2 (E2), envelope glycoprotein 3 (E3) or non-structural protein 1 (NSP1), or an epitope or antigenic fragment thereof; the Ebola virus antigen is nucleoprotein (NP), or an epitope or antigenic fragment thereof; the hepatitis C virus antigen is core, E1, E2, NS2, NS3, NS4 or NS5, or an epitope or antigenic fragment thereof; the poliovirus antigen is VP1, or an epitope or antigenic fragment thereof; or the dengue virus antigen is capsid (C), membrane (prM/M), envelope (E), NS1, NS2A, NS2B, NS3, NS4A, NS4B or NS5, or an epitope or antigenic fragment thereof.

In some embodiments in which the recombinant RhCMV or HCMV vector is replication-deficient, the vector does not include a heterologous antigen. Such a recombinant vector, which is attenuated, can be used to treat or prevent infection with CMV.

In some embodiments, the pathogen-specific antigen is a bacterial antigen. The bacterial antigen can be from any type of bacteria that is known to be pathogenic, or against which it is desirable to elicit an immune response. In some embodiments, the bacterial antigen is from *Mycobacterium tuberculosis*, the causative agent of Tuberculosis. In some embodiments, the bacterial antigen is from *Clostridium tetani*, the causative agent of tetanus. Specific antigens from *Clostridium tetani* are well known in the art. Thus, a suitable antigen from *Clostridium tetani* can be selected by one of ordinary skill in the art. In particular examples, the antigen from *Clostridium tetani* is tetanusC.

In some embodiments, the pathogen-specific antigen is a fungal antigen. The fungal antigen can be from any fungus that is known to be pathogenic, or against which it is desirable to elicit an immune response.

In some embodiments, the pathogen-specific antigen is a protozoan antigen. The protozoan antigen can be from any protozoan that is known to be pathogenic, or against which it is desirable to elicit an immune response. In some examples, the protozoan antigen is an antigen from a *Plasmodium* species, such as *Plasmodium falciparum, Plasmodium vivax,* *Plasmodium ovale* or *Plasmodium malariae*. Specific antigens from *Plasmodium* species are well known in the art. Thus, a suitable antigen can be selected by one of ordinary skill in the art. In particular examples, the antigen from *Plasmodium* is a pre-erythrocytic antigen, such as CSP or SSP2, or an erythrocytic antigen, such as AMA1 or MSP1.

In some embodiments, the tumor antigen is an antigen expressed by a solid tumor. In other embodiments, the tumor antigen is an antigen expressed by a hematological cancer. Tumor antigens are well known in the art and a non-limiting list of tumor antigens is provided herein.

The RhCMV or HCMV vectors can be derived from any RhCMV or HCMV virus isolate, strain or variant (such as a clinical isolate or laboratory strain). In some embodiments, the RhCMV is Cercopithecine herpesvirus 8. In particular examples, the RhCMV comprises the nucleotide sequence of SEQ ID NO: 1, or a nucleotide sequence that is at least 80%, at least 85%, at least 90%, at least 95% or at least 99% identical to SEQ ID NO: 1. The RhCMV vector can also be BAC encoding the RhCMV genome. In some embodiments, recombinant RhCMV vector includes a deletion of one or more genes encoding an immunomodulatory protein. In some examples, the deletion comprises a deletion of Rh182-189 or Rh158-166, or both.

In some embodiments, the HCMV comprises the AD169 lab strain, wild-type strain Merlin, Towne BAC HCMV isolate, Toledo-BAC HCMV isolate, TR-BAC HCMV isolate, FIX-BAC HCMV isolate, AD169-BAC HCMV isolate or HCMV strain Davis. In particular examples, the HCMV vector comprises the nucleic acid sequence of SEQ ID NO: 2, SEQ ID NO: 3, SEQ ID NO: 4, SEQ ID NO: 5, SEQ ID NO: 6, SEQ ID NO: 7, SEQ ID NO: 8 or SEQ ID NO: 9. In certain embodiments, a variant of a HCMV or RhCMV vector can be used, for example, a variant that is at least 80%, at least 85%, at least 90%, at least 95% or at least 99% identical to any one of SEQ ID NOs: 2-9, but that retains the capacity to function as a vector.

Recombinant RhCMV and CMV vectors are publicly available and/or have been previously described. For example, several CMV vectors are available from the American Type Culture Collection (Manassas, Va.), including HCMV AD169 (ATCC VR-538), HCMV Towne (ATCC VR-977) and HCMV Davis (ATCC VR-807). HCMV Toledo strain has also been described (see Quinnan et al., *Ann Intern Med* 101: 478-83, 1984). Recombinant HCMV and RhCMV are also described in, for example, U. S. Patent Application Publication No. 2009/029755 and PCT Publication No. WO 2006/031264, which is incorporated herein by reference.

In some embodiments, the recombinant RhCMV or HCMV vector comprises a deletion in a RhCMV or HCMV gene that is essential for or augments replication. CMV essential genes and augmenting have been well described in the art (see, for example, Dunn et al., *Proc. Natl. Acad. Sci. USA* 100(24):14223-14228, 2003; and Dong et al., *Proc. Natl. Acad. Sci. USA* 100(21):12396-12401, 2003). Essential CMV genes include, but are not limited to, UL32, UL34, UL37, UL44, UL46, UL48, UL48.5, UL49, UL50, UL51, UL52, UL53, UL54, UL55, UL56, UL57, UL60, UL61, UL70, UL71, UL73, UL75, UL76, UL77, UL79, UL80, UL82, UL84, UL85, UL86, UL87, UL89, UL90, UL91, UL92, UL93, UL94, UL95, UL96, UL98, UL99, UL100, UL102, UL104, UL105, UL115 and UL122. In some embodiments, the CMV essential or augmenting gene is UL82, UL94, UL32, UL99, UL115 or UL44, or a homolog thereof (i.e., the homologous gene in RhCMV). Other essential or augmenting genes are known in the art and are described herein. In particular examples, the essential gene is UL82, or a homolog thereof. In some embodiments, the recombinant RhCMV and HCMV vectors do not include a heterologous antigen. In other embodiments, the recombinant RhCMV or HCMV vector having a deletion in an essential or augmenting gene includes a nucleic acid sequence encoding a heterologous antigen, such as a pathogen-specific antigen or a tumor antigen. Compositions comprising recombinant RhCMV or HCMV vectors and a pharmaceutically acceptable carrier also are provided. Such vectors and compositions can be used, for example, in a method of treating a subject with an infectious disease, or at risk of becoming infected with an infectious disease, or with cancer, or at risk of developing cancer. CMV vectors having a deletion of at least one essential or augmenting gene are generally attenuated and thus can be used as vaccines for the treatment or prevention of CMV (in which case, the recombinant vector does not encode a heterologous antigen).

In some embodiments, the recombinant RhCMV or HCMV vectors comprise a suicide or safety means to prevent further replication of the virus. For example, the recombinant CMV vectors can include LoxP sites flanking an essential gene or region of the RhCMV or HCMV genome (essential CMV genes are listed above and are known in the art), as well as the coding sequence for Cre-recombinase. Cre-recombinase is generally under the control of an inducible promoter to regulate expression of Cre, thereby controlling removal of the essential gene and inhibition of viral replication. In particular examples, Cre is a Tet-regulated Cre and expression of Cre is controlled by the presence of Dox.

Also provided are compositions comprising a recombinant RhCMV or HCMV vector disclosed herein and a pharmaceutically acceptable carrier.

Further provided is a method of treating a subject with an infectious disease, or at risk of becoming infected with an infectious disease, or with cancer, or at risk of developing cancer, by selecting a subject in need of treatment and administering to the subject a recombinant RhCMV or HCMV vector, or composition thereof, disclosed herein. In some embodiments, selecting a subject in need of treatment includes selecting a subject diagnosed with an infectious disease, such as a viral disease, a bacterial disease, a fungal disease or a protozoan disease. In other embodiments, selecting a subject in need of treatment includes selecting a subject that has been exposed or is likely to be exposed to an infectious agent. In other embodiments, selecting a subject in need of treatment includes selecting a subject diagnosed with cancer. In other embodiments, selecting a subject in need of treatment includes selecting a subject that is at risk of developing cancer, such as a subject that has been exposed to a carcinogen, a subject that has cancer associated genetic mutations or a subject that has previously had cancer.

In some embodiments of the methods, the infectious disease is influenza virus infection and the recombinant RhCMV or HCMV vector encodes an antigen from influenza virus. In other embodiments, the infectious disease is monkeypox virus infection and the recombinant RhCMV or HCMV vector encodes an antigen from monkeypox virus. In other embodiments, the infectious disease is West Nile virus infection and the recombinant RhCMV or HCMV vector encodes an antigen from West Nile virus. In other embodiments, the infectious disease is Chikungunya virus infection and the recombinant RhCMV or HCMV vector encodes an antigen from Chikungunya virus. In other embodiments, the infectious disease is Ebola virus infection and the recombinant RhCMV or HCMV vector encodes an antigen from Ebola virus. In other embodiments, the infectious disease is hepatitis C virus infection and the recombinant RhCMV or HCMV vector encodes an antigen from hepatitis C virus. In other embodiments, the infectious disease is poliovirus infection and the recombinant RhCMV or HCMV vector encodes an antigen from poliovirus. In other embodiments, the infectious disease is dengue fever and the recombinant RhCMV or HCMV vector encodes an antigen from dengue virus serotype 1, dengue virus serotype 2, dengue virus serotype 3 or dengue virus serotype 4. In other embodiments, the disease is Acquired immune deficiency syndrome (AIDS) or a Simian Immunodeficiency virus (SIV) infection and the recombinant RhCMV or HCMV vector encodes an antigen from HIV or SIV. In other embodiments, the disease is or is related to skin warts, genital warts, cervical cancer or respiratory papillomatosis, and the recombinant RhCMV or HCMV vector encodes an antigen from HPV. In other embodiments, the disease is Malaria and the recombinant RhCMV or HCMV vector encodes an antigen from eukaryotic protists of the genus *Plasmodium*. In other embodiments, the disease is Ebola hemorrhagic fever and the recombinant RhCMV or HCMV vector encodes an antigen from the Ebola virus. In other embodiments, the disease is Tuberculosis and the recombinant RhCMV or HCMV vector encodes an antigen from the *Mycobacterium tuberculosis*. In other embodiments, the disease is Ebola hemorrhagic fever and the recombinant RhCMV or HCMV vector encodes an antigen from the Ebola virus.

In other embodiments, the disease is a Herpes disease and the recombinant RhCMV or HCMV vector encodes an antigen from a Herpes virus. A herpes disease includes but is not limited to Genital Herpes, Chicken pox or Herpes Zoster (shingles), Infectious mononucleosis and Kaposi's sarcoma. The recombinant RhCMV or HCMV vector encodes an antigen from viruses that include but are not limited to Herpes simplex virus-1 (HSV-1), Herpes simplex virus-2 (HSV-2), Varicella zorter virus (VZV), Epstein-Barr virus (EBV), Roseolovirus, and Kaposi's sarcoma-associated herpesvirus (KSHV). In some embodiments of the methods, the infectious disease is CMV infection and the vector does not include a heterologous antigen.

In some embodiments of the methods, the cancer is a solid tumor and the RhCMV or HCMV vector encodes a tumor antigen from a solid tumor. In other embodiments, the cancer is a hematological cancer and the RhCMV or HCMV vector encodes a tumor antigen from a hematological cancer.

Cytomegaloviruses (CMVs) comprise a distinct, widely distributed subgroup of β-herpesviruses that share common growth characteristics, characteristic cytopathology, salivary gland tropism and a capacity to establish persistent and latent infection. Among the largest and most complex of known viruses, CMV virions range in size from 150-200 nm and include a double stranded DNA genome of 230 kb—capable of coding for more than 200 proteins. The β-herpes viruses in general, and the CMVs in specific, are thought to have emerged prior to mammalian radiation, and therefore, viral evolution has accompanied mammalian speciation such that each species has their own uniquely adapted CMV, and CMV relatedness generally parallels species relatedness. Thus, the genetics and biology of primate CMVs (human, chimp, RM) are considerably more closely related to each other than to rodent CMVs. In both humans in developing counties and in RM, CMV infection is essentially universal with 90-100% of adults showing serologic evidence of infection (Vogel et al., *Lab Anim Sci* 44(1):25-30, 1994; Ho, *Rev Infect Dis* 12 Suppl 7:S701-710, 1990). In affluent areas of developed countries, increased hygiene has somewhat limited transmission with only 40-60% of the adult population showing seroreactivity. For the vast majority of exposed (immunologically normal)

subjects, either human or monkey, acute infection with CMV is completely asymptomatic (Zanghellini et al., *J Infect Dis* 180(3):702-707, 1999; Lockridge et al., *J Virol* 73(11):9576-83, 1999); a small fraction of humans (<5%) experience symptomatic, but benign illness, and an even smaller fraction experience a mononucleosis syndrome (CMV accounts for ~8% of all cases of mononucleosis) (Zanghellini et al., *J Infect Dis* 180(3):702-707, 1999).

After initial infection, CMV is shed for months to years in multiple body fluids (saliva, tears, urine, genital secretions, breast milk), and transmission generally involves mucosal exposure to such fluids, and not surprisingly occurs in situations where such secretion 'transfer' is common (early childhood and adolescence). CMV persists in the host indefinitely and viral shedding can occur years after exposure. CMV can manifest latent infection of its target cells, and like other herpes viruses, this capability likely plays a role in this remarkable persistence. However, unlike herpes simplex and varicella-zoster virus, the frequency of shedding (particularly in monkeys), the kinetics of reactivation after transplantation, and the unique strength of the T cell response suggest that foci of active CMV replication are frequently, if not continuously, occurring somewhere in the infected host's body. Such active persistence implies a means for evading host immunity, and indeed, CMV has evolved diverse mechanisms for manipulating both innate and adaptive immune responses, including genes that modulate/interfere with 1) Ag presentation and other major histocompatibility complex (MHC) protein function, 2) leukocyte migration, activation and cytokine responses, 3) Fc receptor function, and 4) host cell susceptibility to apoptosis induction (Mocarski, *Trends Microbiol* 10(7):332-329, 2002; Atalay et al., *J Virol* 76(17):8596-608, 2002; Skaletskaya et al., *Proc Natl Acad Sci USA* 98(14): 7829-34, 2001; Penfold et al., *Proc Natl Acad Sci USA* 96(17):9839-9844, 1999; Benedict et al., *J Immunol* 162(12): 6967-6970, 1999; Spencer et al., *J Virol* 76(3):1285-92, 2002). These sophisticated immune evasion strategies might explain CMV's ability to re-infect immune hosts (Plotkin et al., *J Infect Dis* 159(5): 860-865, 1989; Boppana et al., *N Engl J Med* 344(18):1366-1371, 2001; and see below).

Despite this impressive persistence and immune evasion, and despite CMV's ability to replicate in a wide variety of cell types, overt disease in chronic CMV infection is exceedingly rare. Indeed, given its essentially apathogenic nature in normal children and adults, CMV would likely be an obscure virus, if not for the discovery in the 1950s of its involvement with fetal/neonatal cytomegalic inclusion disease—an important medical problem because of its associated damage to the CNS and sensory organs—and later, its appearance as one of the most common and devastating opportunistic pathogens in the settings of organ/bone marrow transplantation and AIDS. These situations have one striking commonality—immunodeficiency, particularly in cell-mediated immunity, related to immunologic immaturity, pharmacologic immunosuppression (transplantation), or the progressive immunodeficiency of HIV infection. This well-characterized relationship between immunity and CMV disease suggests that CMV infection exemplifies a complex host-parasite relationship in which a delicate balance has been evolutionarily 'negotiated' between viral mechanisms of pathogenesis, persistence, and immune evasion and the host immune response. In essence, the virus is not eliminated from the host and has relatively free rein to replicate in excretion sites; yet host immunity restricts replication in most sites—those in which such replication would lead to disease. With this balance, the virus enjoys pervasiveness in a large host population that could not occur with unchecked pathogenicity. As for the host, the ability of a normal immune system to essentially eliminate pathogenicity within reproductively relevant members of the population suggests that the support of this pathogen does not pose a significant evolutionary handicap.

Figure 2:
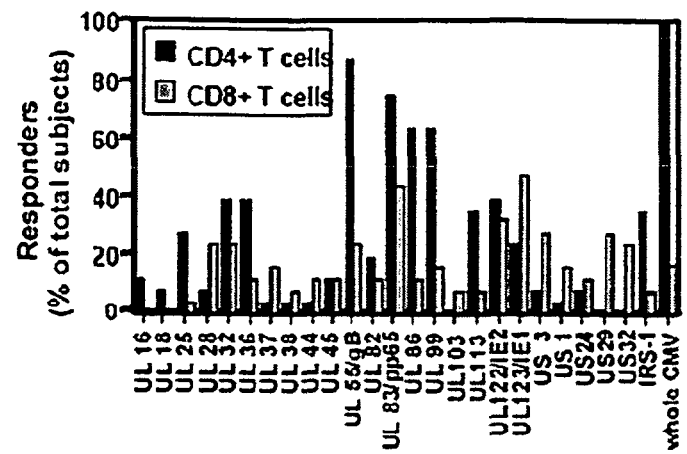
FIG. 2 is a set of graphs showing the percentage of CMV seropositive donors with T cell responses ($CD4^+$ and $CD8^+$ T cells) to whole CMV or selected ORFs in PB (top); the mean response frequencies within the total PB T cell population to selected RhCMV ORFs (middle); and the mean response frequencies within the memory PB T cell population to selected RhCMV ORFs.
Figure 2:
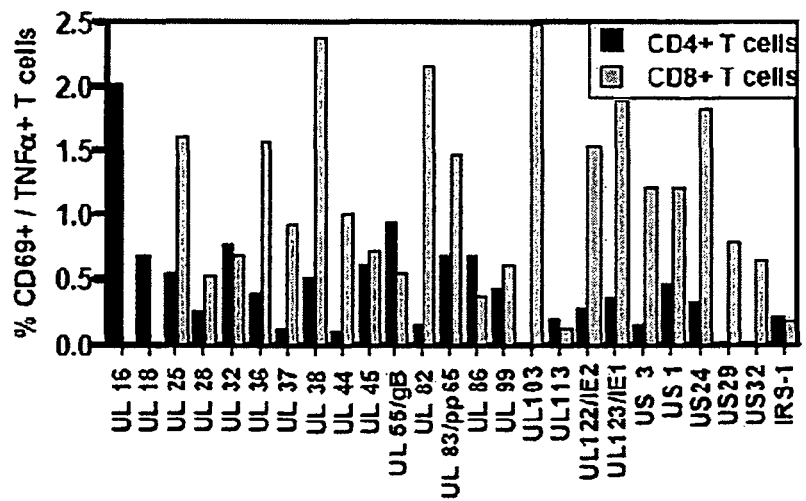
Figure 2:
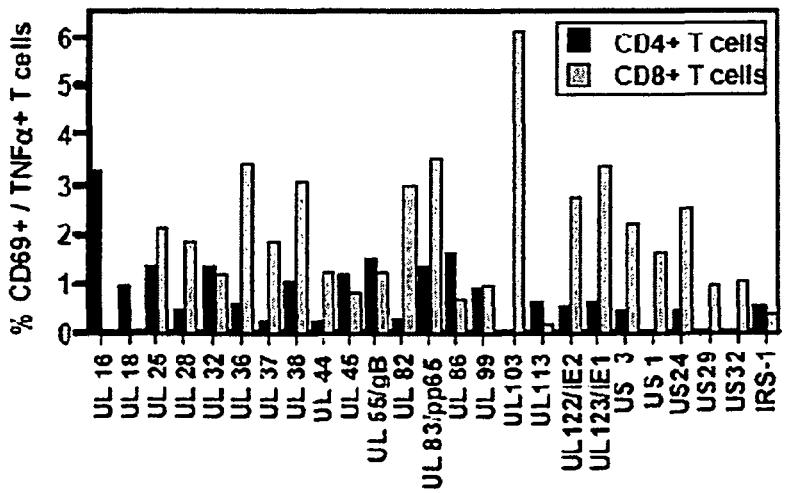

Although the immunologic requirements for maintaining this host-virus balance are not yet well characterized, the immunologic 'resources' specifically devoted to CMV are known to be quite large. The median CD4+ T cell response frequencies to human CMV (HCMV) are 5-10 fold higher than the median CD4+ T cell response frequencies to (whole) non-persistent viruses such as mumps, measles, influenza, and adenovirus, and even other persistent viruses such as herpes simplex and varicella-zoster viruses. High frequency CD8+ T cell responses to particular HCMV epitopes or ORFs are also typical. The Applicants have quantified total blood CD4+ and CD8+ T cell responses to the entire CMV genome (using ~14,000 overlapping peptides, cytokine flow cytometry, and a large cohort of HLA-disparate CMV-seropositive subjects). The Applicants have 'interrogated' all of these peptides (217 ORF mixes) in 24 CMV seropositive and 5 seronegative subjects and have found that when totaled, the median frequencies of CMV-specific CD4+ and CD8+ T cells in CMV-seropositive subjects are 5-6% for the total CD4+ or CD8+ T cell populations (which corresponds to 10-11% of the memory populations) (FIGS. 1, 2). The total responses in seronegative subjects are less than 0.5%, a number that represents the 'background' of this summation analysis. Astonishingly, in some individuals, CMV-specific T cells account for more than 25% of the memory T cell repertoire in peripheral blood. This T cell response is broad—each subject recognizes an average of 19 HCMV ORFs (~equally distributed among CD4 and CD8 responses), and at least 28 ORFs provoke significant CD4+ or CD8+ T cell responses (≥0.2% of peripheral blood memory population) in 20% or more of the subjects tested.

The precise mechanisms by which these large CMV-specific T cell populations are generated and maintained following infection are not understood, but probably relate to the ability of this virus to maintain infection, including active, productive infection in local microenvironments, in the face of a substantial immune response over the life of the host. In addition, CMV is capable of re-infecting fully immune hosts (Boppana et al., *N Engl J Med* 344(18):1366-1371, 2001; Plotkin et al., *J Infect Dis* 159(5):860-865, 1989), and it is shown herein in the RM model that experimental re-infection significantly increases steady state frequencies of CMV-specific T cells, indicating that periodic re-infection plays a central role in the extraordinary build-up of CMV-specific T cell response frequencies. Finally, the abilities of HCMV to infect professional Ag-presenting cells (macro-phages, dendritic cells), and produce abundant dense bodies (enveloped tegument protein complexes that can 'infect' target cells but lack genetic material) might contribute to the generation of these robust T cell responses.

Importantly, the characteristics of the antiviral antibody response to HCMV mirror those mentioned above for antiviral T cell immunity. HCMV-specific antibody responses are notable for their reactivity with a large number of viral proteins and by the persistence of stable titers against viral proteins for decades. Antibodies specific for HCMV-encoded proteins, including those against structural proteins made only during virus replication, develop rapidly after primary infection and are maintained at significant titers, likely because of the persistent expression of virus-encoded proteins. Antibody specific for HCMV is also present on mucosal surfaces, perhaps as a result of the tropism of this virus for secretory glands. Interestingly, anti-HCMV antibody responses also boost following both community-acquired re-infections and re-infections in transplant recipients.

As indicated above, RMs, the most utilized animal model of lentivirus (SIV) infection, display a natural CMV infection that closely mimics human infection with HCMV in terms of epidemiology, patterns of infection and disease in immunocompetent and immunodeficient hosts, particularly including RhCMV's role as a major opportunistic pathogen of SIV-infected monkeys. Not surprisingly, this biologic relatedness is reflected by genetic relatedness. Early work revealed high homology between the HCMV genes gB, IE1 and UL121-117 and their RhCMV homologues (Kravitz et al., *J Gen Virol* 78(Pt 8):2009-2013, 1997; Barry et al., *Virology* 215(1):61-72, 1996). The Applicants obtained and analyzed the complete sequence of RhCMV strain 68.1, and identified 236 potential ORFs of 100 or more amino acids that are positionally arranged in similar fashion as their HCMV counterparts. Of these 236 ORFs, 138 (58.47%) are clearly homologous to known HCMV proteins. Some of the RhCMV that are homologous to HCMV ORFs known to be nonessential for replication in fibroblasts are listed in Table 1 below. In some embodiments, these ORFs are sites for insertion of pathogenic antigens for expression in the disclosed CMV-based vaccine vectors.

In comparison, murine CMV encodes 170 ORFs, of which 78 (45.9%) are homologous to known HCMV proteins. Importantly, in contrast to murine CMV, RhCMV encodes a full complement of HCMV-like immune evasion genes, and tegument proteins with sufficient homology to HCMV to form dense bodies.

TABLE 1

Representative examples of RhCMV ORFs with homologues in the HCMV genome

| RhCMV ORFs | HCMV ORFs | RhCMV mutant |
|---|---|---|
| Rh01 | RL1 | |
| Rh05 | UL153 | |
| Rh17 | UL4 | |
| Rh19 | UL7 | |
| Rh20 | UL6 | |
| Rh31 | UL13 | |
| Rh33 | UL14 | 25698, 25739 |
| Rh35a | UL19 | |
| Rh36 | UL20 | |
| Rh40 | UL23 | 31242 |
| Rh42 | UL24 | 31782, 32619 |
| Rh43 | UL25 | 33323, 33711 |
| Rh54 | UL31 | |
| Rh56 | UL33 | |
| Rh59 | UL35 | |
| Rh68 | UL42 | |
| Rh69 | UL43 | 54274 |
| Rh72 | UL45 | 57859, 58210 |
| Rh107 | UL78 | |
| Rh123 | UL88 | 122332, 122472 |
| Rh143 | UL111A | |
| Rh148 | UL116 | |
| Rh151/2 | UL118/9 | |
| Rh155 | UL121 | 155860 |
| Rh158 | UL147 | |
| Rh159 | UL148 | 165110 |
| Rh160 | UL132 | |
| Rh160a | UL130 | |
| Rh162 | UL145 | |
| Rh163 | UL144 | |
| Rh164 | UL141 | |
| Rh181 | US1 | |
| Rh182 | US2 | |
| Rh184 | US3 | |
| Rh189 | US11 | |
| Rh190 | US12 | |
| Rh192 | US13 | |
| Rh198 | US17 | |
| Rh199 | US18 | |
| Rh200 | US19 | |
| Rh201 | US20 | |
| Rh202 | US21 | |
| Rh203 | US22 | |
| Rh221 | US29 | |
| Rh223 | US30 | |
| Rh225 | US31 | |

Each annotated RhCMV ORF, as well as several previously unrecognized ORFs (Rh35a and Rh160a), was compared to the full set of HCMV ORFs using the BlastP algorithm. Scores with a significance of ≤$10^{-5}$ were considered matches. If more than one RhCMV ORF corresponded to an HCMV ORF (e.g., Rh111 and 112 are homologous to UL83) the RhCMV ORF was excluded from the list. Nine of the RhCMV ORFs have been mutated by insertion of a transposon, and insert sites are indicated. The Rh151/2 ORFs correspond to the spliced HCMV UL118/9 ORFs.

Basically, BlastP was used to search the RhCMV genome for ORFs that are homologous to HCMV ORFs known to be nonessential for replication in fibroblasts. These nonessential HCMV ORFs were identified: (i) from the literature; (ii) from transposon mutagenesis of the AD169 strain of HCMV; and (iii) from the fact that they are in clinical isolates but not the AD169 laboratory strain. A total of 48 RhCMV ORFs met these criteria and they are listed in Table 1. The HCMV homologues of three of these ORFs (Rh182, 184 and 189) are known to be immunomodulatory genes, and three additional immunomodulatory ORFs (Rh185, Rh186 and Rh187) were not identified in the BlastP analysis because their HCMV homologues were deleted during the BAC cloning of the clinical HCMVs that were sequenced. To confirm the relationship between the RhCMV and HCMV ORFs, ClustalW was used to perform multiple sequence alignments. Each RhCMV ORF was compared to the corresponding ORFs from four clinical isolates of HCMV. This analysis demonstrated that each RhCMV ORF has an ortholog in all four HCMV clinical isolates that have been sequenced, and it confirmed that the ORFs from the rhesus and human viruses are indeed related, ruling out the possibility that the original BlastP scores resulted from short homologies in otherwise unrelated proteins.

In particular exemplary vectors, two gene blocks are deleted: Rh182-189, which contains homologues to the known HCMV immunomodulatory genes US2-11, and Rh158-166, which contains genes that are present in clinical isolates but missing in laboratory strains of HCMV.

Figure 3:
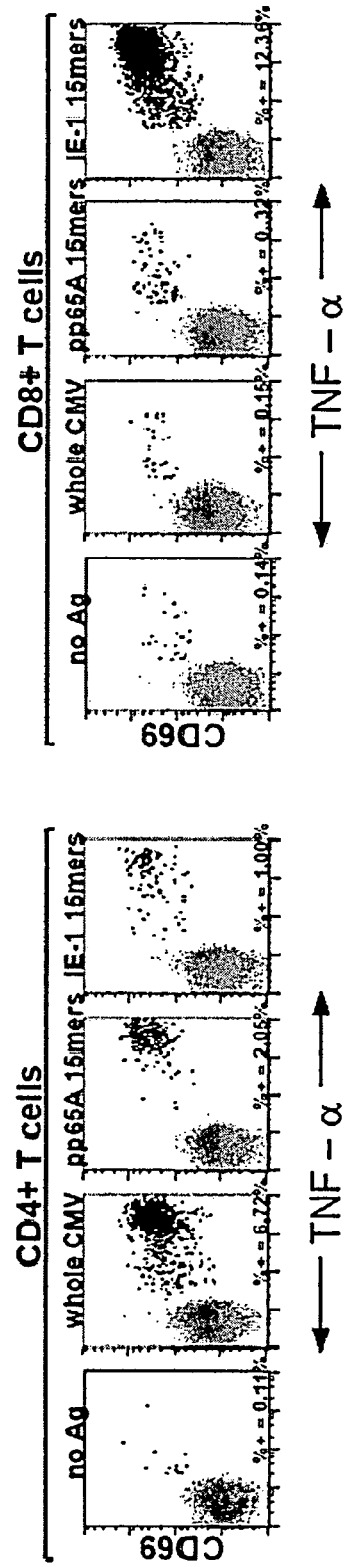
FIG. 3 is a series of FACS plots showing robust peripheral blood T cell responses to RhCMV.
Figure 4:
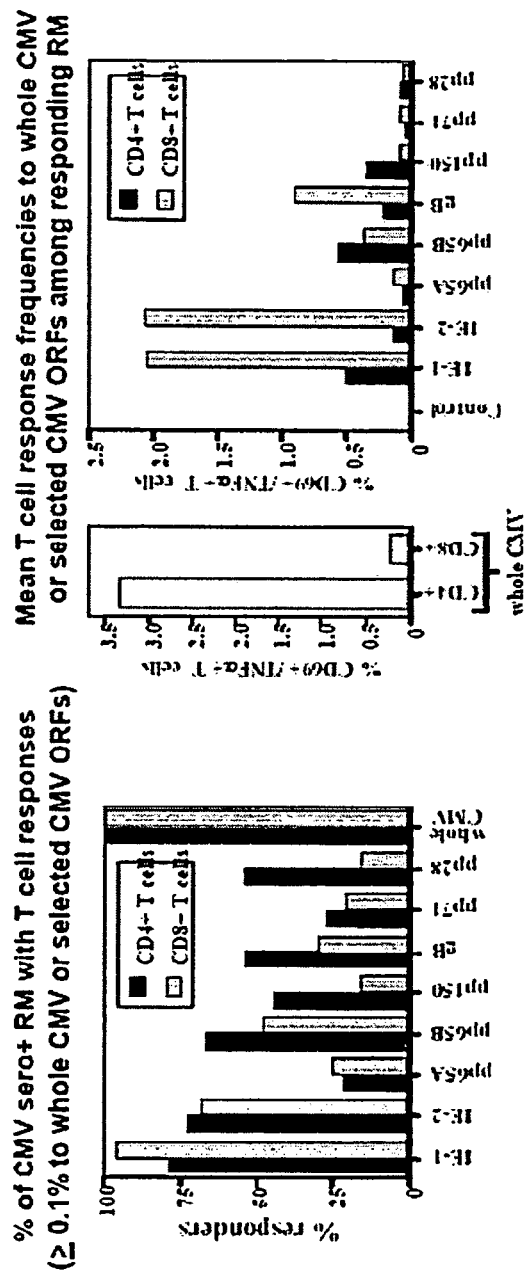
FIG. 4 is a set of graphs showing peripheral blood T cell responses to RhCMV in 27 adult males. Shown are the percentage of CMV seropositive RM with T cell responses (≥0.1% to whole CMV or selected CMV ORFs) (left); and mean T cell response frequencies to whole CMV (middle) or selected CMV ORFs (right) among responding RM.
Figure 5:
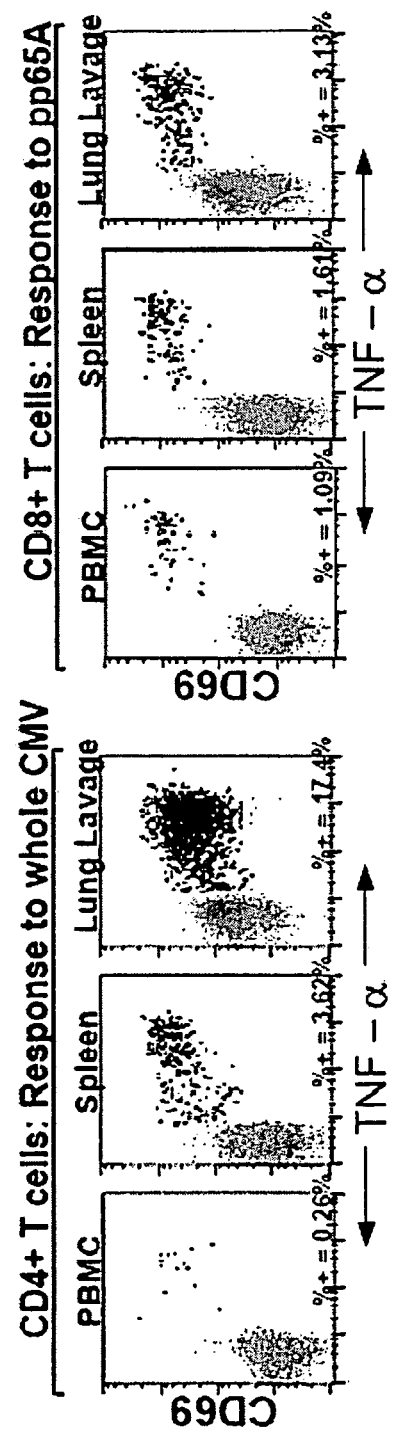
FIG. 5 is a series of FACS plots showing RhCMV-specific memory T cells are highly enriched in spleen and lung. Six thousand events are shown, gated on total CD4+ or CD8+ T cells with the "%+" representing the net response frequencies after subtracting background within these subsets. Responding cells are all memory cells, and in the example shown, the fraction of total memory T cells (the true denominator or the response) varies from 45%/75% (CD4/CD8) in the blood to 100%/100% in lung. Thus, the response frequencies within the CD4+ and CD8+ memory subsets are as follows: CD4 response to whole CMV (blood/spleen/lung)=0.56%/4.943%/17.4%; CD8 response to pp65A (blood/spleen/lung)=1.45%/1.69%/3.13%.
Figure 6:
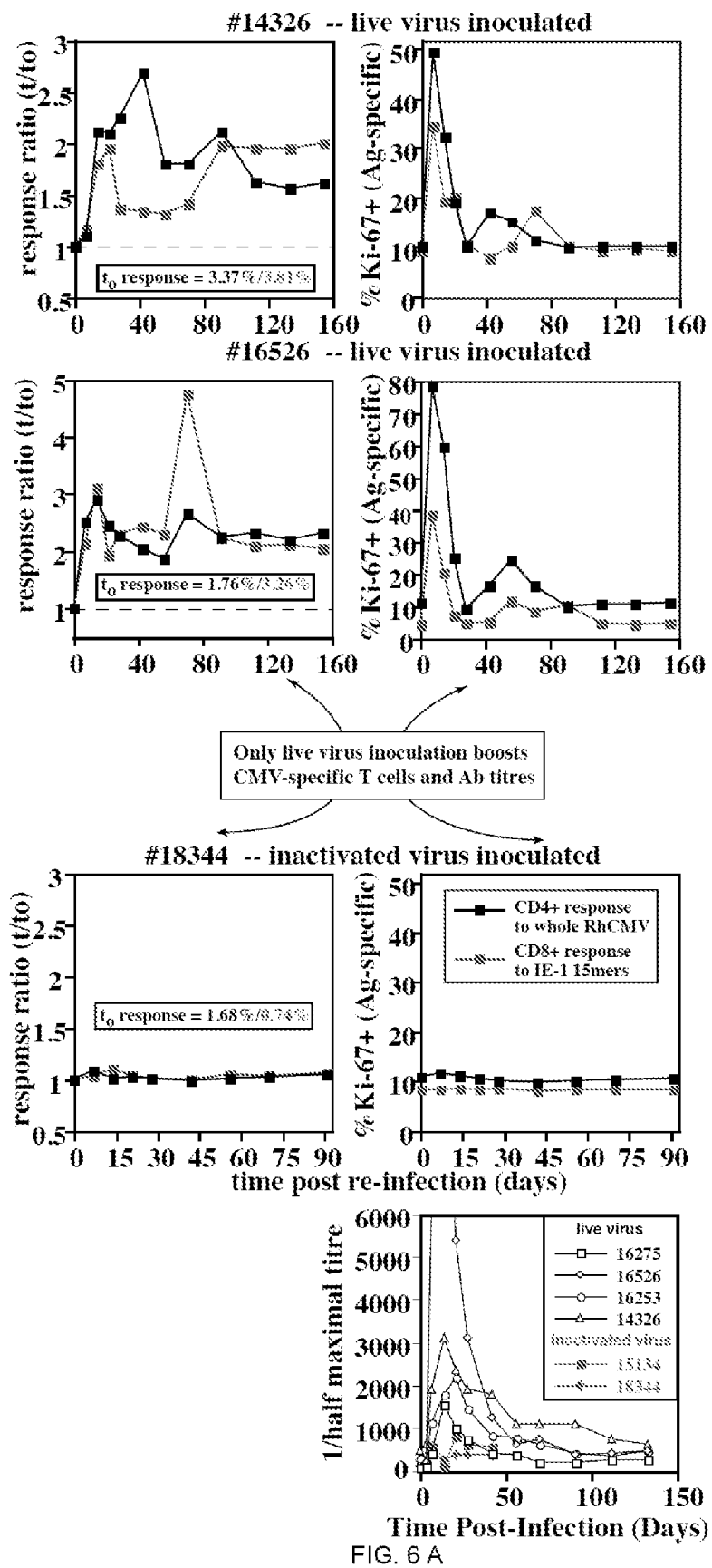
FIG. 6 is a series of graphs showing immunologic evidence of RhCMV re-infection, and depicts CMV-specific $CD4^+$ and $CD8^+$ T cell frequencies/proliferative status in blood and plasma antibody titers after re-infection.
Figure 6:
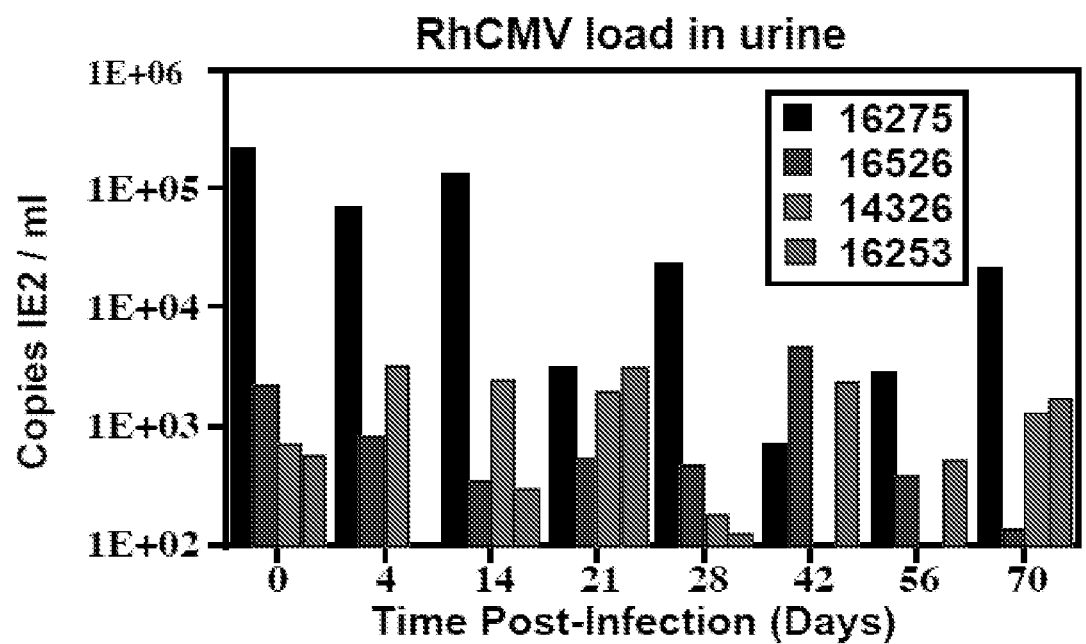

The homology between HCMV and RhCMV infections extends to their respective immune responses as well. As shown below and in FIGS. 3 and 4, the RM T cell response to RhCMV in peripheral blood is similar to that in the human in both size and the CMV ORFs targeted. Moreover, the increased accessibility of the RM model has allowed investigation on the frequencies of these RhCMV-specific T cells in tissue sites, and the immunologic response to RhCMV re-infection. With regard to the former, as illustrated in FIG. 5, the representation of CMV-specific T cells in the memory repertoire at the pulmonary tissue:air interface can be truly enormous, often more than 10-fold higher than in peripheral blood. With regard to the latter, inoculation of CMV-immune RM with live (but not inactivated) wild-type RhCMV results in a dramatic boosting of CMV-specific T cell (both CD4+ and CD8+) and antibody responses (FIG. 6). The boosted antibody titers appear to return to baseline after about 2 months, but importantly, the peripheral blood frequencies of CMV-specific CD4+ and CD8+ T cells appear to stabilize at levels 50-100% higher than their previous baseline—suggesting periodic re-infections or overt re-activations substantially contribute to the high frequency of RhCMV-specific T cells observed in most adult RM.

Many of the recognized characteristics of CMV make this virus highly attractive as a vaccine vector, such as a vaccine vector for an infectious agent or cancer. First, CMV's capability to elicit strong antibody responses and robust T cell responses focused on mucosal sites (FIGS. 3-5) is of relevance to host defense (particularly for SIV/HIV). It is believed by the Applicants that these strong responses reflect a steady state situation, maintained indefinitely, rather than the post-boost peak responses that are often highlighted in prior art vaccine studies.

Figure 7:
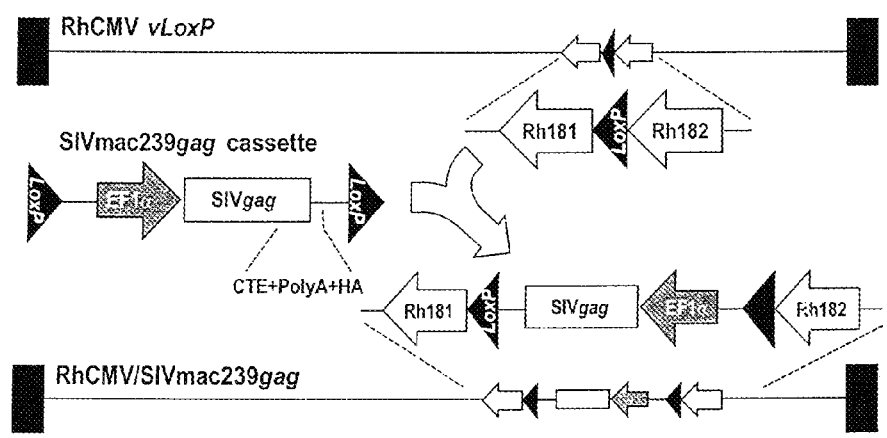
FIG. 7 is a schematic illustration of Cre/LoxP-based recombination for construction of RhCMVvLoxP-based RhCMV/SIVmac239gag recombinants.
Figure 8:
FIG. 8 is an image of an immunoblot demonstrating RhCMV/SIVgag re-infection of RhCMV-seropositive RMs.

Second, CMV has the ability to re-infect immune hosts, and generate new immune responses with such re-infections. To confirm this phenomenon directly with RhCMV, a particular RhCMV vector was constructed that encodes SIV gag (FIG. 7). This vector showed clear-cut gag expression by both immunofluorescence and western blot (FIG. 8), and demonstrated in vitro growth kinetics indistinguishable from that of wild-type virus. When subcutaneously administered (5×10$^6$ PFU) to 4 RhCMV seropositive RM (224 days after primary infection), a similar (clinically asymptomatic) boosting of the RhCMV-specific T cell and antibody response as described in FIG. 6 was observed. As previously observed in re-infection (FIG. 6), real-time PCR did not identify RhCMV, either wild-type or the gag-recombinant, in blood or lung lavage mononuclear cells at any time point following viral inoculation. However, urine from day 127 post re-infection was weakly positive for gag expression by ELISA, suggesting the presence of the RhCMV-gag vector. These samples were co-cultured to isolate RhCMV, and these in vivo-derived viral preparations were assessed for gag expression by western blot. As shown in FIG. 8, RhCMV co-cultures from all 4 animals expressed immunoreactive gag, definitively establishing the presence of the administered recombinant virus in secretory sites. Retrospective analysis of urine at earlier post-re-infection time points revealed the presence of the gag-expressing RhCMV vector by day 7 in one RM and by day 21 in the other 3. Moreover, the gag-expressing RhCMV vector has also been detected in saliva, and remains present in urine at least through day 237 post re-infection.

These data have two critical implications. First, they unequivocally demonstrate that CMV is capable of re-infecting immune subjects, effectively competing with pre-existent wild-type virus, and somehow finding its way to its usual 'ecological' niche despite strongly boosted cellular and humoral immunity directed at CMV. Second, they demonstrate the in vivo stability of RhCMV vectors expressing exogenous neoAgs, indicating that these vectors are able to persistently infect inoculated subjects, and indefinitely maintain expression of the inserted, exogenous antigen-encoding genes.

This RhCMV-gag re-infected cohort was also used to assess the ability of RhCMV vectors to initiate a de novo immune response in the face of the massive CMV-specific memory boost associated with re-infection.

Figure 9:
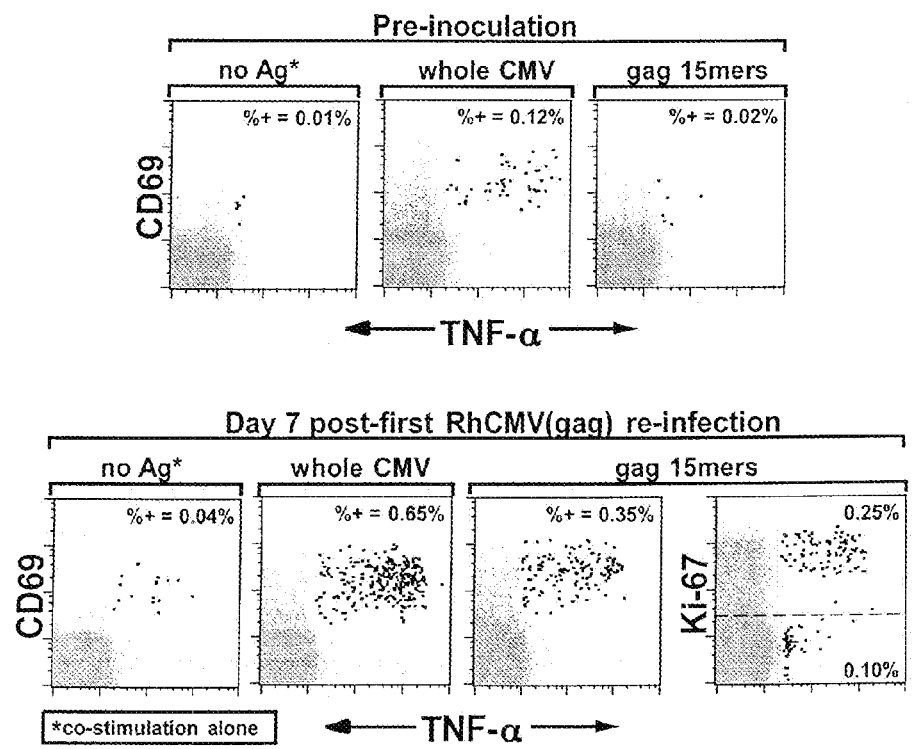
FIG. 9 is a series of FACS plots showing rapid appearance of gag-specific CD4+ T cells in blood after a single inoculation of CMV seropositive RM (#19997) with a first generation RhCMV(gag) vector.
Figure 10:
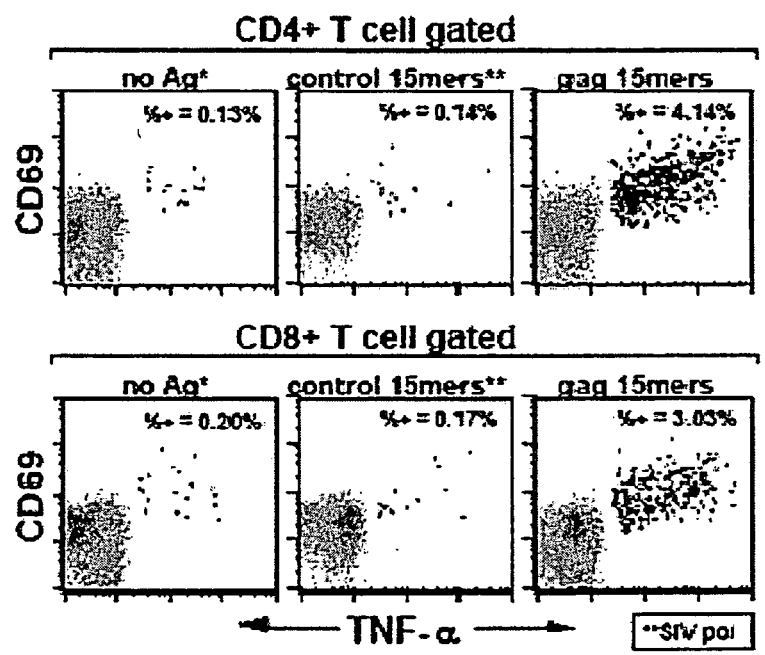
FIG. 10 is a series of FACS plots showing preferential localization of gag-specific T cells in lung after RhCMV(gag) re-infection (#21046; day 56, re-infection #1).
Figure 11:
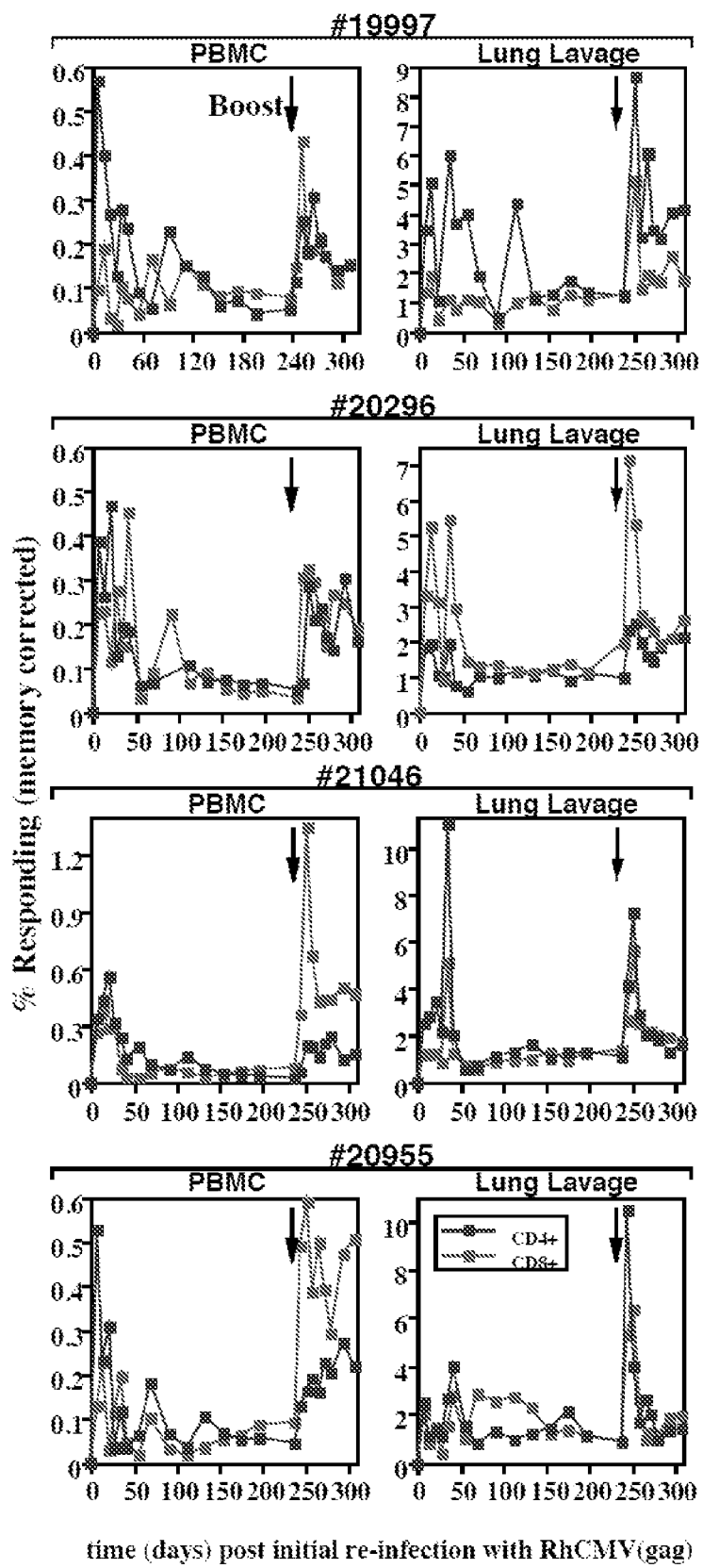
FIG. 11 is a series of graphs showing the development of gag-specific T cells with RhCMV(gag) re-infection (×2).
Figure 12:
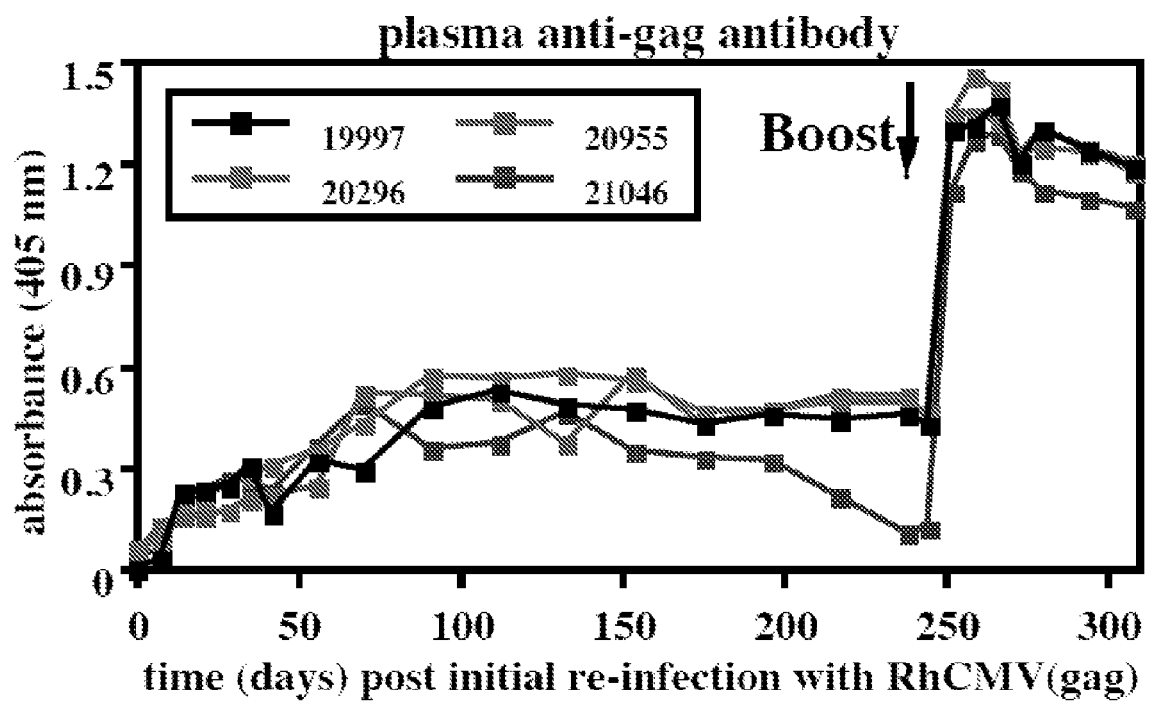
FIG. 12 is a graph showing development of anti-gag antibodies over time after initial re-infection.
Figure 13:
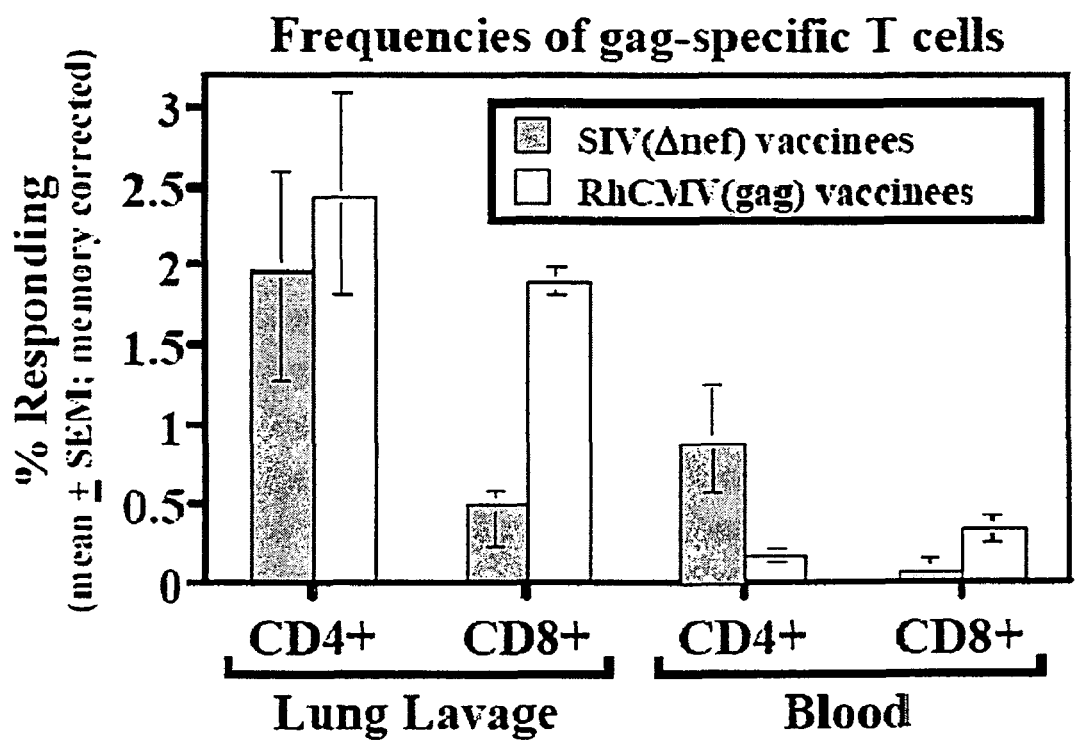
FIG. 13 is a graph showing a comparison of gag-specific T cell frequencies in SIV(Δnef) and RhCMV(gag)-immunized RM. In both groups, both $CD4^+$ and $CD8^+$ gag-specific T cell responses were higher in lung as compared to blood, even through the percentages in blood were memory corrected.
Figure 14:
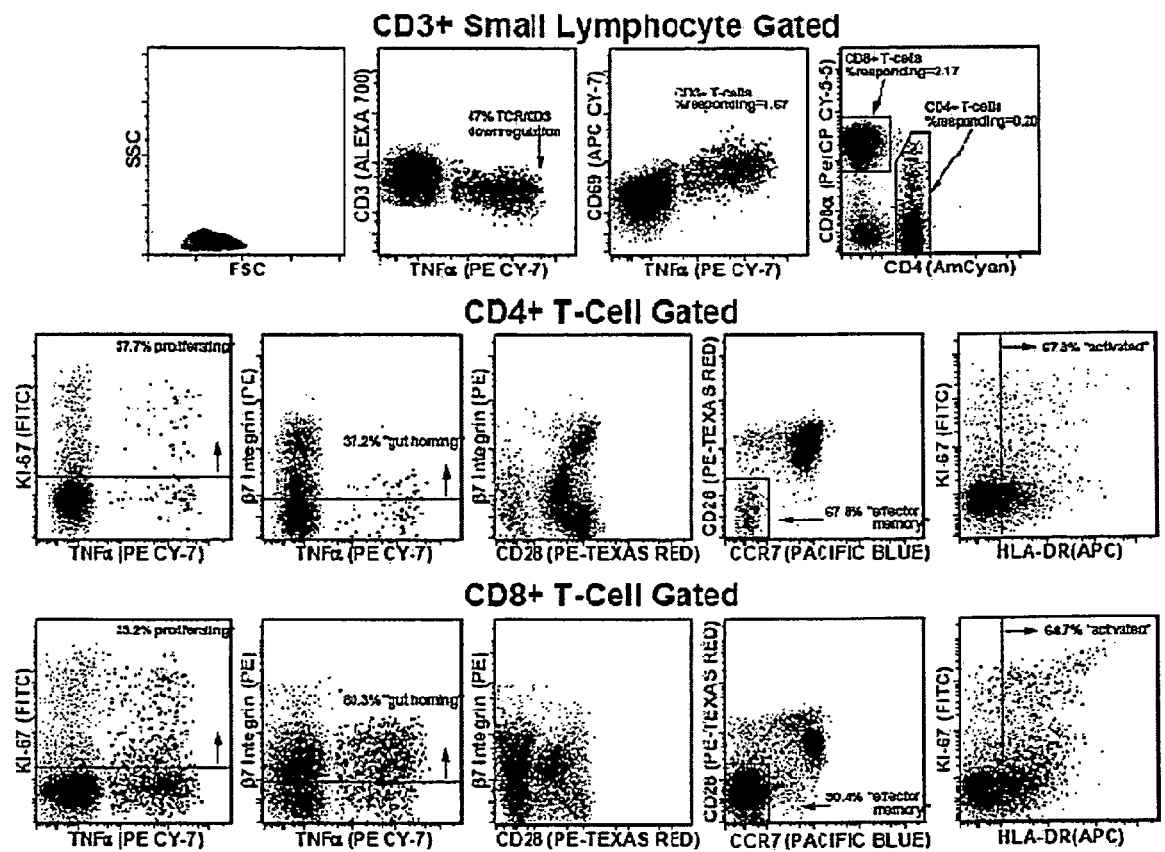
FIG. 14 is a series of FACS plots providing quantification and characterization of a young adult RM peripheral blood $CD4^+$ and $CD8^+$ T cell responses to RhCMV IE-1 15mer mix by 10 color cytokine flow cytometry.

As shown in FIGS. 9 and 10, all inoculated RM developed gag-specific CD4+ and CD8+ T cell responses in blood, as early as day 7 post re-infection. These blood responses peaked in the first month following re-infection at 0.2%-0.6% of memory cells, declining thereafter to a stable plateau in the 0.1%-0.2% range. SIV gag-specific antibodies were also induced by day 14 post-infection, increasing through day 91 post-infection, prior to achieving a stable plateau (FIG. 12). Re-administration of the same RhCMV-gag vector (at day 238 post re-infection) dramatically boosted both examined, these responses remained higher than the previous 'set points,' suggesting establishment of higher plateau levels. Significantly, as previously shown for RhCMV-specific T cell responses, blood frequencies of these CMV-vectored gag-specific T cell responses substantially (>10×) underestimated the frequency of SW-specific T cells in a tissue effector site—the lung (FIGS. 10 and 11). Gag-specific CD4+ and CD8+T cells were found in lung lavage fluid by day 7 post the initial RhCMV(gag) re-infection in all RM, peaking with frequencies as high as 10% (day 42-56 post re-infection) before achieving stable plateau levels in the 1%-3% range. Boosting (second re-infection) resulted in a sharp spike in these frequencies with return to the previous plateau level in 2 RM, and what appear to be (at day 70 post re-infection #2) slightly higher plateau levels in the other 2 animals. Significantly, the frequency and distribution of gag-specific T cells in these RhCMV(gag)-immunized RM are comparable to what was observed in RM 'immunized' with attenuated SIVmac239 (Δnef) that effectively controlled I. V. challenge with wild-type SIVmac239 (FIG. 13). It should also be noted that in all of the RMs studied, the observed gag-specific responses occurred in the setting of significant boosting of the RhCMV-specific responses (FIG. 9); indeed, it is possible these recall CMV-specific responses acted as an adjuvant for the new gag-specific response. Significantly, these data demonstrate the ability of RhCMV to function effectively as a vector for neoAgs in RhCMV-immune RM.

According to particular aspects of the present disclosure, the unique ability of CMV to effectively 'vector' neoAg responses in CMV-immune subjects has several highly significant implications for their utility in a vaccine. First, by virtue of the fact that any healthy CMV+ subjects have operationally demonstrated their ability to control wild-type CMV infection, their risk of morbidity after administration of CMV vectors, even vectors based on an otherwise unmodified CMV genome, would be expected to be minimal. Although fetuses of CMV+ mothers can in some circumstances be infected, this risk can be averted by simply not providing CMV-based vaccines to pregnant females. Incorporation of safety (e.g., inducible suicide) mechanisms and/or strategic gene deletion (so as to reduce pathogenic potential without sacrificing immunogenicity and persistence) would be expected to reduce the possibility of vaccine morbidity even further. It should also be noted that other well-studied herpesviruses that could potentially be used as persistent and perhaps re-infection capable vectors have one or more features that mitigate against such use. For example, the γ-herpesviruses Epstein Barr Virus (EBV) and Kaposi's Sarcoma Herpes Virus (KSHV) are firmly associated with malignancies, whereas CMV is not. Additionally, α herpesviruses (herpes simplex) lack the generalized T cell immunogenicity of CMV and because of neurovirulence (e.g., herpes encephalitis) would appear to have considerable more pathogenic potential in otherwise immunocompetent individuals.

The second implication of CMV's re-infection capability and the demonstration herein that a subsequent inoculation with the same RhCMV vector elicits a strong immunologic boost to the recombinant (SIV) gene product (FIG. 11) is that, unlike essentially all other viral vectors currently in use or in development, CMV vectors can likely be used repeatedly. Indeed, according to particular embodiments of the present disclosure, individuals are serially vaccinated with different CMV vectors so as to generate responses to new epitopes.

In one embodiment herein, it is disclosed that a CMV-driven, anti-HIV/SIV immune response (e.g., in place at the time of HIV/SIV exposure) is sufficient to contain viral replication, blunt the initial viral diaspora, prevent immunopathogenicity, and establish a non-progressive infection. Aspects of the present disclosure co-opt CMV's eons of evolution, and provide strategically engineered and optimized CMV as a heterologous ORF-encoding vaccine vector. CMV's combination of 1) remarkable immunogenicity, 2) low pathogenicity, 3) persistence, 4) widespread tissue dissemination, and 5) the ability to re-infect CMV+ hosts is substantially and fundamentally different from other vaccine vectors in development. Indeed, the issue of persistence, by itself, makes this approach substantially worthy. According to particular aspects, long-term antigen exposure, as is possible with the disclosed CMV-based vaccine vectors, correlates with a qualitatively different and functionally superior anti-lentiviral immune response.

For safety considerations, CMV vectors, with all their unique potential, must be handled appropriately. Therefore, in some embodiments, the CMV-based vaccination vectors are used to elicit neoAg immunity in CMV+ hosts, who have—by their healthy, CMV+ status—established their ability to contain this virus. Although no live virus vector is without risk, in the appropriate setting (such as in the context of demonstrably immunocompetent, CMV+ pre-adolescents), the risk of serious CMV vector pathogenicity, even with non-safety modified vectors, should be minimal. According to further aspects of the present disclosure, even the relatively low disease-inducing potential of wild-type CMV is abrogatable by genetic manipulation of the CMV vector without sacrificing immunogenicity or persistence.

According to aspects of the present disclosure, CMV vectors, alone or in combination with other modalities, provide qualitatively superior cellular and humoral immune responses against infectious disease, such that such challenges are significantly contained. Additional aspects provide safe vectors without sacrificing the unique persistence and re-infection capabilities. According to yet further aspects, various CMV genes are deletable without sacrificing vector function, and particular exemplary vectors use the genomic 'space' created by such deletions for insertion of safety constructs (e.g., inducible suicide mechanisms) as well as larger (poly-cistronic) gene encoding cassettes. This gene deletion approach is designed to retain the balance between immunogenicity/persistence and pathogenicity, and exploits the redundancy of CMV's adaptations in providing engineered RhCMV optimized vectors.

In some embodiments, RhCMV vectors are designed to reflect genes and biology that are homologous to HCMV, and optimized RhCMV vector designs are directly applicable to construction of HCMV vector embodiments.

In some embodiments, the CMV vectors disclosed herein encode a heterologous antigen. The heterologous antigen is an antigenic polypeptide encoded by a heterologous polynucleotide that is incorporated into the recombinant CMV vector. In particular examples, the antigenic polypeptide is derived from a bacterium, fungus, protozoan, virus or tumor. The polypeptide can be anything that is beneficially used as an antigen to stimulate an immune response, though it is contemplated that the benefit of provoking a long-term immune response against a particular antigen will influence its selection.

The antigenic polypeptide sequence may be any length sufficient to elicit the immune response. In particular examples, the polypeptide is at least 8, at least 10, at least 20, at least 30, at least 40, at least 50 amino acids long or greater. Likewise, the sequence identity of the antigenic polypeptide need not be identical to the sequence identity to the native polypeptide in order to be sufficient to maintain specificity of the immune response against the bacterium, protozoan, fungus, virus or tumor. One of skill in art will recognize that the sequence of a polypeptide may be significantly altered while maintaining its antigenic specificity—that is, the ability to stimulate an antigenic response that will still provide responsiveness to the native protein. Thus, in particular examples, the antigenic polypeptide is at least 50%, at least 60%, at least 70%, at least 80%, at least 90%, at least 95%, or at least 98% identical to the polypeptide from which it was derived. In particular examples, the polypeptide is an analog of the host polypeptide that is found in a different species (xenogeneic).

One of ordinary skill will recognize that the lists of exemplary heterologous polypeptides discussed herein are neither exhaustive nor intended to be limiting. Thus, it will be recognized that the methods provided herein are useful for expression of, and thus immune-stimulation related to, any polypeptide against which it would be beneficial to generate immunity.

In some embodiments, the heterologous antigen is a polypeptide derived from a pathogenic organism such bacteria, fungi, protozoa, or virus.

Examples of pathogenic viruses include, but are not limited to those in the following virus families: Retroviridae (for example, human immunodeficiency virus (HIV), human T-cell leukemia viruses; Picornaviridae (for example, polio virus, hepatitis A virus, hepatitis C virus, enteroviruses, human coxsackie viruses, rhinoviruses, echoviruses, foot-and-mouth disease virus); Caliciviridae (such as strains that cause gastroenteritis, including Norwalk virus); Togaviridae (for example, alphaviruses (including chikungunya virus, equine encephalitis viruses, Simliki Forest virus, Sindbis virus, Ross River virus), rubella viruses); Flaviridae (for example, dengue viruses, yellow fever viruses, West Nile virus, St. Louis encephalitis virus, Japanese encephalitis virus, Powassan virus and other encephalitis viruses); Coronaviridae (for example, coronaviruses, severe acute respiratory syndrome (SARS) virus; Rhabdoviridae (for example, vesicular stomatitis viruses, rabies viruses); Filoviridae (for example, Ebola virus, Marburg virus); Paramyxoviridae (for example, parainfluenza viruses, mumps virus, measles virus, respiratory syncytial virus); Orthomyxoviridae (for example, influenza viruses); Bunyaviridae (for example, Hantaan viruses, Sin Nombre virus, Rift Valley fever virus, bunya viruses, phleboviruses and Nairo viruses); Arenaviridae (such as Lassa fever virus and other hemorrhagic fever viruses, Machupo virus, Junin virus); Reoviridae (e.g., reoviruses, orbiviurses, rotaviruses); Birnaviridae; Hepadnaviridae (hepatitis B virus); Parvoviridae (parvoviruses); Papovaviridae (papilloma viruses, polyoma viruses, BK-virus); Adenoviridae (adenoviruses); Herpesviridae (herpes simplex virus (HSV)-1 and HSV-2; cytomegalovirus; Epstein-Barr virus; varicella zoster virus; and other herpes viruses, including HSV-6); Poxyiridae (variola viruses, vaccinia viruses, pox viruses); and Iridoviridae (such as African swine fever virus); Astroviridae; and unclassified viruses (for example, the etiological agents of spongiform encephalopathies, the agent of delta hepatitis (thought to be a defective satellite of hepatitis B virus).

Examples of bacterial pathogens include, but are not limited to: *Helicobacter pylori, Escherichia coli, Vibrio chol-*

*erae, Borelia burgdorferi, Legionella pneumophilia, Mycobacteria* sps (such as. *M. tuberculosis, M. avium, M. intracellulare, M. kansaii, M. gordonae*), *Staphylococcus aureus, Neisseria gonorrhoeae, Neisseria meningitidis, Listeria monocytogenes, Streptococcus pyogenes* (Group A *Streptococcus*), *Streptococcus agalactiae* (Group B *Streptococcus*), *Streptococcus* (viridans group), *Streptococcus faecalis, Streptococcus bovis, Streptococcus* (anaerobic sps.), *Streptococcus pneumoniae*, pathogenic *Campylobacter* sp., *Enterococcus* sp., *Haemophilus influenzae, Bacillus anthracis, corynebacterium diphtheriae, corynebacterium* sp., *Erysipelothrix rhusiopathiae, Clostridium perfringers, Clostridium tetani, Enterobacter aerogenes, Klebsiella pneumoniae, Pasturella multocida, Bacteroides* sp., *Fusobacterium nucleatum, Streptobacillus moniliformis, Treponema pallidium, Treponema pertenue, Leptospira, Bordetella pertussis, Shigella flexnerii, Shigella dysenteriae* and *Actinomyces israelli*.

Examples of fungal pathogens include, but are not limited to: *Cryptococcus neoformans, Histoplasma capsulatum, Coccidioides immitis, Blastomyces dermatitidis, Chlamydia trachomatis, Candida albicans*.

Other pathogens (such as parasitic pathogens) include, but are not limited to: *Plasmodium falciparum, Plasmodium vivax, Trypanosoma cruzi* and *Toxoplasma gondii*.

Immunogenic proteins encoded by pathogenic microorganisms are well known and/or can be determined by those of skill in the art. Thus, the specific antigen encoded by the recombinant CMV vector can be any protein or fragment thereof (such as an epitope or antigenic fragment thereof) that is specifically expressed by the pathogen and is capable of eliciting an immune response in a subject.

In some embodiments, the recombinant CMV vector encodes an antigen from a virus. The viruses may include but are not limited to Influenza virus, West nile virus, Poliovirus, SIV, HIV, HCMV, Kaposi's sarcoma associated herpesvirus, Ebola virus, Chikungunya virus, Dengue virus, Monkeypox virus, varcella zoster virus, Epstein-barr virus, Herpes simplex 1 virus and Herpes simplex 2 virus. In particular embodiments disclosed herein, the recombinant CMV vector encodes an antigen from influenza virus. In some examples, the influenza virus antigen is hemagglutinin (HA) or neuraminidase, or an epitope or antigenic fragment thereof. In other embodiments, the recombinant CMV vector encodes an antigen from monkeypox virus. In some examples, the monkeypox virus antigen is A35R, or an epitope or antigenic fragment thereof. In other embodiments, the recombinant CMV vector encodes an antigen from West Nile virus. In some examples, the West Nile virus antigen is capsid (C), membrane (prM/M), envelope (E), NS1, NS2A, NS2B, NS3, NS4A, NS4B or NS5, or an epitope or antigenic fragment thereof. In other embodiments, the recombinant CMV vector encodes an antigen from Chikungunya virus. In some examples, the Chikungunya virus antigen is capsid (C), envelope glycoprotein 1 (E1), envelope glycoprotein 2 (E2), envelope glycoprotein 3 (E3) or non-structural protein 1 (NSP1), or an epitope or antigenic fragment thereof. In other embodiments, the recombinant CMV vector encodes an antigen from Ebola virus. In some examples, the Ebola virus antigen is nucleoprotein (NP), or an epitope or antigenic fragment thereof. In other embodiments, the recombinant CMV vector encodes an antigen from HCV. In some examples, the HCV antigen is core, E1, E2, NS2, NS3, NS4 or NS5, or an epitope or antigenic fragment thereof. In other embodiments, the recombinant CMV vector encodes an antigen from poliovirus. In some examples, the poliovirus antigen is VP1, or an epitope or antigenic fragment thereof. In other embodiments, the recombinant CMV vector encodes an antigen from a dengue virus, such as a dengue serotype 1, 2, 3, or 4 virus. In some examples, the dengue virus antigen is capsid (C), membrane (prM/M), envelope (E), NS1, NS2A, NS2B, NS3, NS4A, NS4B or NS5, or an epitope or antigenic fragment thereof.

In some embodiments, the recombinant CMV vector encodes a bacterial antigen. In particular embodiments, the antigen is from *Clostridium tetani*, the causative agent of tetanus. In some examples, the antigen from *Clostridium tetani* is tetanusC, or an epitope or antigenic fragment thereof. TetanusC is a non-toxic fragment of tetanus toxin that is capable of eliciting a protective immune response to tetanus toxin.

In some embodiments, the recombinant CMV vector encodes a fungal antigen.

In some embodiments, the recombinant CMV vector encodes a protozoan antigen. In particular embodiments, the protozoan antigen is an antigen from *Plasmodium falciparum, Plasmodium vivax, Plasmodium ovale* or *Plasmodium malariae*, each of which can cause malaria (with *Plasmodium falciparum* being the most common causative agent for malaria). In some examples, the *Plasmodium* antigen is a pre-erythrocytic antigen, such as CSP or SSP2, or an epitope or antigenic fragment thereof. In other examples, the *Plasmodium* antigen is an erythrocytic antigen, such as AMA1 or MSP1, or an epitope or antigenic fragment thereof.

In other embodiments, the heterologous polynucleotide carried by the recombinant CMV vector encodes a polypeptide derived from a tumor. The tumor may be the result of any type of cellular proliferative disease or condition, and may be benign or malignant. In particular examples, the tumor is cancerous. Such tumors can be of any type of cancer including, but not limited to: leukemias, including acute leukemias (such as acute lymphocytic leukemia, acute myelocytic leukemia, acute myelogenous leukemia and myeloblastic, promyelocytic, myelomonocytic, monocytic and erythroleukemia), chronic leukemias (such as chronic myelogenous leukemia, and chronic lymphocytic leukemia), myelodysplastic syndrome, and myelodysplasia, polycythemia vera, lymphoma, (such as Hodgkin's disease, all forms of non-Hodgkin's lymphoma), multiple myeloma, Waldenstrom's macroglobulinemia, and heavy chain disease. Examples of solid tumors, such as sarcomas and carcinomas, include, but are not limited to: fibrosarcoma, myxosarcoma, liposarcoma, chondrosarcoma, osteogenic sarcoma, and other sarcomas, synovioma, mesothelioma, Ewing's tumor, leiomyosarcoma, rhabdomyosarcoma, colon carcinoma, pancreatic cancer, breast cancer, lung cancer, ovarian cancer, prostate cancer, hepatocellular carcinoma, squamous cell carcinoma, basal cell carcinoma, adenocarcinoma, sweat gland carcinoma, sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, bladder carcinoma, melanoma, and CNS tumors (such as a glioma, astrocytoma, medulloblastoma, craniopharyogioma, ependymoma, pinealoma, hemangioblastoma, acoustic neuroma, oligodendroglioma, menangioma, meningioma, neuroblastoma and retinoblastoma).

Antigenic tumor-derived polypeptides that may be encoded by the heterologous polynucleotide of the described compositions and methods encompass polypeptides also known as tumor associated antigens (TAAs), and peptides derived therefrom. Many TAAs have been identified. These include, but are not limited to: human telomerase reverse transcriptase (hTERT), survivin, MAGE-1, MAGE-3, human chorionic gonadotropin, carcinoembryonic antigen, alpha fetoprotein, pancreatic oncofetal antigen, MUC-1, CA 125, CA 15-3, CA 19-9, CA 549, CA 195, prostate-specific membrane antigen, Her2/neu, gp-100, trp-2, mutant K-ras proteins, mutant p53, truncated epidermal growth factor receptor, chimeric protein $p^{210}$BCR-ABL; E7 protein of human papilloma virus, EBNA3 protein of Epstein-Barr virus, carcinoembryonic antigen (CEA), β-human chorionic gonadotropin, alphafetoprotein (AFP), lectin-reactive AFP, thyroglobulin, RAGE-1, MN-CA IX, RU1, RU2 (AS), intestinal carboxyl esterase, mut hsp70-2, M-CSF, prostase, prostate-specific antigen (PSA), PAP, NY-ESO-1, LAGE-1a, p53, prostein, PSMA, telomerase, prostate-carcinoma tumor antigen-1 (PCTA-1), ELF2M, neutrophil elastase, ephrinB2, CD22, insulin growth factor (IGF)-I, IGF-II, IGF-I receptor and mesothelin (some of these TAAs as well as others are described in Novellino et al., *Cancer Immunology and Immunotherapy*, 54:187-207, 2005).

A list of exemplary tumor antigens and their associated tumors are shown below in Table 2.

TABLE 2

Exemplary tumors and their tumor antigens

| Tumor | Tumor Associated Antigens |
|---|---|
| Acute myelogenous leukemia | Wilms tumor 1 (WT1), preferentially expressed antigen of melanoma (PRAME), PR1, proteinase 3, elastase, cathepsin G |
| Chronic myelogenous leukemia | WT1, PRAME, PR1, proteinase 3, elastase, cathepsin G |
| Myelodysplastic syndrome | WT1, PRAME, PR1, proteinase 3, elastase, cathepsin G |
| Acute lymphoblastic leukemia | PRAME |
| Chronic lymphocytic leukemia | Survivin |
| Non-Hodgkin's lymphoma | Survivin |
| Multiple myeloma | NY-ESO-1 |
| Malignant melanoma | MAGE, MART, Tyrosinase, PRAME GP100 |
| Breast cancer | WT1, herceptin, epithelial tumor antigen (ETA) |
| Lung cancer | WT1 |
| Ovarian cancer | CA-125 |
| Prostate cancer | PSA |
| Pancreatic cancer | CA19-9, RCAS1 |
| Colon cancer | CEA |
| Renal cell carcinoma (RCC) | Fibroblast growth factor 5 |
| Germ cell tumors | AFP |

Successful tumor immunotherapy is hampered by the poor immunogenicity of tumor epitopes and the fact that the immune system often responds to them by immune tolerance rather than by initiating a potent effector response. An ideal immunotherapeutic tumor vaccine would elicit an immune response that is (a) robust, (b) effective, (c) resistant to the development of immune tolerance, (d) long-lived, and (e) after initial tumor control, effective at the task of immune surveillance against recurrences and metastases. The robust, life-long immune response elicited by CMV infection, and the ability of CMV to overcome self-tolerance, suggest that CMV may be an ideal vaccine vector for tumor immunotherapy.

Recombinant CMV vectors encoding a tumor antigen, and compositions thereof, may be administered singly, or administered in combination with one or more pharmaceutically active compounds. For example, the compounds may be co-administered with other anti-cancer compounds such as alkylating agents, antimetabolites, natural products, hormones and their antagonists, other miscellaneous agents, or any combination of these. Additional anti-cancer agents can be administered prior to, at the same time, or following administration of the recombinant CMV vector.

Examples of alkylating agents include nitrogen mustards (such as mechlorethamine, cyclophosphamide, melphalan, uracil mustard or chlorambucil), alkyl sulfonates (such as busulfan), nitrosoureas (such as carmustine, lomustine, semustine, streptozocin, or dacarbazine). Examples of antimetabolites include folic acid analogs (such as methotrexate), pyrimidine analogs (such as 5-FU or cytarabine), and purine analogs, such as mercaptopurine or thioguanine Examples of natural products include vinca alkaloids (such as vinblastine, vincristine, or vindesine), epipodophyllotoxins (such as etoposide or teniposide), antibiotics (such as dactinomycin, daunorubicin, doxorubicin, bleomycin, plicamycin, or mitomycin C), and enzymes (such as L-asparaginase). Examples of miscellaneous agents include platinum coordination complexes (such as cis-diamine-dichloroplatinum II also known as cisplatin), substituted ureas (such as hydroxyurea), methyl hydrazine derivatives (such as procarbazine), and adrenocortical suppressants (such as mitotane and aminoglutethimide).

Examples of hormones and antagonists include adrenocorticosteroids (such as prednisone), progestins (such as hydroxyprogesterone caproate, medroxyprogesterone acetate, and magestrol acetate), estrogens (such as diethylstilbestrol and ethinyl estradiol), antiestrogens (such as tamoxifen), and androgens (such as testerone proprionate and fluoxymesterone). Examples of the most commonly used chemotherapy drugs include Adriamycin, Alkeran, Ara-C, BiCNU, Busulfan, CCNU, Carboplatinum, Cisplatinum, Cytoxan, Daunorubicin, DTIC, 5-FU, Fludarabine, Hydrea, Idarubicin, Ifosfamide, Methotrexate, Mithramycin, Mitomycin, Mitoxantrone, Nitrogen Mustard, Taxol (or other taxanes, such as docetaxel), Velban, Vincristine, VP-16, while some more newer drugs include Gemcitabine (Gemzar), Herceptin, Irinotecan (Camptosar, CPT-11), Leustatin, Navelbine, Rituxan STI-571, Taxotere, Topotecan (Hycamtin), Xeloda (Capecitabine), Zevelin and calcitriol. Non-limiting examples of immunomodulators that can be used include AS-101 (Wyeth-Ayerst Labs.), bropirimine (Upjohn), gamma interferon (Genentech), GM-CSF (granulocyte macrophage colony stimulating factor; Genetics Institute), IL-2 (Cetus or Hoffman-LaRoche), human immune globulin (Cutter Biological), IMREG (from Imreg of New Orleans, La.), SK&F 106528, and TNF (tumor necrosis factor; Genentech).

For the treatment of cancer, administration of a recombinant CMV vector encoding a tumor antigen may be preceded by, or followed by, one or more additional therapies to treat the cancer, such as surgical resection of the tumor or radiation therapy.

Also disclosed herein are recombinant CMV vectors, such as RhCMV and HCMV vectors, having a deletion in one or more genes that are essential for or augment CMV replication, dissemination or spreading. Thus, these vectors are referred to as "replication-deficient" CMV vectors. As used herein, "replication-deficient" encompasses CMV vectors that are unable to undergo any replication in a host cell, or have a significantly reduced ability to undergo viral replication. In some examples, the replication-deficient CMV vectors are able to replicate, but are unable to disseminate since they are incapable of infection neighboring cells. In some examples, the replication-deficient CMV vectors are able to replicate, but are unable to spread since they are not secreted from infected hosts.

CMV essential and augmenting genes are well known in the art (see, for example, Dunn et al., *Proc. Natl. Acad. Sci. USA* 100(24):14223-14228, 2003; and Dong et al., *Proc. Natl. Acad. Sci. USA* 100(21):12396-12401, 2003), and are described herein. In some embodiments, the recombinant RhCMV or HCMV vector includes a deletion in one gene that is essential for or augments virus replication, dissemination or spreading. In other embodiments, the recombinant RhCMV or HCMV vector includes a deletion in multiple (such as, but not limited to, two, three or four) genes essential for or augmenting CMV replication, dissemination or spreading. The deletion need not be a deletion of the entire open reading frame of the gene, but includes any deletion that eliminates expression of functional protein.

Figure 36:
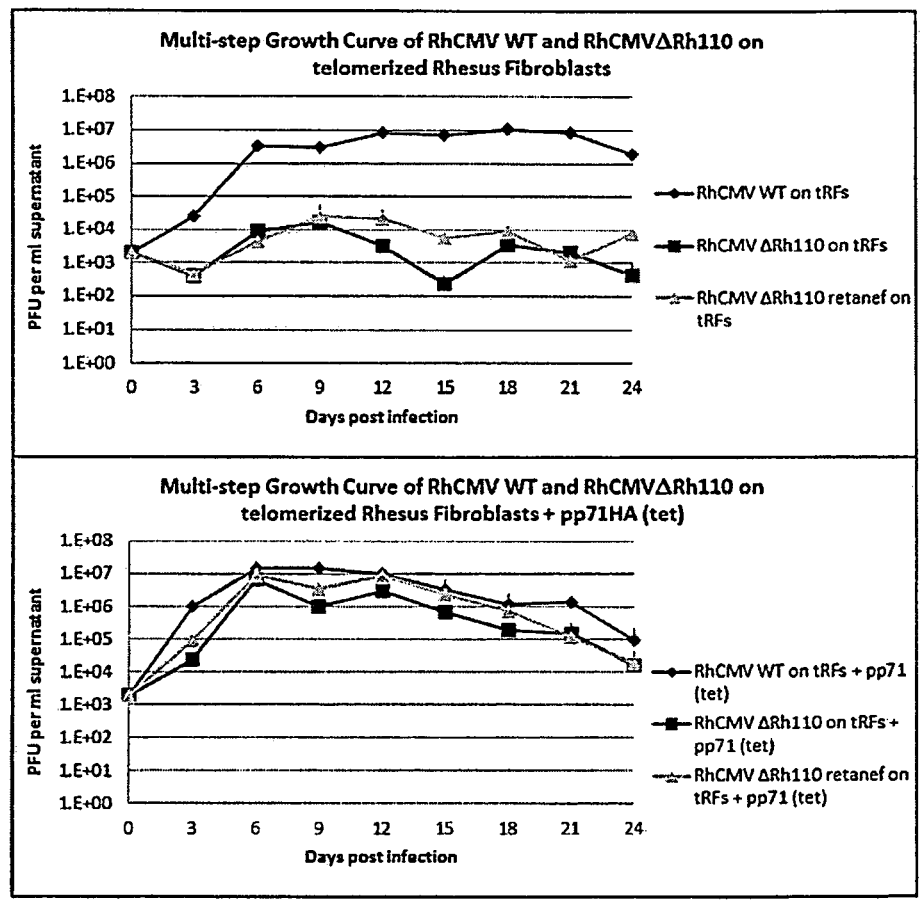
FIG. 36 is a pair of graphs showing that the deletion of pp71 impairs viral release from normal fibroblasts, but not from fibroblasts expressing pp71.
Figure 37:
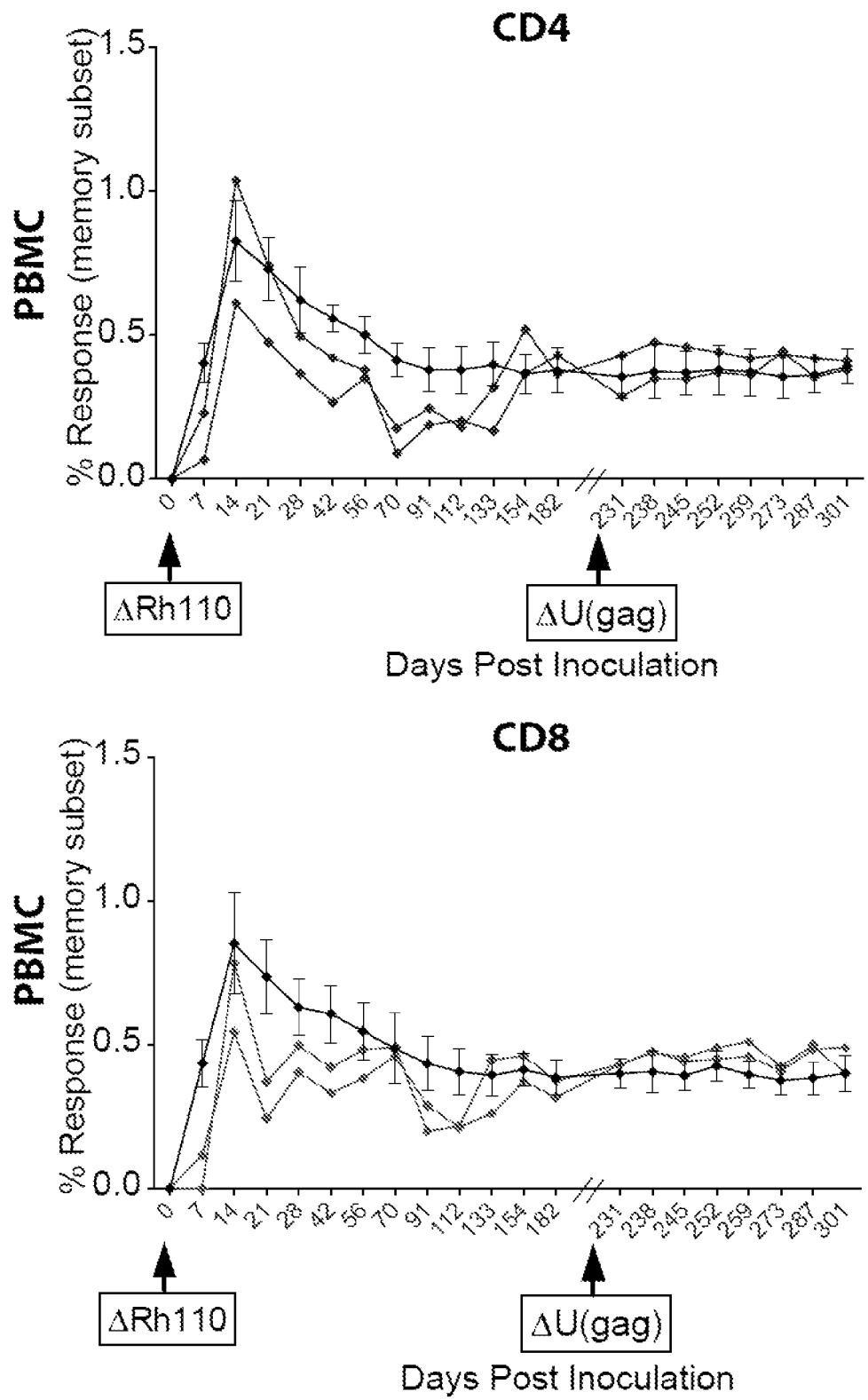
FIG. 37 shows the deletion of pp71 attenuates CMV-vectors in vivo but does not impair their ability to induce a longlasting immune response comparable to wildtype virus.
Figure 37:
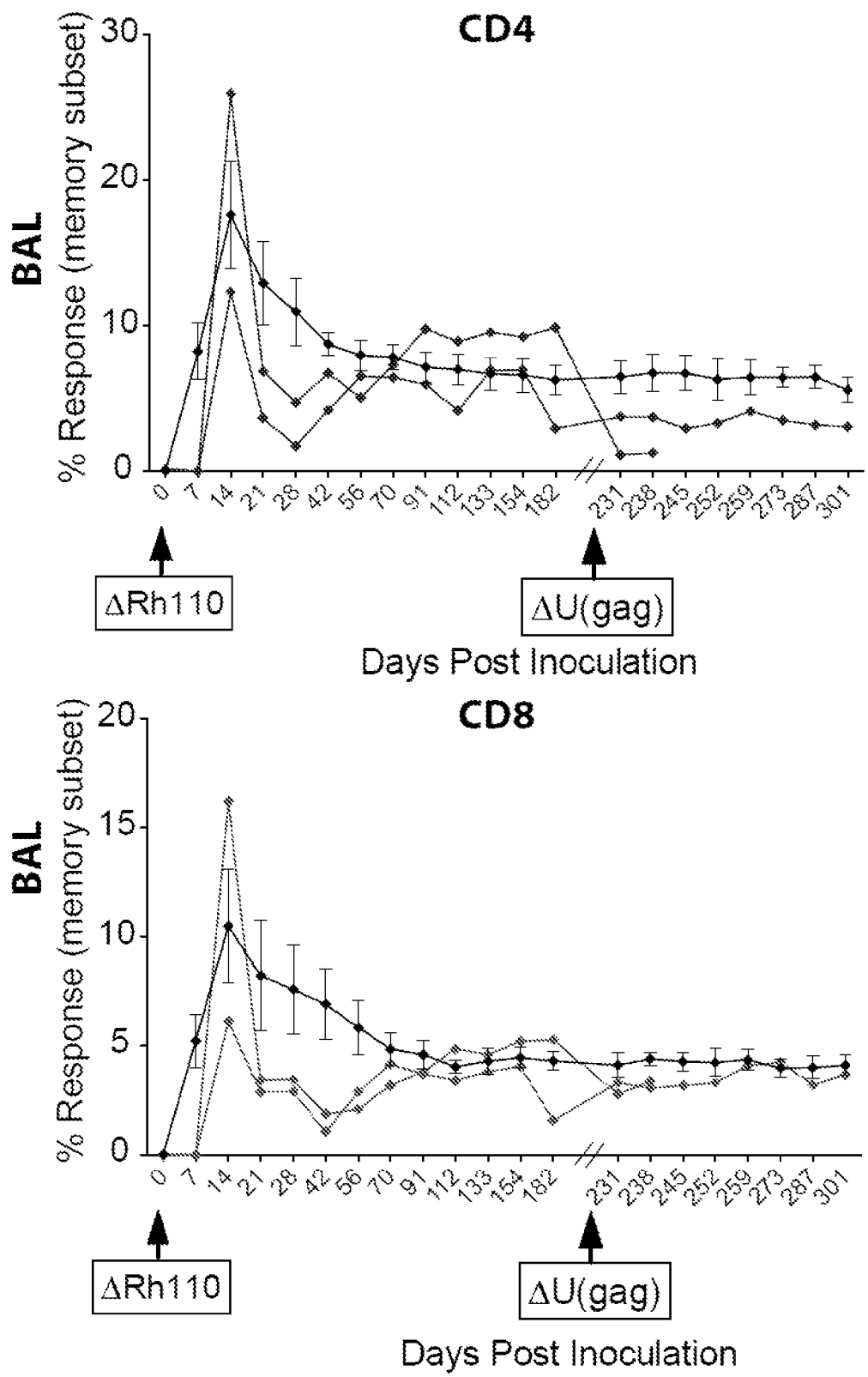
Figure 37C:
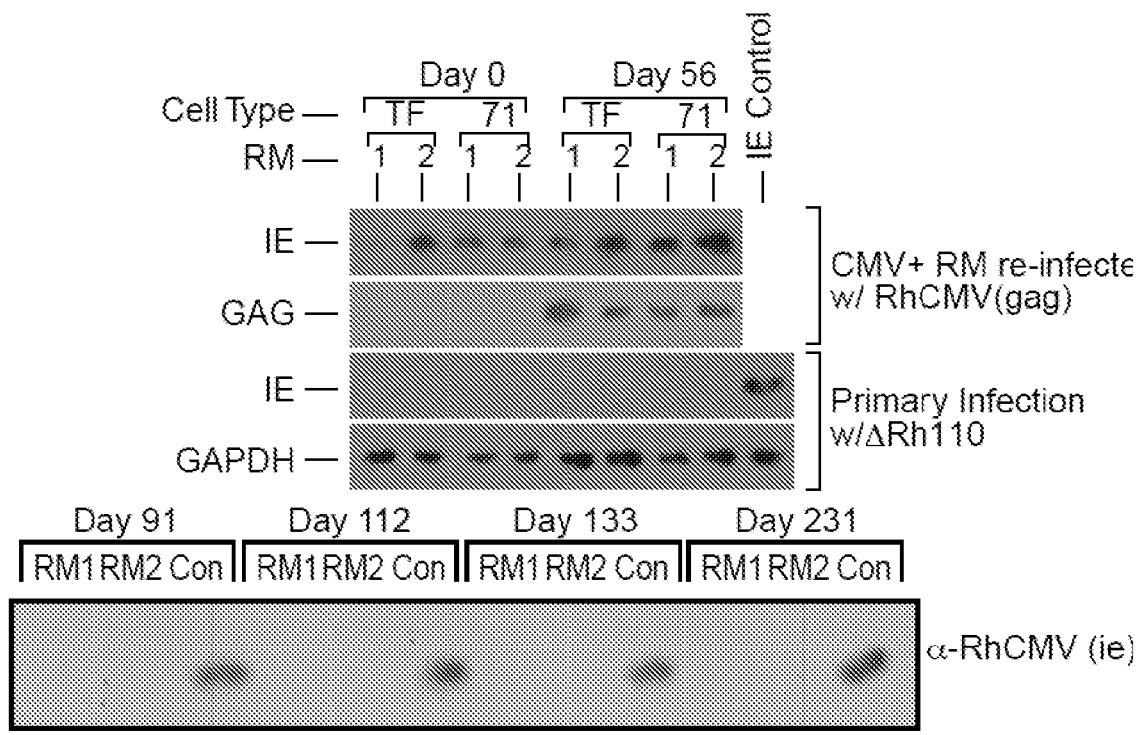

In some embodiments, the recombinant RhCMV or HCMV vector includes a deletion in one or more genes selected from UL82 (encoding pp71) (see FIGS. 36-38), UL94 (encoding the UL94 protein), UL32 (encoding pp150), UL99 (encoding pp28), UL115 (encoding gL) and UL44 (encoding p52), or a homolog thereof (i.e., the RhCMV homolog of these HCMV genes).

Replication-deficient RhCMV and HCMV vectors disclosed herein can include a nucleic acid sequence encoding a heterologous antigen, such as a pathogen-specific antigen or a tumor antigen. As disclosed for other recombinant RhCMV and HCMV vectors described herein, replication-deficient RhCMV and HCMV vectors can be used to elicit an immune response in a subject against the encoded heterologous antigen.

A recombinant RhCMV vector having a deletion in gene UL82 (which encodes the pp71 protein) is severely impaired in its ability grow in vitro and to spread in vivo, but still elicits a robust T cell immune response against CMV. Thus, it is contemplated herein to use such a replication-deficient vector as a vaccine against CMV itself (see FIGS. 36-38)

In advantageous embodiments of the present invention, a recombinant CMV vector, such as a RhCMV or a HCMV vector may have deletions in gene regions non-essential for growth in vivo. Such gene regions include, but are not limited to, the RL11 family, the pp65 family, the US12 family and the US28 family. In particular, RhCMV gene regions that may be deleted include gene regions Rh13-Rh29, Rh111-RH112, Rh191-Rh202 and Rh214-Rh220. More particularly, the RhCMV gene regions that may be deleted include Rh13.1, Rh19, Rh20, Rh23, Rh24, Rh112, Rh190, Rh192, Rh196, Rh198, Rh199, Rh200, Rh201, Rh202 and Rh220. In another embodiment, HCMV gene regions that may be deleted include gene regions RL11 (L), UL6, UL7 (L), UL9 (L), UL11 (E), UL83 (L) (pp65), US12 (E), US13 (E), US14 (E), US17 (E), US18 (E), US19 (E), US20 (E), US21 and UL28.

Recombinant CMV vectors, or compositions thereof, can be administered to a subject by any of the routes normally used for introducing recombinant virus or viral vectors into a subject. Methods of administration include, but are not limited to, intradermal, intramuscular, intraperitoneal, parenteral, intravenous, subcutaneous, vaginal, rectal, intranasal, inhalation or oral. Parenteral administration, such as subcutaneous, intravenous or intramuscular administration, is generally achieved by injection. Injectables can be prepared in conventional forms, either as liquid solutions or suspensions, solid forms suitable for solution or suspension in liquid prior to injection, or as emulsions. Injection solutions and suspensions can be prepared from sterile powders, granules, and tablets of the kind previously described. Administration can be systemic or local.

Compositions including recombinant CMV vectors are administered in any suitable manner, such as with pharmaceutically acceptable carriers. Pharmaceutically acceptable carriers are determined in part by the particular composition being administered, as well as by the particular method used to administer the composition. Accordingly, there is a wide variety of suitable formulations of pharmaceutical compositions of the present disclosure.

Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives may also be present such as, for example, antimicrobials, antioxidants, chelating agents, and inert gases and the like.

Some of the compositions may potentially be administered as a pharmaceutically acceptable acid- or base-addition salt, formed by reaction with inorganic acids such as hydrochloric acid, hydrobromic acid, perchloric acid, nitric acid, thiocyanic acid, sulfuric acid, and phosphoric acid, and organic acids such as formic acid, acetic acid, propionic acid, glycolic acid, lactic acid, pyruvic acid, oxalic acid, malonic acid, succinic acid, maleic acid, and fumaric acid, or by reaction with an inorganic base such as sodium hydroxide, ammonium hydroxide, potassium hydroxide, and organic bases such as mono-, di-, trialkyl and aryl amines and substituted ethanolamines.

Administration can be accomplished by single or multiple doses. The dose administered to a subject in the context of the present disclosure should be sufficient to induce a beneficial therapeutic response in a subject over time. The dose required will vary from subject to subject depending on the species, age, weight and general condition of the subject, the severity of the infection being treated, the particular composition being used and its mode of administration. An appropriate dose can be determined by one of ordinary skill in the art using only routine experimentation.

Provided herein are pharmaceutical compositions which include a therapeutically effective amount of the recombinant CMV vector alone or in combination with a pharmaceutically acceptable carrier. Pharmaceutically acceptable carriers include, but are not limited to, saline, buffered saline, dextrose, water, glycerol, ethanol, and combinations thereof. The carrier and composition can be sterile, and the formulation suits the mode of administration. The composition can also contain minor amounts of wetting or emulsifying agents, or pH buffering agents. The composition can be a liquid solution, suspension, emulsion, tablet, pill, capsule, sustained release formulation, or powder. The composition can be formulated as a suppository, with traditional binders and carriers such as triglycerides. Oral formulations can include standard carriers such as pharmaceutical grades of mannitol, lactose, starch, magnesium stearate, sodium saccharine, cellulose, and magnesium carbonate. Any of the common pharmaceutical carriers, such as sterile saline solution or sesame oil, can be used. The medium can also contain conventional pharmaceutical adjunct materials such as, for example, pharmaceutically acceptable salts to adjust the osmotic pressure, buffers, preservatives and the like. Other media that can be used with the compositions and methods provided herein are normal saline and sesame oil.

The recombinant CMV vectors described herein can be administered alone or in combination with other therapeutic agents to enhance antigenicity. For example, the CMV vectors can be administered with an adjuvant, such as Freund's incomplete adjuvant or Freund's complete adjuvant.

Optionally, one or more cytokines, such as IL-2, IL-6, IL-12, RANTES, GM-CSF, TNF-α, or IFN-γ, one or more growth factors, such as GM-CSF or G-CSF; one or more molecules such as OX-40L or 41 BBL, or combinations of these molecules, can be used as biological adjuvants (see, for example, Salgaller et al., 1998, *J. Surg. Oncol.* 68(2):122-38; Lotze et al., 2000, *Cancer J. Sci. Am.* 6(Suppl 1):S61-6; Cao et al., 1998, *Stem Cells* 16(Suppl 1):251-60; Kuiper et al., 2000, *Adv. Exp. Med. Biol.* 465:381-90). These molecules can be administered systemically (or locally) to the host.

A number of means for inducing cellular responses, both in vitro and in vivo, are known. Lipids have been identified as agents capable of assisting in priming CTL in vivo against various antigens. In certain embodiments, the use of liposomes, nanocapsules, microparticles, microspheres, lipid particles, vesicles, and the like, are contemplated for the introduction of the compositions of the present disclosure into suitable host cells. In particular, the compositions of the present disclosure may be formulated for delivery either encapsulated in a lipid particle, a liposome, a vesicle, a nanosphere, or a nanoparticle or the like.

Such formulations may be preferred for the introduction of pharmaceutically-acceptable formulations of the nucleic acids or constructs disclosed herein. The formation and use of liposomes is generally known to those of skill in the art. Liposomes have been developed with improved serum stability and circulation half-times (U.S. Pat. No. 5,741,516). Further, various methods of liposome and liposome like preparations as potential drug carriers have been reviewed (U.S. Pat. No. 5,567,434; U.S. Pat. No. 5,552,157; U.S. Pat. No. 5,565,213; U.S. Pat. No. 5,738,868 and U.S. Pat. No. 5,795,587).

Liposomes have been used successfully with a number of cell types that are normally resistant to transfection by other procedures including T cell suspensions, primary hepatocyte cultures and PC 12 cells. In addition, liposomes are free of the DNA length constraints that are typical of viral-based delivery systems. Liposomes have been used effectively to introduce genes, drugs, radiotherapeutic agents, enzymes, viruses, transcription factors and allosteric effectors into a variety of cultured cell lines and animals. In addition, several successful clinical trials examining the effectiveness of liposome-mediated drug delivery have been completed. Furthermore, several studies suggest that the use of liposomes is not associated with autoimmune responses, toxicity or gonadal localization after systemic delivery.

Liposomes are formed from phospholipids that are dispersed in an aqueous medium and spontaneously form multilamellar concentric bilayer vesicles (also termed multilamellar vesicles (MLVs). MLVs generally have diameters of from 25 nm to 4 μm. Sonication of MLVs results in the formation of small unilamellar vesicles (SUVs) with diameters in the range of 200 to 500 Å, containing an aqueous solution in the core.

Liposomes bear resemblance to cellular membranes and are contemplated for use in connection with the present disclosure as carriers for the CMV vector compositions. They are widely suitable as both water- and lipid-soluble substances can be entrapped, i.e., in the aqueous spaces and within the bilayer itself, respectively. It is possible that the drug-bearing liposomes may even be employed for site-specific delivery of active agents by selectively modifying the liposomal formulation.

Some embodiments of the invention relate to the alteration of RhCMV/SIV vector tropism to prevent replication in cells and tissues associated with viral spread and pathogenesis. The tropism-defective vector either lacks genes required for optimal growth in certain cell types or the vector is modified to contain targets for tissue-specific micro-RNAs in genes that are essential for viral replication.

The following examples are provided to illustrate certain particular features and/or embodiments. These examples should not be construed to limit the disclosure to the particular features or embodiments described.

EXAMPLES

Example 1

Recombinant HCMV and RhCMV Vectors

This example describes exemplary recombinant HCMV and RhCMV vectors encoding heterologous antigens, such as pathogen-specific antigens or cancer antigens. Particular aspects of the disclosure provide recombinant RhCMV and HCMV vectors that are deficient or impaired in their ability to replicate in vitro and in vivo, disseminate within the host, or spread from host to host. Other aspects provide RhCMV and HCMV vectors that can be growth-modulated in vivo (e.g., by oral administration of the antibiotic doxycycline). Heterologous antigen expression may be under the control of promoters of different kinetic classes with respect to the CMV infection cycle (e.g., EF1α—constitutive; MIE—immediate early; pp65—early; gH—late).

In particular embodiments, RhCMV and HCMV vectors lack immune modulatory genes (e.g., Rh158-166 and Rh182-189 (US2-11)) to enhance vector immunogenicity, safety and heterologous gene carrying capacity of the vector. For example, HCMV encodes at least four different gene products, gpUS2, gpUS3, gpUS6 and gpUS11 that interfere with antigen presentation by MHC I (37). All four HCMV MHC evasion molecules are encoded in the unique short region of HCMV and belong to the related US6 gene family. Additional HCMV immunomodulators include, but are not limited to UL118, UL119, UL36, UL37, UL111a, UL146, UL147, etc. Likewise, RhCMV contains homologous and analogous immune modulatory genes that can be deleted or modified to enhance vector immunogenicity, safety and heterologous gene carrying capacity of the disclosed vaccine vectors.

In additional embodiments, recombinant RhCMV and HCMV vectors are further optimized for anti-pathogen or anti-tumor immunogenicity by insertion of multiple antigen genes. Alternatively, several vectors, each having a single inserted antigen may be used for co-administration.

In additional embodiments, recombinant RhCMV and HCMV vectors contain LoxP sites (e.g., RhCMV/Antigen-LoxPCre) strategically placed in the CMV genome to flank an essential region of the viral genome, in combination with a tetracycline (Tet)-regulated Cre recombinase. Following immunization, doxycycline (Dox)-mediated induction of Cre recombinase enables in vivo inactivation of RhCMV/AntigenLoxPCre by cleavage at the LoxP sites.

In additional embodiments, the recombinant RhCMV or HCMV vector includes a deletion in one or more genes that are essential for or augment virus replication inside the infected cell, dissemination within the host, and spreading between hosts. Specific examples of essential or augmenting genes include, but are not limited to, UL82, UL94, UL32, UL99, UL115 or UL44, or a homolog thereof. Other essential genes are known in the art and are contemplated for deletion in the disclosed RhCMV and HCMV vectors (see, for example, Dunn et al., *Proc. Natl. Acad. Sci. USA* 100(24): 14223-14228, 2003; Dong et al., *Proc. Natl. Acad. Sci. USA* 100(21):12396-12401, 2003).

Construction and Characterization of the RhCMV BAC The development of BAC technology to clone large segments of genomic DNA coupled with sophisticated λ phage-based mutagenesis systems has revolutionized the field of herpes virology enabling genetic approaches to analyze the virus. This system was used, for example, to construct an RhCMV BAC (RhCMV BAC-Cre) containing the complete RhCMV strain 68-1 genome. The RhCMV BAC-Cre was derived from an infectious, pathogenic RhCMV 68-1/EGFP recombinant virus (16). RhCMV BAC-Cre contains a BAC cassette inserted at a single LoxP site within the Rh181 (US1)/Rh182 (US2) intergenic region of RhCMVvLoxP. Insertion of the BAC cassette at this site results in the generation of LoxP sequences flanking the cassette. As the BAC cassette contains a Cre gene that is expressed in eukaryotic cells, transfection of this 'self-excising' RhCMV BAC-Cre into fibroblasts results in efficient excision of the BAC cassette, reconstituting virus (designated RhCMVvLoxP). Characterization of the growth of the BAC-reconstituted virus (RhCMVvLoxP) in vitro and in vivo demonstrates that the various genetic manipulations did not alter the WT properties of the virus. The genomic structure of RhCMVvLoxP is identical to that of WT RhCMV except for the residual LoxP site. The presence of the LoxP sequence does not alter the expression profiles of neighboring Rh181 (US1) and Rh182 (US2) or distal (IE2) genes. RhCMVvLoxP replicates with WT kinetics both in tissue culture and in RhCMV seronegative immunocompetent RMs (n=2). Analysis of tissues from one animal terminated at 6 months post-inoculation demonstrated the presence of both RhCMV DNA and IE1-expressing cells in the spleen, consistent with the persistent gene expression observed in previous studies with WT virus. Both RMs developed vigorous anti-RhCMV antibody titers comparable to those observed in naturally infected animals. Taken together, these observations demonstrate that RhCMVvLoxP is phenotypically WT and is suitable to construct site-specific alterations for the development of vaccine vectors.

Exemplary HCMV and RhCMV Vaccine Vectors

Figure 15:
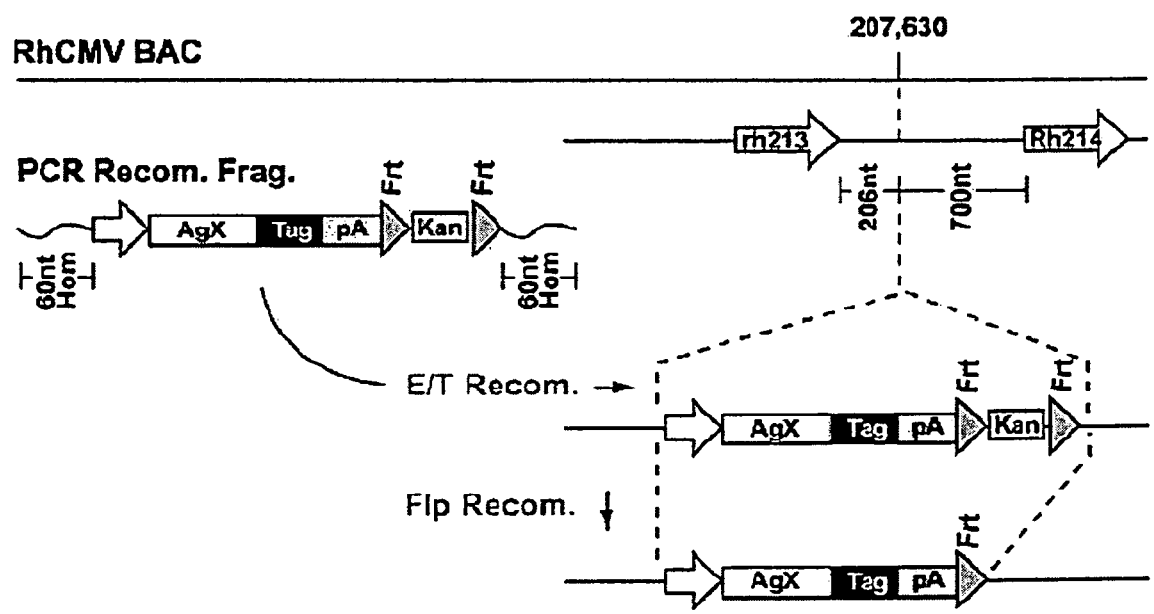
FIG. 15 is an illustration of the construction of RhCMV and HCMV vaccine vectors. Heterologous pathogen antigen(s) are inserted into RhCMV or HCMV bacterial artificial chromosomes (BACs) by E/T and Flp-mediated recombination.

FIG. 15 schematically depicts construction of RhCMV and HCMV vaccine vectors according to particular aspects of the present disclosure. Heterologous pathogen antigen(s) are inserted into RhCMV or HCMV bacterial artificial chromosomes (BACs) by E/T and Flp-mediated recombination. The schematic shows, for example, a generalized strategy for insertion of an epitope-tagged pathogen antigen into the non-coding region between rh213 and Rh214 of RhCMV. This strategy can be similarly used for insertion of heterologous pathogen antigens at other defined sites within the RhCMV/HCMV genome, as well as insertion of multiple antigens at single or multiple sites within the genome. The gene encoding the epitope-tagged pathogen antigen is inserted into the BAC genome using E/T recombination. Following selection of recombinant BACs on the basis of antibiotic resistance (such as Kan), the resistance gene is removed by Flp-mediated recombination. Recombinant RhCMV and HCMV vaccine vectors are reconstituted by transfection of recombinant BACs into RhCMV/HCMV permissive cells (AgX, pathogen or cancer antigen; Tag, epitope tag; pA, polyadenylation site; Kan, kanamycin resistance gene for selection in bacteria).

Figure 16:
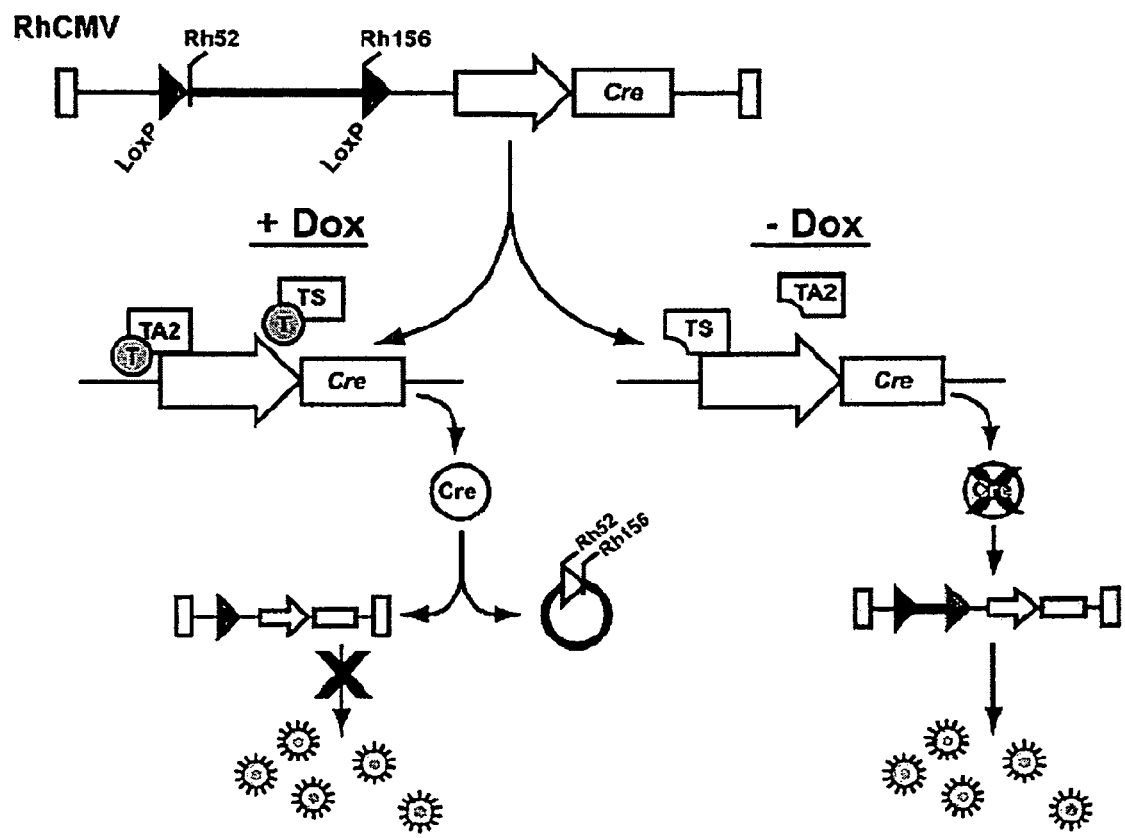
FIG. 16 is an illustration of an exemplary tetracycline-regulated RhCMV/HCMV safety vaccine vector. This RhCMV/HCMV safety vector contains two interactive genetic components within the RhCMV/HCMV genome that together enable Tet-induced vector inactivation.

FIG. 16 shows an exemplary tetracycline-regulated RhCMV/HCMV 'safety' vaccine vector. This RhCMV/HCMV safety vector contains two interactive genetic components within the RhCMV/HCMV genome that together enable Tet-induced vector inactivation. A Tet-inducible Cre recombinase gene (Cre) inserted within the viral genome enables induction of Cre recombinase expression by treatment with the Tet homologue, doxycycline (Dox) (D). This Tet-regulated system is comprised of a Tet-sensitive reverse-transactivator (rtTA2$^s$-M2) (TA2), a Tet-transrepressor (tTS-kid) (TS) and a tetO$_7$-CMV minimal promoter unit (white arrow) driving Cre-recombinase expression. The second component necessary for Tet-induced inactivation is a pair of LoxP sites located within the viral genome to flank a region of the genome essential for virus replication (in this case, Rh52-Rh156). In the absence of Dox, the binding of tTS-kid and lack of binding of rtTA2$^s$-M2 to the tetO$_7$-CMV minimal promoter unit prevents Cre-recombinase expression. In the absence of Cre recombinase, the integrity of the RhCMV/HCMV genome is maintained and the virus replicates normally. Addition of Dox results in the allosteric modulation of tTS-kid and rtTA2$^s$-M2 that results in the activation of Cre recombinase expression. Cre recombinase inactivates the RhCMV/HCMV vaccine vectors by catalyzing the excision of the region of the viral genome flanked by loxP sites (in this case, Rh52-Rh156). For simplicity, genes expressing rtTA2$^s$-M2 and tTS-kid as well as the gene expressing the heterologous pathogen antigen are not shown.

Figure 17:
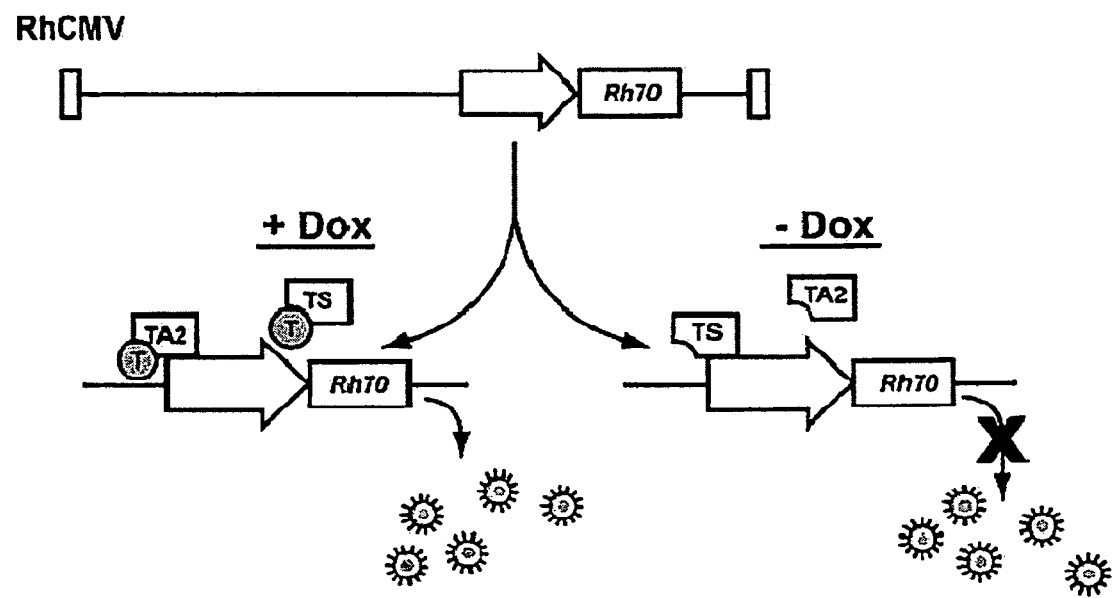
FIG. 17 is an illustration of another exemplary tetracycline-regulated RhCMV/HCMV safety vaccine vector. Such RhCMV/HCMV vaccine vectors are constructed by placing a gene essential for virus replication, (in this example, Rh70 (HCMV homologue-UL44); DNA polymerase processivity factor), under control of the Tet-inducible system illustrated in FIG. 10.

FIG. 17 shows another exemplary tetracycline-regulated RhCMV/HCMV 'safety' vaccine vector. Such RhCMV/HCMV vaccine vectors are constructed by placing a gene essential for virus replication, in this example Rh70 (HCMV homologue-UL44) DNA polymerase processivity factor, under control of the Tet-inducible system described in FIG. 16. The Rh70HCMV homologue (UL44) was initially selected as this gene has been shown to be essential for CMV replication (Shenk, Proc. Natl. Acad. Sci. USA 100:12396, 2003; Ripalti, J Virol. 69:2047, 1995). However, other essential viral genes can be used as candidate genes for Tet-mediated regulation. Regulation of Rh70 expression or expression of other essential RhCMV/HCMV genes by the Tet-regulated system enables control of virus replication by varying Dox level. To place the essential gene under Dox control, the 5' upstream region of the gene is replaced with the tetO$_7$-CMV minimal promoter unit (white arrow). After inoculation of animals with Tet-regulated vectors in the presence of Dox, virus replication can be inactivated simply by Dox withdrawal. Tet-regulated vectors are constructed by E/T and Flp-based recombination as detailed in FIG. 15.

Figure 18:
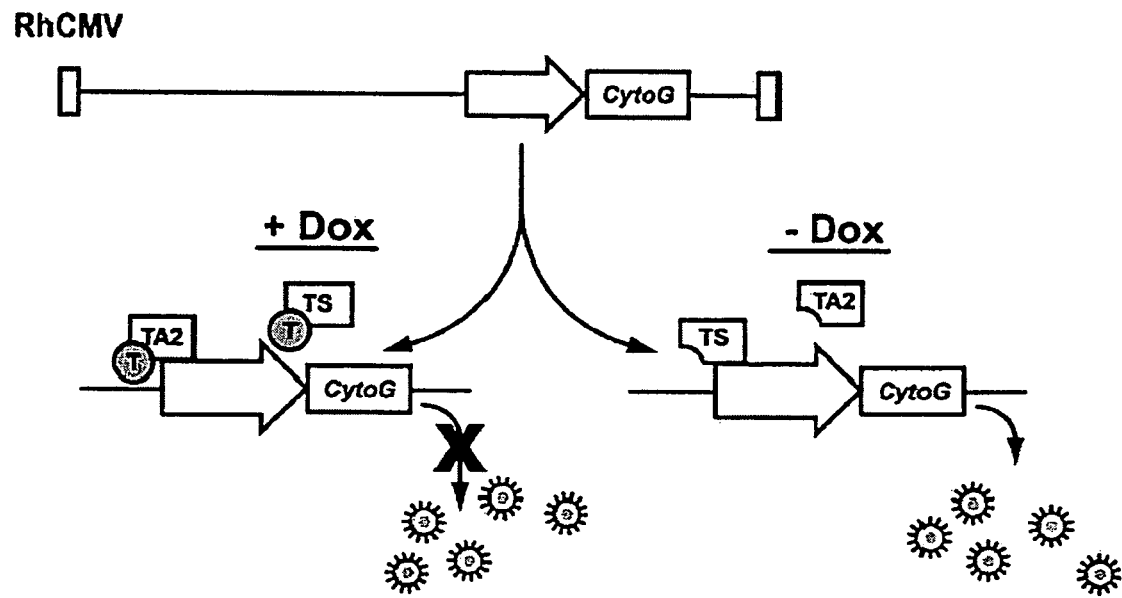
FIG. 18 is an illustration of another exemplary tetracycline-regulated RhCMV/HCMV safety vaccine vector. Such RhCMV/HCMV vaccine vectors are constructed containing a cytotoxic gene (CytoG) under control of the Tet-inducible system as detailed in FIG. 11. After inoculation of animals with Tet-regulated vectors in the absence of Dox, virus replication can be rapidly inactivated by Dox-mediated induction of the cytopathic gene resulting in death of the vaccine vector-infected cell.

FIG. 18 shows yet another exemplary tetracycline-regulated RhCMV/HCMV 'safety' vaccine vector. Such RhCMV/HCMV vaccine vectors are constructed containing a cytotoxic gene (CytoG) under control of the Tet-inducible system as detailed in FIG. 17. After inoculation of animals with Tet-regulated vectors in the absence of Dox, virus replication can be rapidly inactivated by Dox-mediated induction of the cytopathic gene resulting in death of the vaccine vector-infected cell.

Figure 19:
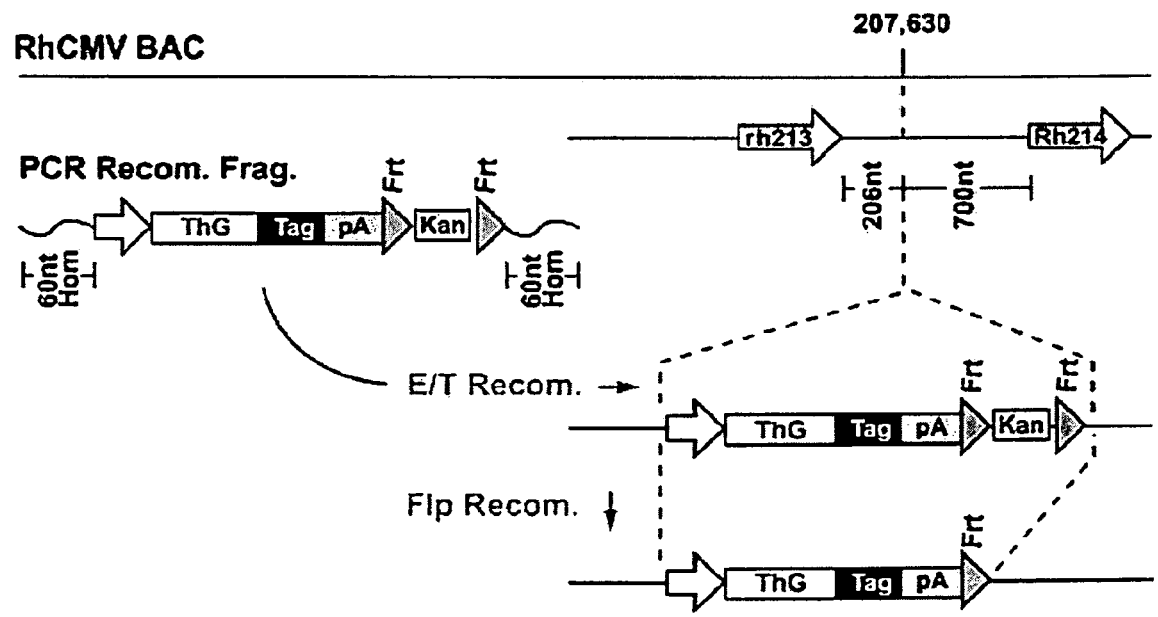
FIG. 19 is an illustration of the construction of exemplary RhCMV and HCMV gene therapy vectors. Therapeutic gene(s) are inserted into RhCMV or HCMV bacterial artificial chromosomes (BACs) by E/T and Flp-mediated recombination. The schematic shows a generalized strategy for insertion of an epitope-tagged therapeutic gene into the non-coding region between rh213 and Rh214 of RhCMV. This strategy can be similarly used for insertion of therapeutic genes at other defined sites within the RhCMV/HCMV genome.
Figure 20:
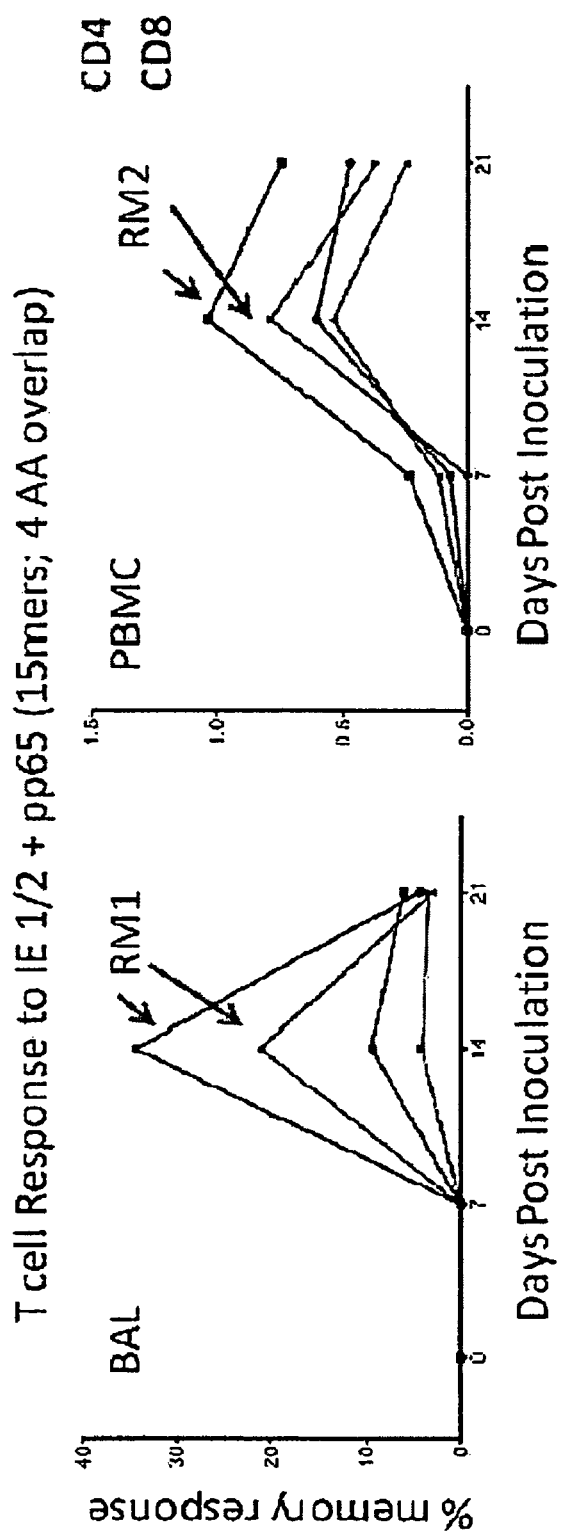
FIG. 20 is a pair of graphs showing the T cell response to RhCMV lacking pp71. Two sero-negative RM were inoculated s.c. with $10^7$ PFU of RhCMVΔpp71 at day 0. The CD8+ and CD4+ T cell response against overlapping peptides of RhCMV IE and pp65 was measured by intracellular cytokine staining in PBMC and BAL at the indicated intervals.

In further aspects, RhCMV and HCMV gene therapy vectors are provided. FIG. 19 schematically depicts construction of exemplary RhCMV and HCMV gene therapy vectors. Therapeutic gene(s) are inserted into RhCMV or HCMV BACs by E/T and Flp-mediated recombination. The schematic shows a generalized strategy for insertion of an epitope-tagged therapeutic gene into the non-coding region between rh213 and Rh214 of RhCMV. This strategy can be similarly used for insertion of therapeutic genes at other defined sites within the RhCMV/HCMV genome. The gene encoding the epitope-tagged replacement gene is inserted into the BAC genome using E/T recombination. Following selection of recombinant BACs on the basis of antibiotic resistance (in this case, Kan), the resistance gene is removed by Flp-mediated recombination. Recombinant RhCMV and HCMV gene therapy vectors are reconstituted by transfection of recombinant BACs into RhCMV/HCMV permissive cells (ThG, therapeutic gene; Tag, epitope tag; pA, polyadenylation site; Kan, kanamycin resistance gene for selection in bacteria).

Example 2

Construction of RhCMV/SIVmac239gag

The presence of the single functional LoxP site located in the intergenic region between Rh181 (US1) and Rh182 (US2) of RhCMVvLoxP was exploited to utilize a Cre recombinase/ LoxP system for construction of recombinant virus. For this approach, pSIVmac239gag plasmid was used as a source of template for PCR amplification of the SIVmac239gag cassette. The SIVmac239gag cassette contains the cellular EF1α promoter driving expression of the SIVmac239gag gene. The EF1α promoter is a highly active promoter that is constitutively active in all cell types tested and is expected to result in high cell type independent expression of the gag gene. PCR amplification was performed using primers designed to incorporate a single LoxP site at either end of the amplified SIVmac239gag cassette. For recombination, the PCR product containing the SIVmac239gag cassette flanked by LoxP sites was transfected into RM fibroblasts. At 24 hours post-transfection, these cells were infected with RhCMVvLoxP at a multiplicity of infection (MOI) of 1. The infection was allowed to progress until extensive cytopathic effect was observed. At this time, virus-infected cells were harvested and used to infect fresh fibroblasts, which were then over-layed with agarose to prevent viral spread through the culture. After approximately two weeks, individual viral plaques were picked, and each plaque was used to infect fresh fibroblasts. Total cell lysates were then screened for the presence of the SIVmac239gag gene by PCR. SIVmac239gag-positive cell lysates were then sonicated, serial diluted and used to infect fresh fibroblasts. The process was repeated three times, after which plaque-purified virus clones were screened for gag gene expression by northern blot analysis of total RNA obtained from infected cells. The presence of gag protein expression was confirmed by western analysis as well as immunofluorescence in endothelial cells (EC) and monocyte-derived macrophages (MDM). The entire SIVmac239gag cassette was sequenced to confirm sequence integrity of the inserted cassette. The growth kinetics of gag-positive clones was compared to WT virus and a single RhCMV/SIVmac239gag recombinant virus with WT growth characteristics and high levels of gag expression was selected.

At day 224 post-primary infection, RhCMV/SIVmac239gag was subcutaneously administered to a cohort of 4 RhCMV-seropositive RM. As previously observed in re-infection studies, real-time PCR did not detect RhCMV, either WT or RhCMV/SIVmac239gag, in blood or lung lavage mononuclear cells at any time point following viral inoculation. However, urine from day 127 post re-infection was weakly positive for gag expression by ELISA suggesting the presence of RhCMV/SIVmac239gag. These samples were co-cultured to isolate RhCMV, and these in vivo-derived viral preparations were assessed for gag expression by western blot. As shown in FIG. 8, RhCMV co-cultures from all 4 animals expressed gag, definitively establishing the presence of RhCMV/SIVmac239gag virus at these epithelial secretory sites. Retrospective analysis of urine at earlier post-re-infection time points revealed the presence of the gag-expressing RhCMV vector in urine by day 7 in one RM and by day 21 in the other 3 animals. Moreover, gag-expressing RhCMV was also present in saliva, and remained present in urine at least through day 237 post re-infection. Significantly, re-infection of this RhCMV/SIVmac239gag clone induced a mucosally-oriented, gag-specific CD4+ and CD8+ T cell response, as well as a gag-specific antibody response (see FIGS. 10, 11 and 12). These data unequivocally demonstrate that CMV is capable of re-infecting immune subjects, effectively competing with pre-existent WT virus, and establishing infection at normal sites within the host, despite strongly boosted cellular and humoral immunity directed at CMV. They also demonstrate the high in vivo stability of RhCMV vectors expressing exogenous heterologous antigens, suggesting that these vectors may be able to persistently infect inoculated subjects and indefinitely maintain expression of the inserted, exogenous antigen-encoding genes. Finally, they demonstrate that recombinant RhCMV can elicit both T cell and Ab responses to exogenous proteins in the setting of re-infection, and thus has the potential to serve as an effective vaccine vector in individuals with pre-existing CMV immunity.

Example 3

CMV Vectors Encoding Poliovirus VP1, TetanusC, Influenza H5N1 Hemagglutinin and Ebola Virus Nucleoprotein (NP)

This example describes in vitro expression of heterologous antigens encoded by a recombinant murine CMV (MCMV) vector, and induction of antigen-specific CD8+ T cells in vaccinated animals. CMVs show strict species specificity with most mammalian species having their own unique CMV. However, all CMVs share common characteristics of growth, cytopathology, tissue tropism and a capacity to establish persistent and latent infection. The similarity in biology of CMVs has enabled the use of CMV infection of non-human animals, such as murine CMV infection of mice and rhesus CMV infection of rhesus macaques, as in vivo models of human disease. Thus, the MCMV mouse model is commonly used as an in vivo model for HCMV. Accordingly, this example provides proof of concept for use of recombinant CMV vectors (such as RhCMV and HCMV vectors) for expression of heterologous antigens and use of the vectors for eliciting an immune response in a subject.

The MCMV BAC plasmid used in the following experiments to generate recombinant MCMV vectors encoding a heterologous antigen has been described (Wagner et al., *J. Virol.* 73:7056-7060, 1999).

DNA encoding poliovirus VP1 was PCR amplified from poliovirus nucleic acid and cloned into the MCMV BAC plasmid to generate pMCMV-VP1. The VP1 protein was also tagged with a small epitope at the extreme carboxy-terminus to facilitate detection. The pMCMV-VP1 was transfected into murine embryo fibroblasts (MEFs) to reconstitute MCMV-VP1 virus. MEFs were infected with MCMV-VP1 virus. After approximately 3 days, cells were harvested and isolated protein was separated on a polyacrylamide gel. Western blotting was performed using an antibody against the epitope tag. Based on epitope tag reactivity and predicted molecular weight, the results demonstrated that poliovirus VP1 was efficiently expressed in MEFs infected with MCMV-VP1. Aspects of this embodiment of the invention are further described in Example 6.

The avian influenza (Viet04 strain) H5N1 HA was cloned into the MCMV BAC plasmid to generate pMCMV-HA. The HA protein was epitope-tagged to facilitate expression analysis. MCMV-HA virus was reconstituted as described above. MCMV-HA virus was used to infect MEFs. After approximately 3 days, cells were harvested and isolated protein was separated on a polyacrylamide gel. Western blotting was performed using an antibody against the epitope tag. Based on epitope tag reactivity and predicted molecular weight, the results demonstrated that HA was efficiently expressed in MEFs infected with MCMV-HA.

A T cell epitope of Ebola virus NP was fused to non-essential MCMV gene IE2 to generate the construct pMCMV-EBOV-NP$_{CTL}$. MCMV-EBOV-NP$_{CTL}$ virus was reconstituted in MEFs. Ten mice were immunized i.p. with MCMV-EBOV-NP$_{CTL}$ on day 1 and boosted at week 4. Splenocytes were harvested at week 8 to evaluate the number of NP-specific CD8+ T cells using intracellular cytokine staining (ICS) Briefly, splenocytes were incubated in the presence of target antigen (NP) and brefeldin A for 6 hours. The percentage of NP-specific CD8+ T cells was determined by flow cytometry based on expression of effector cytokines. For individual mice, the percentage of total CD8+ T cells specific for NP ranged from approximately 1-10%, demonstrating that immunization with MCMV-EBOV-NP$_{CTL}$ was extremely effective for eliciting an NP-specific T cell immune response. This embodiment of the invention is further described in Example 7.

Summary: These results demonstrate that recombinant CMV vectors encoding a heterologous antigen (either the entire full-length protein or an individual epitope) are capable of effectively expressing the heterologous antigen in infected cells, and eliciting a strong T cell immune response to the heterologous antigen.

Example 4

Recombinant RhCMV Encoding Monkeypox Virus Antigen A35R

This example describes a recombinant RhCMV vector encoding the monkeypox virus antigen A35R and A35R-specific T cell responses in rhesus macaques (RM) vaccinated with the recombinant virus vector. RMs were vaccinated with RhCMV expressing A35R, and BAL fluid was collected at days 7, 14 and 21 post-vaccination for analysis of T cells in the lung (an accessible mucosal effector site). Both CD4+ and CD8+ central (CM) and effector memory (EM) responses specific for A35R were assessed by ICS as described above (but using A35R peptides). At day 14, a significant increase in the number of CM and EM A35R-specific T-cells (both CD4+ and CD8+) was observed in the vaccinated animal.

Example 5

Generation of an effective SIV vaccine using an RhCMV vector design that is highly attenuated and sufficiently safe for human translation is described. One approach takes the most direct route to vector attenuation by engineering generally replication-deficient vectors, but the requirement for CMV vector replication for inducing a protective immune response against SIV is still unclear. A complementary approach generates RhCMV/SIV vectors that are attenuated for replication only in specific target tissues that are associated with CMV disease and shedding, but that can still induce SIV protective immune responses if viral replication is a necessary component for this immunity. One of the key characteristics of primary HCMV/RhCMV infection is that individuals shed virus from glandular tissue such as salivary gland as well as excrete virus into the urine (Pass, R. F. 2001. Cytomegalovirus. In Fields Virology. P. M. H. David M. Knipe, Diane E. Griffin, Robert A. Lamb Malcolm A. Martin, Bernard Roizman and Stephen E. Straus, editor. Philadelphia: Lippincott Williams & Wilkins. 2675-2705).

Infected epithelial cells lining the salivary gland ducts and urinary tract or kidney are considered to be persistent sources of virus in these tissues. First, a RhCMV/SIV vector is engineered that has all of the known genes involved in epithelial cell tropism removed from the RhCMV backbone. Preventing virus replication in this cell type may significantly reduce shedding of RhCMV from these tissues as well as pathogenicity in RM without the loss of SIV protective immunity. Altering RhCMV epithelial cell tropism may significantly attenuate the vaccine vector in RM, but the possibility remains that in the context of fetal infection the vector may still be able to disseminate and cause CNS disease. Therefore, an additional embodiment of the invention relates to ensuring safety of the vector by altering its ability to replicate in CNS and myeloid tissue using a novel approach based on tissue-specific miRNAs to inactivate essential RhCMV genes necessary for production of infectious virus. The ultimate RhCMV/SIV vaccine generated in these studies may include a combination of these tropism defects depending on the characteristics of the SIV-specific T cell responses observed with the individual tropism knockouts.

Generation and characterization of a RhCMV/SIV vector completely deficient for replication in epithelial cells by deletion of tropism genes. HCMV and RhCMV replicate in many different cell types including epithelial and endothelial cells, macrophages, neurons, endothelial cells, as well as fibroblasts (which is the prototypic cell for growth of the virus in vitro). HCMV and RhCMV mutagenesis studies have revealed a number of viral genes that are nonessential for replication in fibroblasts, but that determine tropism of the virus for other cell types. For example, HCMV UL128-131A genes were observed to be critical for viral entry into epithelial and endothelial cells, but not fibroblasts as described earlier. The RhCMV vector used for construction of RhCMV/SIV constructs (68-1), has mutations in the UL128-131A gene cluster and displays decreased replication in RM retinal pigment epithelial (RRPE) cells. This decreased replication in RRPE cells results from the loss of the RhCMV homologues of HCMV UL128 and the second exon of UL130. While 68-1 is still capable of infecting epithelial cells, repair of the UL128 and 130 mutations results in a 2-3 log increase in viral replication in these cells. Consistent with the function of these genes in epithelial tropism, RhCMV 68-1 exhibits decreased shedding into urine and saliva from normal epithelial sites of persistent replication in healthy adult RMs. Importantly, this 'experiment of nature' indicates that targeting of epithelial tropism genes is an effective strategy by which to attenuate the ability of CMV vectors to shed while maintaining vaccine efficacy. The presence of 4 additional epithelial cell tropism genes in RhCMV (Rh01 Rh159, Rh160, and, Rh203) may explain the ability of 68-1 to retain a residual ability to replicate in epithelial cells. Mutation of these genes result in severe (>4 log decrease) to moderate (1-2 log decrease) replication defects in epithelial but not fibroblast cells. Since inactivation of RhCMV UL128 and 130 has an effect on the ability of the virus to infect epithelial cells and shed from infected RMs, the elimination of the remaining epithelial cell tropism genes may completely abrogate epithelial cell infection and eliminate viral shedding. The elimination of the epithelial cell tropism may severely attenuate pathogenicity of the virus in vivo, especially in the ability of the virus to cause epithelium-associated disease such as pneumonia. Therefore, embodiments of the invention relate to a RhCMV/SIV vector that has decreased replication in epithelial cells by deletion of these 4 additional epithelial tropism genes from the 68-1 RhCMV genome. This vector is designated RhCMVΔEpiCMAX/SIV(gag) or (retanef) and to be used for in vivo studies.

The construction of a RhCMV/SIV vector deleted for all known epithelial tropism genes [designated RhCMVΔEpiCMAX/SIV(gag) or (retanef)] requires multiple rounds of linear recombination to individually target the four remaining tropism genes within the 68-1 BAC genome (which is already deleted for UL128 and UL130). At the same time, a cassette expressing SIV gag or retanef with a distinct epitope tag under control of the EF1α promoter is reciprocally inserted into the genome during deletion of the first epithelial tropism open reading frame (ORF) (Rh01). To enable repeated rounds of deletion, a modification to the standard two-step linear recombination protocol that uses galactokinase (galK) as the selectable marker is used (Warming, S., Costantino, N., Court, D. L., Jenkins, N. A., and Copeland, N. G. 2005. Simple and highly efficient BAC recombineering using galK selection. Nucleic Acids Res 33:e36).

Importantly, this modified system does not leave any cis-acting heterologous sequence DNA 'scar' within the BAC genome that would interfere with subsequent rounds of recombination. In the first recombination step, recombinant bacteria (SW102) containing the RhCMV BAC (68-1) are transformed with a PCR product comprised of galK and kanamycin resistance (KanR) flanked by sequence homologous to the desired site of recombination within the RhCMV genome. SW102 are galactose auxotrophs (due to deletion of the galK gene from the galactose operon), and growth on plates containing galactose as the only source of carbon and kanamycin enables selection for BAC clones that have incorporated the PCR product (and galK/KanR) within the genome.

In the second recombination step, the galK/KanR cassette is replaced with an oligonucleotide or PCR product with sequence homology to the recombination site flanking the desired deletion. Bacteria is grown on plates containing 2-deoxy-galactose, a substrate toxic in the presence of galK, in the absence of kanamycin resulting in counter-selection for BAC clones that have lost the galK/KanR marker, and contain only the desired deletion. This method is used to sequentially delete Rh159, Rh160, and, Rh203 until all of the epithelial cell tropism genes are deleted from the RhCMV/SIV vector. In parallel to reduce the numbers of animals necessary to test the immunogenicity of the RhCMV/SIV vectors similar RhCMV vectors lacking the epithelial cell tropism genes but encoding SIV retanef with a V5 epitope tag expression cassette (2) instead of the gag expression cassette [RhCMVΔEpiCMAX/SIV(retanef) are constructed.

Reconstitution of RhCMVΔEpiCMAX/SIV(gag) and (retanef) viruses: To reconstitute viruses, BACs are transfected into primary rhesus fibroblasts (RFs). After approximately two weeks, plaques are expected to become visible and virus is recovered. Virus is further purified by three rounds of plaque purification to ensure removal of the BAC cassette and elimination of any residual contamination with wildtype RhCMV. Removal of the BAC-cassette is confirmed by PCR and Southern blot from genomic DNA isolated from recovered virus. Expression of gag and retanef protein expression is confirmed to ensure that target antigen expression levels are comparable to WT vectors. Growth of RhCMVΔEpiCMAX/SIV(gag) and (retanef) is compared to wildtype RhCMV for growth in both RFs (assessment of basic growth capacity) and epithelial cells.

In addition to RRPE, primary RM kidney epithelial cells may be used for this characterization. Growth on macrophages and microvascular endothelial cells is also assessed since these genes may effect growth of the virus in these cell types. An RhCMV vector that retains normal growth in fibroblasts in vitro, but is maximally compromised for growth in epithelial cells will be tested for immunogenicity and attenuation in animals. If viral replication is also altered in macrophages or endothelial cells, an embodiment of the invention relates to mutations that exhibit lack replication in epithelial cells alone. Since the four individual epithelial genes may be sequentially deleted in construction of RhCMVΔEpiCMAX/SIV(gag) and (retanef), any vector that shows decreased replication in fibroblasts or additional non-epithelial cell types is rapidly identified at the stage of its construction during the subsequent in vitro growth characterization. The RhCMV vector that is maximally deleted for the greatest number of the epithelial tropism ORFs, without affecting fibroblast growth is designated RhCMVΔEpiCMAX/SIV(gag) or (retanef) and used for the in vivo RM studies.

Embodiments of the invention relate to the generation and characterization of RhCMV/SIV vectors that are deficient for replication in epithelial, neuronal and myeloid tissue by insertion of tissue-specific miRNA target sequences into the 3'UTRs of essential RhCMV genes.

One of the main concerns of using a wildtype HCMV-based HIV vaccine is the potential for disease in immunocompromised fetuses, children and adults. HCMV can cause a variety of diseases in these individuals including CNS abnormalities, peripheral neuropathy, retinitis, and pneumonia (Pass, R. F. 2001. Cytomegalovirus. In Fields Virology. P. M. H. David M. Knipe, Diane E. Griffin, Robert A. Lamb Malcolm A. Martin, Bernard Roizman and Stephen E. Straus, editor. Philadelphia: Lippincott Williams & Wilkins. 2675-2705). The loss of epithelial cell tropism in RhCMV vectors may attenuate the development of pneumonia and retinitis though CNS disease remains a major concern. CNS disease is a major concern during congenital infection that can lead to hydrocephalous, malformation of the brain and deafness. Insertion of tissue specific miRNA target sequences into the poliovirus genome was shown to be extraordinarily effective in attenuating viral replication in the brain and mortality in mice providing a novel approach for vaccine development. Similarly, insertion of miRNA targets into the influenza genome also inactivates virus in tissues.

Some embodiments of the invention relate to specifically preventing CMV replication in macrophages by targeting an essential gene of the virus with an hematopoietic miRNA. The functionality of this approach was demonstrated for MCMV where expression of the essential IE3 gene was knocked down by miR 143 3p (FIGS. 21-25). The utility of this approach for targeting mRNA of essential genes of CMV for destruction by cellular miRNAs is described herein. Importantly, miRNAs are highly conserved between mice and humans (and therefore RM) making this approach feasible for other species (Larke, R. P., Wheatley, E., Saigal, S., and Chernesky, M. A. 1980. Congenital cytomegalovirus infection in an urban Canadian community. J Infect Dis 142: 647-653). A similar approach to construct CMV vectors attenuated for growth in the CNS by the use of neuron-specific miRNAs is utilized.

Another characteristic of CMV disease is dissemination of the virus into organs and this is considered to be mediated by macrophages. Macrophages and endothelial cells are considered to be sites of CMV persistence in the host so elimination of one of the reservoirs of the virus should still enable virus persistence (Jarvis, M. A., and Nelson, J. A. 2002. Human cytomegalovirus persistence and latency in endothelial cells and macrophages. Curr Opin Microbiol 5:403-407). Therefore, some embodiments of the invention relate to targeting myeloid replication to prevent CMV systemic dissemination.

An optimal CMV vector candidate will have wildtype immunogenicity, while being maximally attenuated for replication in the widest diversity of different cell types. CMV tissue knockout vectors targeted to prevent replication in the following tissues are generated: CNS, hematopoietic, CNS/epithelial, CNS/hematopoietic, epithelial/hematopoietic, and CNS/hematopoietic/epithelial.

In vitro tissue tropism characteristics of the CNS (RhCMVΔC/SIV) and hematopoietic (RhCMVΔH/SIV) tissue knockout viruses are generated and tested. The number of RM for immunogenicity studies may be conserved by making tissue tropism knockouts with both SIV gag, RhCMV/SIV (gag), and the SIV rev, tat and nef fusion protein, retanef, RhCMV/SIV(retanef) as previously described. The construction of these vectors is as follows:

RhCMVΔC/SIV(gag) and (retanef): To generate a RhCMV/SIV vaccine that cannot replicate in the CNS, 4 repeated target sequences (four 21mers) with exact complementarity to the neuronal miR-124 into the 3'UTR sequence of the RhCMV essential gene IE2 gene (Rh156 Ex5) of the RhCMV/SIV vectors are inserted. miR-124 in mouse, RM, and human are conserved at the nucleotide level (5'UAAGGCACGCGGUGAAUGCC3' (SEQ ID NO: 13)) (as further described on the website of miRBase, the microRNA database). In order to ensure a complete knockout of virus replication in this tissue, the miR-124 target sequences are inserted into the 3' UTR of DNA helicase gene (Rh142). For IE2 the miR-124 target sequences are inserted 18 base pairs down stream of the ORF, effectively the mid-point of the 3'UTR based on the predicted AATAAA polyadenylation signal or 78 base pairs down stream of Rh142 using BAC technology described above.

In each case overlapping ORFs are avoided to minimize the possibility of non-specific attenuation of the virus. Once constructed, each of the viruses are tested for gene expression levels of the target gene and attenuation of viral growth in fibroblast cells stably transfected with inducible constructs expressing each of the tissue specific miRNAs. RNA expression levels are tested by RT-PCR while protein expression levels of the target genes are monitored by western blot analysis. Virus growth is determined by both one-step and multistep growth curves, comparing the viruses containing the miRNA target versus the control viruses in primary cultures of RM fetal neuronal cultures in comparison to RFs. HCMV has been shown to replicate in neuronal cells in vitro (Luo, M. H., Schwartz, P. H., and Fortunato, E. A. 2008. Neonatal neural progenitor cells and their neuronal and glial cell derivatives are fully permissive for human cytomegalovirus infection. J Virol 82:9994-10007). Primary neuronal cultures from fetal RM brain tissue to isolate brain capillary endothelial cells are available with the Applicants. Viruses that exhibit growth in RFs but not neuronal cultures are tested for pathogenesis in as well as the T cell response.

RhCMVΔH/SIV(gag) and (retanef): To generate a RhCMV/SIV vector that cannot replicate in macrophages, four 21mers with exact complementarity to the hematopoietic cell miR-143-3p into the 3' UTRs of two RhCMV essential late genes are inserted: gH(Rh104) the essential glycoprotein receptor, and minor capsid protein (Rh117). The sequence of miR-143-3P for mouse, RM, and human are conserved at the nucleotide level (5'UGUAGUGUUUCCUACUUUAUGGA3' (SEQ ID NO: 14)) (as further described on the website of miRBase, the microRNA database). For gH the miR-143-3p target site is positioned 114 bp downstream of the ORF before the poly A sequence, and for Rh117 the target sequence is 30 bp downstream of the ORF. Since Rh111, 112, 114 and 118 use the same AATAAA polyadenylation signal as Rh117, all of these transcripts are expected to be knocked out in macrophages thereby increasing the effectiveness of the viral replication block.

The RhCMV essential late genes are targeted to prevent production of infectious virus, but permit expression of the SIV gag and retanef antigens in macrophages to allow appropriate gag and retanef antigen presentation to preserve vaccine vector immunogenicity. Viruses that exhibit growth in RF but not macrophages are tested for pathogenesis as well as T cell response in. Macrophages are prepared from RM peripheral blood as previously described (Söderberg-Naucler, C., Fish, K. N., and Nelson, J. A. 1997. Reactivation of latent human cytomegalovirus by allogeneic stimulation of blood cells from healthy donors. Cell 91:119-126).

Along with testing single tropism deficient RhCMV/SIV vectors, embodiments of the invention relate to constructing the multiple tropism deficient RhCMV vectors with gag and retanef combining the features of the epithelial, CNS and macrophage deficient tropisms. Such vectors and regions of growth deficiency are listed in Table 3:

TABLE 3

Vector construction and in vitro characterization

| Vector name | Growth Deficiency |
|---|---|
| (Single Tropism Deficient) | |
| RhCMVΔEpiCMAX/SIV(gag) and (retanef) | Epithelium |
| RhCMVΔC/SIV(gag) and (retanef) | CNS |
| RhCMVΔH/SIV(gag) and (retanef) | Hematopoietic |
| (Multiple Tropism Deficient) | |
| RhCMVΔEpiCMAXΔC/SIV(gag) and (retanef): | Epithelium/CNS |
| RhCMVΔCΔH/SIV (gag) and (retanef) | CNS/Hematopoietic |
| RhCMVΔEpiCMAXΔH/SIV (gag) and (retanef): | Epithelium/ Hematopoietic |
| RhCMVΔEpiCMAXΔCΔH/SIV(gag) and (retanef): | Epithelium/ Hematopoietic/ CNS |

Each of the multiple tropism deficient RhCMV/SIV vectors are tested in vitro for growth in RF in comparison to neuronal, epithelial, endothelial and macrophage cultures as described above.

Further embodiments of the invention relate to comparing the in vivo replication dynamics, persistence, secretion, immunogenicity, and pathogenicity of tropism-modified RhCMV/SIV vectors with that of wildtype RhCMV/SIV vectors.

During congenital infection, the CNS is a major target tissue resulting in hearing loss in the infant. In the immunosuppressed adult, direct infection of epithelial and endothelial cells results in GI, lung and retinal disease, respectively. In all cases myeloid cells are believed to be critical for dissemination of the virus through the host (Sopper, S., Nierwetberg, D., Halbach, A., Sauer, U., Scheller, C., Stahl-Hennig, C., Matz-Rensing, K., Schafer, F., Schneider, T., ter Meulen, V., et al. 2003. Impact of simian immunodeficiency virus (SIV) infection on lymphocyte numbers and T-cell turnover in different organs of rhesus monkeys. Blood 101:1213-1219). Using vectors that are deficient in their ability to replicate in multiple different cell types/tissues may impact the potential for CMV to cause multiple forms of virus-associated disease in all immunocompromised target populations (fetus and adult). Epithelial cells of the oral mucosa, breast and kidney are also major sites of virus shedding. The epithelial tropism defective vectors are additionally expected to impact shedding of virus into saliva and urine and breast milk. Decreased shedding is important for preventing environmental spread of vectors from initial vaccinees to non-vaccinated contacts. Embodiments of the invention relate to the identification of an optimal modified vector that is selected for efficacy trials. The selected vector is chosen based on its ability to induce and maintain a $T_{EM}$-biased immune response against their encoded SIV transgene comparable to wildtype RhCMV vectors, whilst showing decreased replication in tissues targeted by CMV during disease, and shedding (as described below).

A two-stage strategy for construction and analysis of tropism-modified vectors (as listed in Table 3). Single-tropism modified vectors: Embodiments of the invention relate to vectors are constructed that are individually deficient for replication in either epithelial cells [RhCMVΔEpiCMAX/SIV (gag) and (retanef)], CNS [RhCMVΔC/SIV(gag) and (retanef)] or myeloid (hematopoietic) cells RhCMVΔH/SIV(gag) and (retanef)]. Following in vitro characterization (see SA1), vectors that display the desired modified tropism phenotype are assessed for immunogenicity in adult/juvenile RMs and pathogenicity/tropism in the fetal model. Any single-tropism modified vector that shows unanticipated in vitro growth defects is rejected and is not further characterized. Similarly, lack of immunogenicity in adult RMs (i.e., the inability to induce a SIV-specific T cell response), or undesired in vivo tropism (based on analysis in the fetal model) will result in vector rejection.

Multiple-tropism modified vectors: Further embodiments of the invention relate to the construction of multiple-tropism modified vectors based on single-tropism vectors that show desired in vitro or in vivo modified tropism. After determining single-tropism modified vectors immunogenic in adult RMs and showing the desired in vivo tissue tropism in the fetal model, multiple-tropism vectors built on these genetic backgrounds, that show the desired multi-tissue in vitro tropism, will be analyzed in vivo in a comparable fashion to the single-tropism vectors. This group of multiple-tropism vectors comprises four constructs that are deficient for replication in the following multiple tissues: epithelial and myeloid cells [RhCMVΔEpiCMAXΔC/SIV(gag) and (retanef)], epithelial cells and CNS [RhCMVΔEpiCMAXΔC/SIV(gag) and (retanef)], myeloid cells and CNS [RhCMVΔHΔC/SIV(gag) and (retanef)], and all three target tissues [RhCMVΔEpiCMAXΔHΔC/SIV(gag) and (retanef)] (Table 3).

Aspects of the invention relate to the assessment of RhCMV/SIV vector immunogenicity. Initial immunological analysis is performed in groups of 3 RMs/vector (FIG. 26). Each group receives both gag and retanef versions of each vector as a mixture in a single inoculum. Vaccination of sero+ RMs with wildtype RhCMV/SIV vectors results in induction of a detectable T cell response against the SIV transgene in 100% of animals by 3 weeks post-infection as described previously. Any vector pair (individually encoding gag and retanef) that fails to induce a detectable T cell response against SIVgag or retanef by the time of boost at week 15 will considered to have "failed" on the basis of immunogenicity and need not be further characterized. For immunogenic vectors, all 3 RMs are boosted at week 15 with the gag-expressing vector only, thereby enabling characterization of both 'boosted' (gag) and non-boosted (retanef) responses. At the same time, 3 more RMs are recruited into the cohort and treated in an identical fashion as the first 3 animals, so as to supply sufficient statistical power for complete immunological characterization. All RM are followed immunologically and virologically for a total of 45 weeks post-initial vaccination (see FIG. 2 and below).

All RM are necropsied at week 48 for systemic quantification of SIV-specific T cell responses. A total of 24 RMs are available for immunogenicity testing of tropism-modified vectors (in addition to a control cohort of 6 RMs given wt RhCMV/gag×2 and RhCMV/retanef×1). This number of RM translates into several potential different in vivo testing scenarios depending on the final number of tropism-modified vectors that 'pass muster' and need complete evaluation. For example, 5 vectors may initially be tested in 3 RMs each, of which 3 are selected for complete immunological testing in an additional 3 RMs (to give a full complement of 6 RMs for each of the 3 vectors). Alternatively, 6 vectors may initially be tested in 3 RMs each, of which 2 of 6 (the most promising in terms of immunogenicity and/or attenuation) are then selected for complete immunological testing in an additional 3 RMs (to make a full complement of 6 RMs for each of the 2 vectors).

$CD4^+$ and $CD8^+$ T cell responses to the SIV proteins (gag and rev/nef/tat), negative control proteins (TB Ag85B protein), and RhCMV IE (+control) are quantified by cytokine flow cytometry (CFC) using overlapping, consecutive 15-mer peptide mixes comprising these proteins as previously described in Hansen, S. G., Vieville, C., Whizin, N., Coyne-Johnson, L., Siess, D. C., Drummond, D. D., Legasse, A. W., Axthelm, M. K., Oswald, K., Trubey, C. M., et al. 2009. Effector memory T cell responses are associated with protection of rhesus monkeys from mucosal simian immunodeficiency virus challenge. Nat Med 15:293-299.

This assay is applied to PBMC, lymph node (LN) and bronchioalveolar lavage lymphocytes [BAL, an easily accessible effector site, where RhCMV vector elicited responses are highly enriched] per the animal protocol (FIG. 26), and at necropsy to cell preparations obtained from at least 6 different peripheral LN groups, 3 different mesenteric LN groups, BAL, bone marrow, spleen, liver, jejunal/ileal/colonic mucosa, genital mucosa, and tonsil/adenoids. Routine assessment uses staining combination #1 (Table 4) in which the responding cells are delineated by up-regulation of CD69 and intracellular expression of TNF, γ-IFN and IL-2 (alone or in any combination), and simultaneously classified to their differentiation state by expression of CD28 vs. CCR7 (Picker, L. J., Reed-Inderbitzin, E. F., Hagen, S. I., Edgar, J. B., Hansen, S. G., Legasse, A., Planer, S., Piatak, M., Jr., Lifson, J. D., Maino, V. C., et al. 2006. IL-15 induces CD4 effector memory T cell production and tissue emigration in nonhuman primates. J Clin Invest 116:1514-1524.). Staining combination #2 is designed to detect changes in activation and proliferative status of Ag-specific T cells (defined by CD69, TNF and γ-IFN induction), and is used to precisely follow the response of established SIV-specific T cell populations to in vivo Ag exposure after boosting. Staining combination #3 analyzes MIP-1β and cytotoxic degranulation (CD107 externalization) in the context of memory subsets, and is selectively used to extend functional analysis of the response in PBMC at least once for each response prior to necropsy.

Embodiments of the invention relate to CFC assays being performed and in addition, relate to the gag- and rev/nef/tat-specific T cell responses that may be transcriptionally analyzed in PBMC and at necropsy in selected tissues by Ag-stimulated microarray analysis. In this approach, transcriptional changes associated with specific Ag versus control stimulation are compared at 3 and 12 hours post-stimulation to provide a detailed assessment of the functional programs of Ag-responding T cells.

TABLE 4

Standard CFC analyses for monitoring RhCMV/SIV vector immunogenicity
Ag-Specific Response Assays: Routine Staining Panel

| | PB | ACy | FITC | PE | ECD | TrR | PC7 | APC | A700 | AC7 | Comments |
|---|---|---|---|---|---|---|---|---|---|---|---|
| 1 | CCR7 | CD4 | TNF | IL2 | CD28* | CD69 | CD95 | IFNγ | CD3 | CD8 | TNF, IL2, IFNγ; central/effector memory |
| 2 | HLA-DR | CD4 | Ki-67 | PD-1 | CD25 | CD69 | TNF | IFNγ | CD3 | CD8 | TNF, IFNγ; in vivo activation |
| 3 | CCR7 | CD4 | **CD107\*\* | MIP-1β** | CD28* | CD69 | CD95 | TNF | CD3 | CD8 | TNF, MIP-1β; degranulation; cent./effec. mem. |

Notes:
PB = Pacific Blue:
ACy = AmCyan;
F = fluorescein;
PE = phycoarythrin;
ECD = PE-Texas Red;
TR = True Red (PerCP-Cy5.5);
APC = allophycocyanin;
A700 = Alexa700;
PC7 = PE-Cy7;
AC7 = APC-Cy7;
intracellular Ags are in bold;
*CD28 conjugate provided as co-stimulation along with CD49 mAb in stimulation culture;
CD107 conjugates also included with cells during incubation.

The success of each modified vector with respect to immunogenicity is primarily judged by the magnitude of total SIV-specific CD4+ and CD8+ T cells in PBMC, LN and BAL during the vaccine phase (peak and plateau) and the overall size of the SIV-specific CD4+ and CD8+ T cell populations in lymphoid tissues and effector sites at necropsy. Overall systemic response magnitude at necropsy is evaluated by determining the average frequency of SIV-specific T cells in each tissue at necropsy, and by using previous systemic T cell counting data (Halbach, A., Nierwetberg, D., Muller, J. G., Sauer, U., Kerkau, T., Stolte, N., Hofmann, P., Czub, S., ter Meulen, V., and Sopper, S. 2000. Total numbers of lymphocyte subsets in different lymph node regions of uninfected and SIV-infected macaques. J Med Primatol 29:148-157; Sopper, S., Nierwetberg, D., Halbach, A., Sauer, U., Scheller, C., Stahl-Hennig, C., Matz-Rensing, K., Schafer, F., Schneider, T., ter Meulen, V., et al. 2003. Impact of simian immunodeficiency virus (SW) infection on lymphocyte numbers and T-cell turnover in different organs of rhesus monkeys. Blood 101:1213-1219.) to calculate the total numbers of SIV-specific T cells in all sampled locations. These data are statistically analyzed using Wilcoxon rank sum test. Since RhCMV/SIV vector-elicited CD8+ T cell responses correlate most closely to efficacy and preference will be given to vectors eliciting the largest responses in this lineage, particularly when these populations are localized in SIV target cell-rich effector sites. Secondary criteria is the functional, phenotypic and transcriptional characteristics of the steady-state SW-specific T cell responses in chronic phase, with modified RhCMV/SIV vector-elicited T cell responses that most closely recapitulate wildtype RhCMV/SIV vector-elicited responses with respect to $T_{EM}$ phenotypic, functional and transcriptional attributes having priority.

Assessment of RhCMV/SIV vector shedding: Virologic quantification of vectors shed into the saliva and urine determines whether vectors exhibit decreased shedding from these sites. Titers of RhCMV vectors in saliva and urine, as well as blood is determined by quantitative RT-PCR by using either gag or retanef cassette specific primers. RhCMV-specific primers directed against RhCMV IE are used to quantify total RhCMV levels (irrespective of SIV transgene). Co-culture of either saliva or urine with permissive RFs followed by western analysis against either gag or retanef is used as additional maximally sensitive, but non-quantitative measure of vector detection.

Other embodiments of the invention relate to the assessment RhCMV/SIV fetal pathogenicity/tissue tropism: Vectors are also assessed for pathogenicity/tissue tropism in the fetal model. In vivo cellular tropism, as well as level of pathogenicity are critical parameters measured during analysis in this model. Genes are known to be differentially regulated in the fetus compared to the adult (Merkerova, M., Vasikova, A., Belickova, M., and Bruchova, H. MicroRNA expression profiles in umbilical cord blood cell lineages. Stem Cells Dev 19:17-26). Fetuses are inoculated with each RhCMV/SIV vector as described previously. The formalin-fixed/paraffin-embedded/H&E-stained tissue sections for RhCMV sequelae are evaluated, using standard methodologies. Tissues sections are examined in a blinded fashion and scored on a scale of normal to mild to severe. The pathogenic potential of vectors is assessed by using ultrasound and morphometrics (Chang, W. L., Tarantal, A. F., Zhou, S. S., Borowsky, A. D., and Barry, P. A. 2002. A recombinant rhesus cytomegalovirus expressing enhanced green fluorescent protein retains the wild-type phenotype and pathogenicity in fetal macaques. J Virol 76:9493-9504).

Analysis of vector distribution in different tissues by quantitative RT-PCR, and immunohistochemistry using antibodies directed against cellular markers, enables determination of whether tropism phenotypes persist in vivo. Antibodies used in these studies are directed against SIV and RhCMV antigens and RM cellular markers beta-III tubulin or neuronal marker neuronal nuclei (immature and mature neurons), glial fibrillary acid protein (astrocytes), vimentin (fibroblast), vWF or CD31 (endothelial cells), cytokeratin or zonula occludens-1 (epithelial cells), smooth muscle actin (smooth muscle cells), CD68 (macrophage), CD3 (T cells), and CD20 (B cells). Immunohistochemical staining for RhCMV IE1 is performed according to published protocols (Abel, K., Strelow, L., Yue, Y., Eberhardt, M. K., Schmidt, K. A., and Barry, P. A. 2008. A heterologous DNA prime/protein boost immunization strategy for rhesus cytomegalovirus. Vaccine 26:6013-6025; Lockridge, K. M., Sequar, G., Zhou, S. S., Yue, Y., Mandell, C. P., and Barry, P. A. 1999. Pathogenesis of experimental rhesus cytomegalovirus infection. J Virol 73:9576-9583; Bissel, S. J., Wang, G., Ghosh, M., Reinhart, T. A., Capuano, S., 3rd, Stefano Cole, K., Murphey-Corb, M., Piatak Jr, M., Jr., Lifson, J. D., and Wiley, C. A. 2002. Macrophages Relate Presynaptic and Postsynaptic Damage in Simian Immunodeficiency Virus Encephalitis. Am J Pathol 160:927-941; Sequar, G., Britt, W. J., Lakeman, F. D., Lockridge, K. M., Tarara, R. P., Canfield, D. R., Zhou, S. S., Gardner, M. B., and Barry, P. A. 2002. Experimental coinfection of rhesus macaques with rhesus cytomegalovirus and simian immunodeficiency virus: pathogenesis. J Virol 76:7661-7671).

Tissue sections are scored for IE1 staining on a flexible scale of none to minimal (isolated individual cells) to severe (extensive focal areas of staining) Staining protocols are done according to published and unpublished protocols as described in Batchelder, C. A., Lee, C. C., Matsell, D. G., Yoder, M. C., and Tarantal, A. F. 2009. Renal ontogeny in the rhesus monkey (Macaca mulatta) and directed differentiation of human embryonic stem cells towards kidney precursors. Differentiation 78:45-56; Abenes, G., Lee, M., Haghjoo, E., Tong, T., Zhan, X., and Liu, F. 2001. Murine cytomegalovirus open reading frame M27 plays an important role in growth and virulence in mice. J Virol 75:1697-1707; Carlson, J. R., Chang, W. L., Zhou, S. S., Tarantal, A. F., and Barry, P. A. 2005. Rhesus brain microvascular endothelial cells are permissive for rhesus cytomegalovirus infection. J Gen Virol 86:545-549; Mazumdar, K., Alvarez, X., Borda, J. T., Dufour, J., Martin, E., Bethune, M. T., Khosla, C., and Sestak, K. Visualization of transepithelial passage of the immunogenic 33-residue peptide from alpha-2 gliadin in gluten-sensitive macaques. PLoS One 5:e10228; Orzechowska, B. U., Manoharan, M., Sprague, J., Estep, R. D., Axthelm, M. K., and Wong, S. W. 2009. Viral interleukin-6 encoded by rhesus macaque rhadinovirus is associated with lymphoproliferative disorder (LPD). J Med Primatol 38 Suppl 1:2-7). All antibodies are directed to human antigens but have proven cross-reactivity with the RM orthologue.

Embodiments of the invention relate to the assessment of Efficacy against SIV Challenge. Based on all immunological, virological and fetal pathogenic/tropism characteristics, the most promising vectors are selected for use in efficacy trials in a low-dose intra-rectal SIVmac239 challenge model. For these efficacy trials, the remaining SIV constructs for a selected vector design (i.e., expressing env, pol I and II) are constructed so as to have a complete vector set for efficacy assessment. Criteria for vector selection for assessment in efficacy trials and the adult immunosuppression model are primarily based on levels of SIV-specific CD8+ $T_{EM}$ cells at effector mucosal tissue sites, as well as systemic immunogenicity, fetal pathogenicity/tissue tropism profile and shedding. Immunologically, an optimal vector induces and maintains comparable or higher levels of $T_{EM}$ biased responses in effector tissues against the SIV inserts. Virologically, the optimal vector has a minimal level of pathogenicity in the fetal pathogenicity model, and shows reduced shedding into saliva and urine.

Embodiments of the invention relate to pathogenicity testing in the Adult Immunosuppression Model: Gag-expressing versions of vectors selected for efficacy trials are analyzed for pathogenicity in the adult immune suppression model. This model uses iatrogenic immune suppression of adult seronegative animals undergoing primary RhCMV infection via the IV route. Importantly, this model enables characterization of the full pathogenic potential of RhCMV vectors in the primary anticipated target population (i.e., young human adults). All RM go to necropsy for assessment of vector pathology and tissue tropism, as described above for fetal model. These data extend evaluation of vector safety and provide additional criteria for selection of CMV vector designs for human translation.

Embodiments of the invention relate to the generation and characterization HCMV/HIV vectors corresponding to tropism-modified RhCMV/SIV vectors. HCMV/HIV vectors are constructed based on the RhCMV/SIV tropism deficient vectors that demonstrate the greatest attenuation without loss of SIV immunogenicity in RM described above. HCMV versions are constructed containing the same genetic modifications as the selected RhCMV vectors exhibit a comparable phenotype in vitro. This aspect of the invention relates to the construction of the HCMV/HIV vector rather than the construction of an HCMV/HIV vaccine that would be suitable for use in clinical studies. Although most of the RhCMV genes are functionally equivalent, HCMV does have some epithelial tropism genes that appear to be different from RhCMV (Dunn, W., Chou, C., Li, H., Hai, R., Patterson, D., Stolc, V., Zhu, H., and Liu, F. 2003. Functional profiling of a human cytomegalovirus genome. Proc Natl Acad Sci USA 100: 14223-14228.).

Although the RhCMV epithelial cell tropic genes rhUL128-131, Rh01, Rh159, Rh160, and, Rh203 have homologues in HCMV (UL128-131A, TRL, UL148, UL132, and US 22, respectively), only UL128-131A has been identified as an epithelial cell tropism gene in HCMV. The UL128-131A locus from HCMV is not deleted since deletion of these genes also eliminates infection of endothelial cells and macrophages. However, targeted mutagenesis of HCMV revealed that mutation of UL64 and US29 significantly reduced growth of HCMV in epithelial but not endothelial or human fibroblast (HF) cells as described previously. Therefore in the generation of the epithelial tropism-deficient virus these genes are ideal to target for deletion in the generation of an epithelial cell tropism-deficient HCMV vaccine. Translating the CNS and macrophage tropism-deficient RhCMV into HCMV is more straightforward since the genes selected for miRNA targeting are essential genes in both viruses. HCMV tropism deficient vectors are tested for their ability to replicate in epithelial, neuronal, endothelial and macrophage cultures in vitro to ensure the tropism defect. Importantly, these studies provide the construction 'blue-print' for the final HCMV/HIV vector to be used for clinical studies.

HCMV/HIV tropism deficient vaccine vectors are designed based on optimal attenuation and immunogenicity properties. 3-4 HCMV/HIV vaccine vectors that have combinations of altered tropism properties may be generated. The HCMV/HIV vaccines are constructed using the HCMV strain TR as the genetic backbone (Murphy, E., Yu, D., Grimwood, J., Schmutz, J., Dickson, M., Jarvis, M. A., Hahn, G., Nelson, J. A., Myers, R. M., and Shenk, T. E. 2003. Coding potential of laboratory and clinical strains of human cytomegalovirus. Proc Natl Acad Sci USA 100:14976-14981). This HCMV strain is a clinical isolate cloned as an infectious BAC that maintains diverse tropism for multiple cell types.

For epithelial tropism-deficient viruses HCMV genes known to be required for growth in these cell types are first targeted, including the UL64 and US29 (see above). Single and double deletion mutants of UL64 and US29 are generated using BAC technology. Whether the single or double UL64/US29 HCMV mutants exhibit restricted growth in epithelial cells (human retinal epithelial cells and Caco 2 cells) but not endothelial or HF cells is determined. The miRNA knockout strategy for inactivation of essential genes in CNS and macrophages is constructed using the approach described above with RhCMV. A combination of the tropism deficient phenotypes is incorporated into one or two vectors with the RhCMV/SIV multiple-tropism modified vectors. To determine whether the HCMV/HIV vectors exhibit the tropism defects predicted from the RhCMV/SIV studies, the growth properties of these viruses in a variety of different cell types including HF, epithelial and endothelial cells, primary neuronal cultures and macrophages are determined. The cell types including multiple micro- and macro-vascular endothelial cells, epithelial cells (retinal epithelial cells, Caco 2 cells), neuronal cells (SY5Y and SKMN cells), and primary macrophages generated from peripheral blood mononuclear cells (57) that are able to sustain HCMV replication are available to the Applicants. Single- and multi-step growth curves are performed with these cells to compare the replication efficiency of the HCMV/HIV tropism deficient vectors in comparison to wildtype virus.

Example 6

Development of a novel, non-reverting, single-dose oral polio vaccine to replace OPV. This example describes the use of the highly immunogenic cytomegalovirus (CMV)-based vaccine platform to develop a polio vaccine that will induce protective immunity against all the 3 poliovirus serotypes, but has no ability to 'revert' into a pathogenic form of poliovirus.

Background: Vaccination with either the 'killed', inactivated polio vaccine (IPV) or 'live' attenuated oral polio vaccine (OPV) has resulted in a dramatic decrease in the incidence of polio-associated flaccid paralytic paralysis worldwide. Due to a number of characteristics (such as low cost of production, oral administration and induction of mucosal immunity) OPV was selected over IPV for the Global Polio Eradication Initiative (GPEI) in 1988. Since initiation of the GPEI program, OPV vaccination has resulted in a dramatic reduction in polio-associated paralysis from >350,000 cases in 125 countries to <100 in 4 endemic countries (as of March, 2011). With global eradication of wildtype poliovirus imminent, followed by the planned stoppage of vaccination, 'reversion' of OPV into paralytic forms of poliovirus becomes the last remaining hurdle. OPV reversion results from genetic mutation of residual circulating 'live' OPV into a paralytic form of the virus, and is the sole reason for the need of an 'endgame' strategy.

The capacity of OPV reversion to cause disease out-breaks is a 'real-world' problem, which is already occurring in developing countries with poor vaccine coverage. Implementation of 'killed' IPV vaccination has been proposed as one possible endgame strategy to tackle OPV reversion, with IPV vaccination being maintained until OPV is no longer circulating within the human population. Although this strategy may be potentially effective, the cost of IPV vaccination (which has an high cost of production, and requires a needle and trained medical staff for administration) makes this approach prohibitively expensive for use in poorer nations. Embodiments of the invention relate to an alternative endgame strategy using a CMV-based polio vaccine that has all the positive attributes of OPV, but with no possibility for reversion since it is not based on a poliovirus genetic background.

OPV was chosen for global poliovirus eradication due to its suitability for use in all nations, both rich and poor. CMV potentially shares all the characteristics that made OPV the vaccine of choice for global poliovirus eradication, but without the down-side of OPV reversion: 1) the capacity for oral administration by medically untrained individuals, 2) inexpensive manufacturing without costly chemical inactivation steps and quality control associated with IPV, and 3) high immunogenicity, inducing mucosal immunity (cellular and antibody) that can block poliovirus replication in the gut. CMV enjoys several additional beneficial qualities for use as a polio vaccine. CMV can re-infect healthy individuals regardless of CMV seropositivity.

This ability to re-infect regardless of pre-existing vaccine vector immunity is a decided advantage over other vaccines including OPV, where immunity against the vector or cross-reactivity with pathogens present in the environment (i.e., enteroviruses for OPV), severely limits the 'take' of the vaccine. CMV is also benign in healthy individuals, and immunogenicity does not require CMV replication. However, CMV does cause disease in immunosuppressed individuals, such as transplant patients and neonates. In these immunosuppressed populations, CMV replication is an absolute requirement for pathogenicity: no replication equals no disease. The dissociation of CMV immunity from CMV replication is a critical finding as it suggests that a replication-defective CMV-based polio vaccine will be immunogenic and safe in all human populations regardless of immune-status. Finally, CMV vaccines work. Recent studies in rhesus macaque (RMs) show that rhesus CMV (RhCMV) expressing simian immunodeficiency (SIV) antigens induce protection against SIV infection. This is the first vaccine against SIV or HIV that has been shown to induce protection against infection. Moreover, protection against SIV was long-lived (observed at >486 days post-vaccination).

Figure 27:
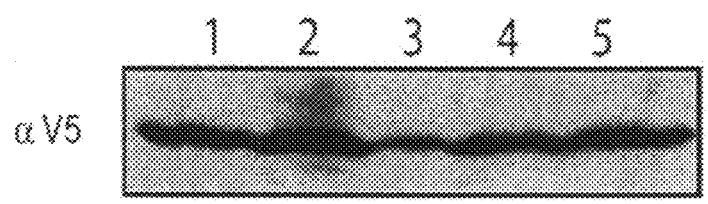
FIG. 27 is an image of a gel showing that MCMV/VP1$_{PVI}$ stably expresses VP1 in vitro.

Embodiments of the invention relate to assessing the ability of a MCMV-based polio vaccine expressing a protective target antigen from poliovirus type 1 to induce protective immunity against poliovirus in mice. A recombinant MCMV stably expressing full-length viral protein 1 (VP1) from poliovirus type 1 (MCMV/VP1PV1) is constructed (FIG. 27). Following immunological characterization of MCMV/VP1PV1, protective efficacy of MCMV/VP1PV1 against poliovirus type 1 in the mouse poliovirus receptor (PVR) transgenic (Tg) mouse challenge model will be determined. A MCMV-based poliovaccine is only used as a 'proof-of-concept' for development of a human CMV-based poliovirus vaccine for use in humans.

FIG. 27 shows that VP1 in MCMV/VP1$_{PV1}$ is epitope tagged (V5) for ease of detection. MCMV/VP1$_{PV1}$ was serial passaged multiple times in murine embryo fibroblasts (MEFs) Cells are harvested at the time of maximum cytopathic effect (CPE) for analysis of VP1 expression based on anti-V5 reactivity. Serial passage numbers are indicated above the image of the gel.

Other embodiments of the invention relate to assessing the ability of a dissemination-defective version of MCMV/VP1PV1 to induce protective immunity against poliovirus type 1 in the PVR Tg model. A dissemination-defective version of MCMV/VP1PV1 (for example, MCMVΔgL/VP1PV1) will be made by deletion of an essential MCMV gene (glycoprotein L, gL) by standard bacterial artificial chromosome (BAC) recombination. This strategy, followed by complementation on a gL-expressing cell line, has been shown to be a straightforward technique for making dissemination-defective CMV viruses (Snyder, C. M., J. E. Allan, E. L. Bonnett, C. M. Doom, and A. B. Hill. 2010. Cross-presentation of a spread-defective MCMV is sufficient to prime the majority of virus-specific CD8+ T cells. PLoS One 5:e9681.) (Bowman, J. J., J. C. Lacayo, P. Burbelo, E. R. Fischer, and J. I. Cohen. 2011. Rhesus and human cytomegalovirus glycoprotein L are required for infection and cell-to-cell spread of virus but cannot complement each other. J Virol 85:2089-99). Immunogenicity and protective efficacy of MCMVΔgL/VP1PV1 against poliovirus type 1 challenge are determined as described above.

CMV vectors may express a variety of different target antigens suggesting that CMV/VP1PV1 vectors will induce substantial and highly durable VP1-specific CD4 and CD8 T cell responses. The ability of OPV, but not IPV, to prevent establishment of poliovirus infection in the gut underlines the importance of cellular immunity for poliovirus control.

CMV/VP1PV1 vectors may induce durable levels of VP1-specific antibodies and these vectors are further tested to determine if these antibodies are neutralizing. Both protein and synthetic peptides from VP1 are able to induce biologically significant levels of neutralizing antibodies (albeit at lower levels than induced by intact virus). The antibody response induced by CMV/VP1PV1 vectors may be neutralizing, but perhaps to a lower level than observed with OPV or IPV vaccination. Since CMV/VP1PV1 vectors are expected to induce high levels of T cells (systemic as well as mucosal) and a biologically significant level of VP1-specific neutralizing antibodies, both CMV/VP1PV1 and CMVΔgL/VP1PV1 may protect against poliovirus type 1 challenge.

Embodiments of the invention relate to establishing that a safe, dissemination-defective CMV-based vector can induce protective immunity against poliovirus type 1, determine whether replicating CMV-based vector (MCMV/VP1PV1) is immunogenic and efficacious against poliovirus type 1 challenge and using MCMVΔgL/VP1PV1 to establish that dissemination is not required for immunogenicity or efficacy of a CMV-based polio vaccine. Further embodiments relate to demonstrating that a dissemination-defective CMV-based vector induces protective immunity against poliovirus type 1 hence establishing that CMV dissemination is not required for vaccine efficacy. This finding 'paves the way' for development of a safe CMV-based polio vaccine for use in all potential human target populations worldwide. Non-human primate poliovirus models were crucial during OPV and IPV development, and will be critical for moving CMV-based polio vaccine towards human trials. Additional embodiments also relate to determining immunogenicity and protective efficacy of dissemination-defective RhCMVΔgL/VP1PV1 in RM and determining whether monovalent RhCMVΔgL/VP1 vectors each expressing a VP1 gene from one of the three poliovirus serotypes, or a single multivalent RhCMVΔgL/VP1 expressing all 3 serotypes together can induce protection against all 3 poliovirus serotypes. The construction of an human HCMVΔgL/VP1 version of most efficacious trivalent vaccine for human Phase I trials is also encompassed in this invention.

Example 7

A Cytomegalovirus-based Vaccine Encoding a Single Ebola Virus Nucleoprotein CTL Epitope Confers Protection Against Ebola Virus. This Example demonstrates the ability of a CMV-based vaccine approach to protect against an highly virulent human pathogen.

Summary: In the present Example Applicants have constructed a MCMV-based EBOV vector expressing a single CTL epitope from NP of Zaire ebolavirus ZEBOV (MCMV/ZEBOV-NP$_{CTL}$). MCMV/ZEBOV-NP$_{CTL}$ was shown to be highly immunogenic, inducing durable, multi-functional CD8$^+$ CTL responses against ZEBOV NP in multiple strains of mice. Importantly, MCMV/ZEBOV-NP$_{CTL}$ conferred protection against lethal ZEBOV challenge to a comparable level as a standard 'benchmark' EBOV vaccine. Absence of neutralizing antibodies in protected animals identified protection as being T cell-mediated.

Background: Human outbreaks of hemorrhagic disease caused by Ebola virus (EBOV) are a serious human health concern. EBOV, a member of the Filoviridae family, causes rapidly progressing viral hemorrhagic fever culminating in multi-organ failure, shock and death [Feldmann H, Geisbert T W (2010) Ebola haemorrhagic fever. Lancet]. EBOV can be subdivided into four distinct and a fifth putative species [Feldmann H, Geisbert T W, Jahrling P B, al. e (2004) In: Fauquet C, Mayo M A, Maniloff J, Desselberger U, Ball L A, editors. Virus Taxonomy: VIIIth Report of the International Committee on Taxonomy of Viruses. London: Elsevier/Academic Press. pp. 645-653, Towner J S, Sealy T K, Khristova M L, Albarino C G, Conlan S, et al. (2008) Newly discovered ebola virus associated with hemorrhagic fever outbreak in Uganda. PLoS Pathog 4: e1000212]. EBOV species differ in level of virulence, with Zaire ebolavirus (ZEBOV) being the most virulent (80-90% mortality) [Sanchez A, Geisbert T W, Feldmann H (2006) Filoviridae: Marburg and Ebola Viruses. In: Knipe D M, Howley P M, editors. Fields Virology. 5th ed. Philadelphia: Lippincott Williams & Wilkins. pp. 1409-1448]. The increasing frequency of outbreaks in endemic areas of Africa, combined with potential for accidental and deliberate introduction into non-endemic nations makes EBOV an ever-increasing global health concern. Potential for rapid dissemination to non-endemic countries was demonstrated in 2008 by importation of Marburg virus (a filovirus closely related to EBOV) to the US [WHO (2009) Case of Marburg Haemorrhagic Fever imported into the United States] and Netherlands [WHO (2008) Case of Marburg Haemorrhagic Fever imported into the Netherlands from Uganda] by tourists infected in Uganda.

A number of candidate EBOV vaccines have been developed that are protective against infection in animal models [Falzarano D, Geisbert T W, Feldmann H (2011) Progress in filovirus vaccine development: evaluating the potential for clinical use. Expert review of vaccines 10: 63-77, Geisbert T W, Bausch D G, Feldmann H (2010) Prospects for immunisation against Marburg and Ebola viruses. Reviews in medical virology 20: 344-357]. Replication-defective adenovirus expressing EBOV glycoprotein (GP) alone [Sullivan N J, Geisbert T W, Geisbert J B, Shedlock D J, Xu L, et al. (2006) Immune protection of nonhuman primates against Ebola virus with single low-dose adenovirus vectors encoding modified GPs. PLoS Med 3: e177] or in combination with nucleoprotein (NP) [Sullivan N J, Geisbert T W, Geisbert J B, Xu L, Yang Z Y, et al. (2003) Accelerated vaccination for Ebola virus haemorrhagic fever in non-human primates. Nature 424: 681-684], virus-like particles comprised of virus matrix protein (VP40) and GP with or without NP [Warfield K L, Swenson D L, Olinger G G, Kalina W V, Aman M J, et al. (2007) Ebola virus-like particle-based vaccine protects nonhuman primates against lethal Ebola virus challenge. The Journal of infectious diseases 196 Suppl 2: S430-437, Swenson D L, Warfield K L, Negley D L, Schmaljohn A, Aman M J, et al. (2005) Virus-like particles exhibit potential as a pan-Filovirus vaccine for both Ebola and Marburg viral infections. Vaccine 23: 3033-3042], and replication-competent vesicular stomatitis virus (VSV) expressing GP [Jones S M, Feldmann H, Stroher U, Geisbert J B, Fernando L, et al. (2005) Live attenuated recombinant vaccine protects nonhuman primates against Ebola and Marburg viruses. Nat Med 11: 786-790, Geisbert T W, Geisbert J B, Leung A, Daddario-DiCaprio K M, Hensley L E, et al. (2009) Single-injection vaccine protects nonhuman primates against infection with marburg virus and three species of ebola virus. J Virol 83: 7296-7304] are all able to consistently induce protective immunity in small animal and non-human primate (NHP) models. Oral immunization with the VSV-based vaccine has been shown to induce protection in mice [Jones S M, Stroher U, Fernando L, Qiu X, Alimonti J, et al. (2007) Assessment of a vesicular stomatitis virus-based vaccine by use of the mouse model of Ebola virus hemorrhagic fever. J Infect Dis 196 Suppl 2: S404-412], leading to the suggestion of its use for food baiting [Groseth A, Feldmann H, Strong J E (2007) The ecology of Ebola virus. Trends Microbiol 15: 408-416, Dolgin E (2008) Baiting Ebola. The Scientist 22: 22].

A cytomegalovirus (CMV)-based vaccine offers an alternative approach. CMV is one of the most immunogenic viruses known [Sylwester A W, Mitchell B L, Edgar J B, Taormina C, Pelte C, et al. (2005) Broadly targeted human cytomegalovirus-specific CD4+ and CD8+ T cells dominate the memory compartments of exposed subjects. J Exp Med 202: 673-685], inducing a characteristic immune response that is highly enriched for 'effector' ($T_{EM}$) T cells [Hansen S G, Vieville C, Whizin N, Coyne-Johnson L, Siess D C, et al. (2009) Effector memory T cell responses are associated with protection of rhesus monkeys from mucosal simian immunodeficiency virus challenge. Nature medicine 15: 293-299]. These cells localize predominantly to extra-lymphoid mucosal sites, and are functionally primed for immediate anti-pathogen effector function [Kaech S M, Wherry E J (2007) Heterogeneity and cell-fate decisions in effector and memory CD8+ T cell differentiation during viral infection. Immunity 27: 393-405]. A CMV-based vaccine may be related to prevention of systemic infection of rhesus macaques by simian immunodeficiency virus (SIV), a NHP model for HIV, which is the first vaccine to prevent acquisition of fully pathogenic SIV [Hansen S G, Vieville C, Whizin N, Coyne-Johnson L, Siess D C, et al. (2009) Effector memory T cell responses are associated with protection of rhesus monkeys from mucosal simian immunodeficiency virus challenge. Nature medicine 15: 293-299].

Figure 32:
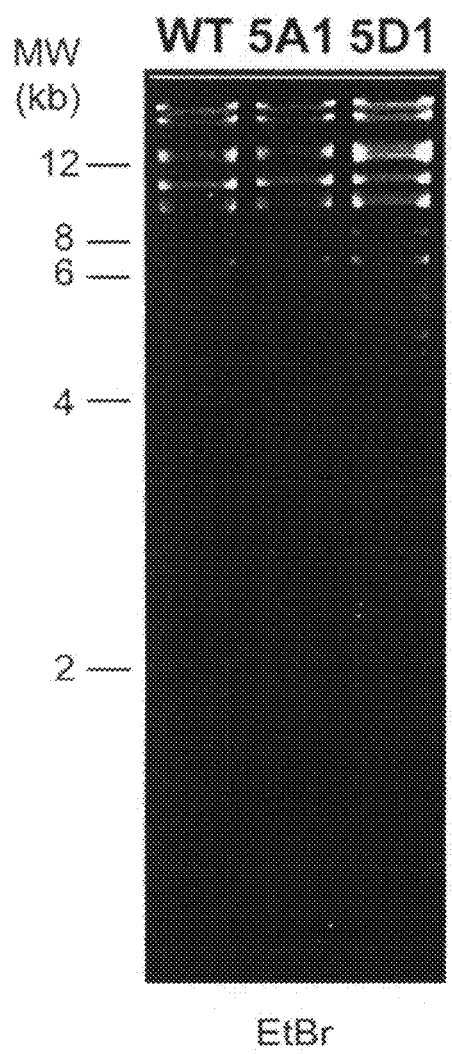
FIG. 32 is a gel showing a WT control and two independent clones of MCMV/ZEBOV-NP$_{CTL}$ (5A1 and 5D1) digested with EcoRI followed by electrophoresis.
Figure 33:
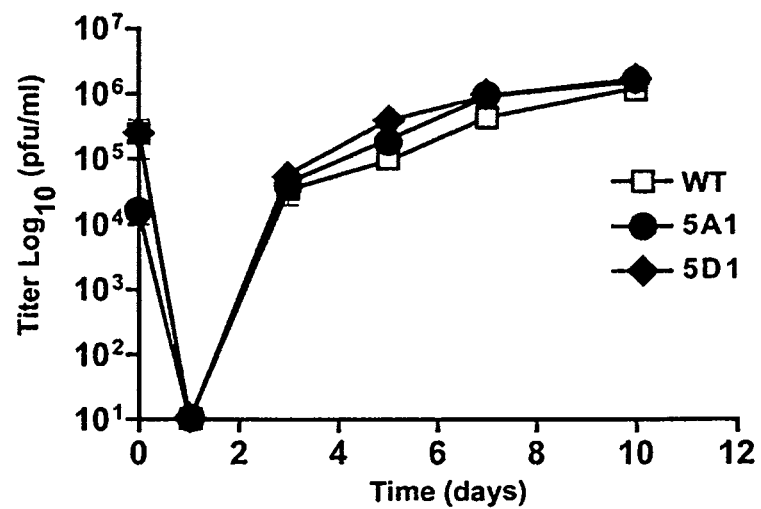
FIG. 33 shows the Multi-step growth analysis of MCMV/ZEBOV-NP$_{CTL}$.

To assess the potential of CMV for development as a vaccine against EBOV, Applicants designed a murine cytomegalovirus (MCMV)-based EBOV vaccine (MCMV/ZEBOV-$NP_{CTL}$) expressing a $CD8^+$ CTL epitope from ZEBOV NP (43-VYQVNNLEEIC-53 (SEQ ID NO: 15); $NP_{43}$) [Wilson J A, Hart M K (2001) Protection from Ebola virus mediated by cytotoxic T lymphocytes specific for the viral nucleoprotein. J Virol 75: 2660-2664, Olinger G G, Bailey M A, Dye J M, Bakken R, Kuehne A, et al. (2005) Protective cytotoxic T-cell responses induced by venezuelan equine encephalitis virus replicons expressing Ebola virus proteins. J Virol 79: 14189-14196, Simmons G, Lee A, Rennekamp A J, Fan X, Bates P, et al. (2004) Identification of murine T-cell epitopes in Ebola virus nucleoprotein. Virology 318: 224-230] fused to a non-essential MCMV protein, IE2 (FIG. 1a). MCMV/ZEBOV-$NP_{CTL}$ was constructed by E/T recombination using a bacterial artificial chromosome (BAC) containing the MCMV genome (pSM3fr) [Hansen S G, Vieville C, Whizin N, Coyne-Johnson L, Siess D C, et al. (2009) Effector memory T cell responses are associated with protection of rhesus monkeys from mucosal simian immunodeficiency virus challenge. Nature medicine 15: 293-299, Wagner M, Jonjic S, Koszinowski U H, Messerle M (1999) Systematic excision of vector sequences from the BAC-cloned herpesvirus genome during virus reconstitution. J Virol 73: 7056-7060]. Independent pMCMV/ZEBOV-$NP_{CTL}$ clones (5A1 and 5D1) were selected for characterization. Restriction enzyme digestion followed by electrophoresis showed no gross genomic rearrangements compared to wild-type (WT) parental BAC (FIG. 32). Viruses were reconstituted by transfection of BAC DNA into murine embryo fibroblasts (MEFs). In vitro growth analysis of reconstituted viruses showed replication kinetics comparable to WT MCMV (FIG. 33).

Figure 28C:
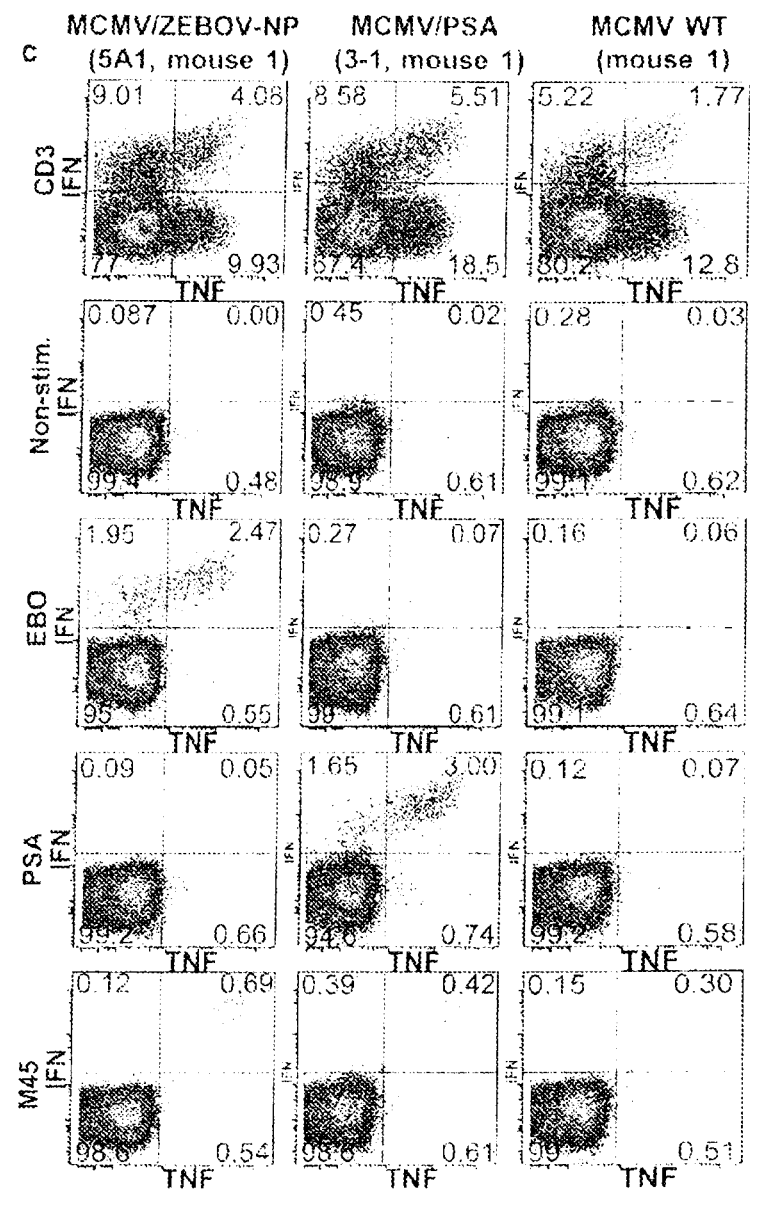

To assess the level of NP-specific $CD8^+$ CTL responses induced by MCMV/ZEBOV-$NP_{CTL}$, Applicants performed immunogenicity studies in $H2^b$-restricted 129S1/SvlmJ/Cr mice. Mice (n=5/group) were immunized intraperitoneally (i.p.) with MCMV/ZEBOV-$NP_{CTL}$ (clone 5A1 or 5D1), MCMV/PSA (clone 3-1) (a control MCMV expressing an irrelevant $H2^b$-restricted epitope from human prostate-specific antigen, PSA [Pavlenko M, Leder C, Roos A K, Levitsky V, Pisa P (2005) Identification of an immunodominant H-2D (b)-restricted CTL epitope of human PSA. Prostate 64: 50-59]), WT MCMV or diluent (Mock). Following a 'boost' using an identical inoculum at week 4, splenocytes were harvested at week 8 for analysis of T cell responses (FIG. 28B). Antigen-specific T cells were analyzed by intracellular cytokine staining (ICS) after a 6 hour in vitro incubation with peptides representing different $H2^b$-restricted epitopes. All MCMV/ZEBOV-$NP_{CTL}$ vaccinated mice exhibited significant $CD8^+$ CTL responses against ZEBOV NP (FIG. 28B). The level of NP responses elicited by 5A1 and 5D1 were not significantly different, and were considered together as a single data set. The ZEBOV NP-specific T cell responses induced were substantial (mean=2.83% of total $CD8^+$ T cells; range=0.32 to 5.99%), $CD8^+$ (no response in $CD4^+$ cell compartment), and specific (directed against ZEBOV NP, but not PSA control). $CD8^+$ CTLs induced against ZEBOV NP were polyfunctional, expressing both IFNγ and TNFα (FIG. 28C). All mice except mock-vaccinated controls had $CD8^+$ CTLs directed against the MCMV-encoded M45 protein.

Figure 29:
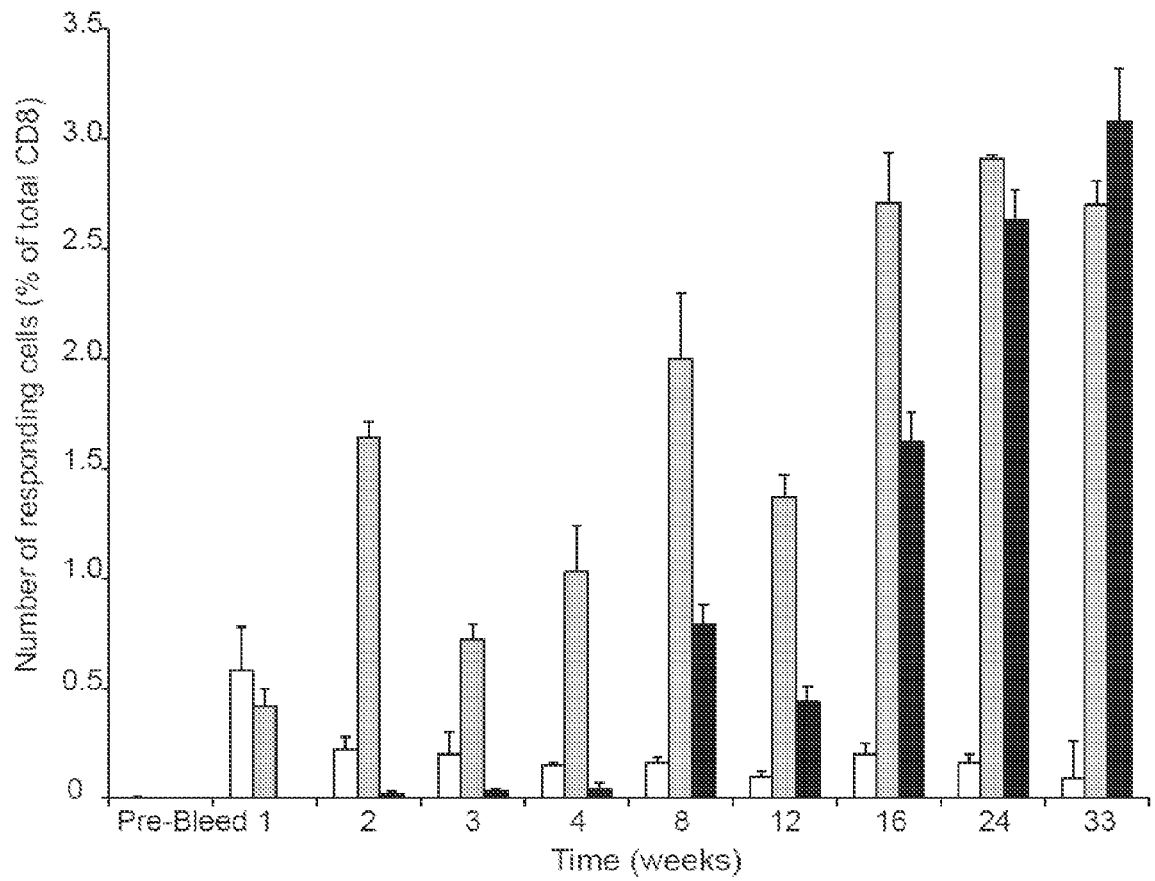
FIG. 29 a graph representing the kinetic analysis of CD8$^+$ T cell response to MCMV/ZEBOV-NP$_{CTL}$.

A unique characteristic of CMV-induced immune responses is their 'inflation' over time with maturation into stable 'effector' T cell ($T_{EM}$) memory that persists for life [Klenerman P, Dunbar P R (2008) CMV and the art of memory maintenance. Immunity 29: 520-522]. Compared to classical central T cell memory ($T_{CM}$) induced by acute or non-replicating vectors such as vaccinia virus and adenovirus, $T_{EM}$ are localized to mucosal epithelial effector sites, and have immediate effector function [Cheroutre H, Madakamutil L (2005) Mucosal effector memory T cells: the other side of the coin. Cell Mol Life Sci 62: 2853-2866, Sallusto F, Lenig D, Forster R, Lipp M, Lanzavecchia A (1999) Two subsets of memory T lymphocytes with distinct homing potentials and effector functions. Nature 401: 708-712]. To determine the durability of ZEBOV NP-specific T cell responses from a single MCMV/ZEBOV-$NP_{CTL}$ inoculation, mice (n=14) were vaccinated (i.p.) with MCMV/ZEBOV-$NP_{CTL}$, and peripheral T cell responses were followed longitudinally. NP-specific $CD8^+$ T cell responses gradually accumulated to high levels and persisted (increasing from 0.79% at week 8, to 3.08% at 33 weeks following the single inoculation) (FIG. 29). Although delayed, the NP-specific CTL response was comparable in kinetics of induction and magnitude to the $T_{EM}$-biased 'inflationary' response directed against MCMV M38 [Munks M W, Cho K S, Pinto A K, Sierro S, Klenerman P, et al. (2006) Four distinct patterns of memory CD8 T cell responses to chronic murine cytomegalovirus infection. J Immunol 177: 450-458, Karrer U, Sierro S, Wagner M, Oxenius A, Hengel H, et al. (2003) Memory inflation: continuous accumulation of antiviral CD8+ T cells over time. J Immunol 170: 2022-2029]. Importantly, these results show that a CMV-based EBOV vaccine can induce high levels of $CD8^+$ T cells against an EBOV antigen that increase with time and are durable.

Figure 30:
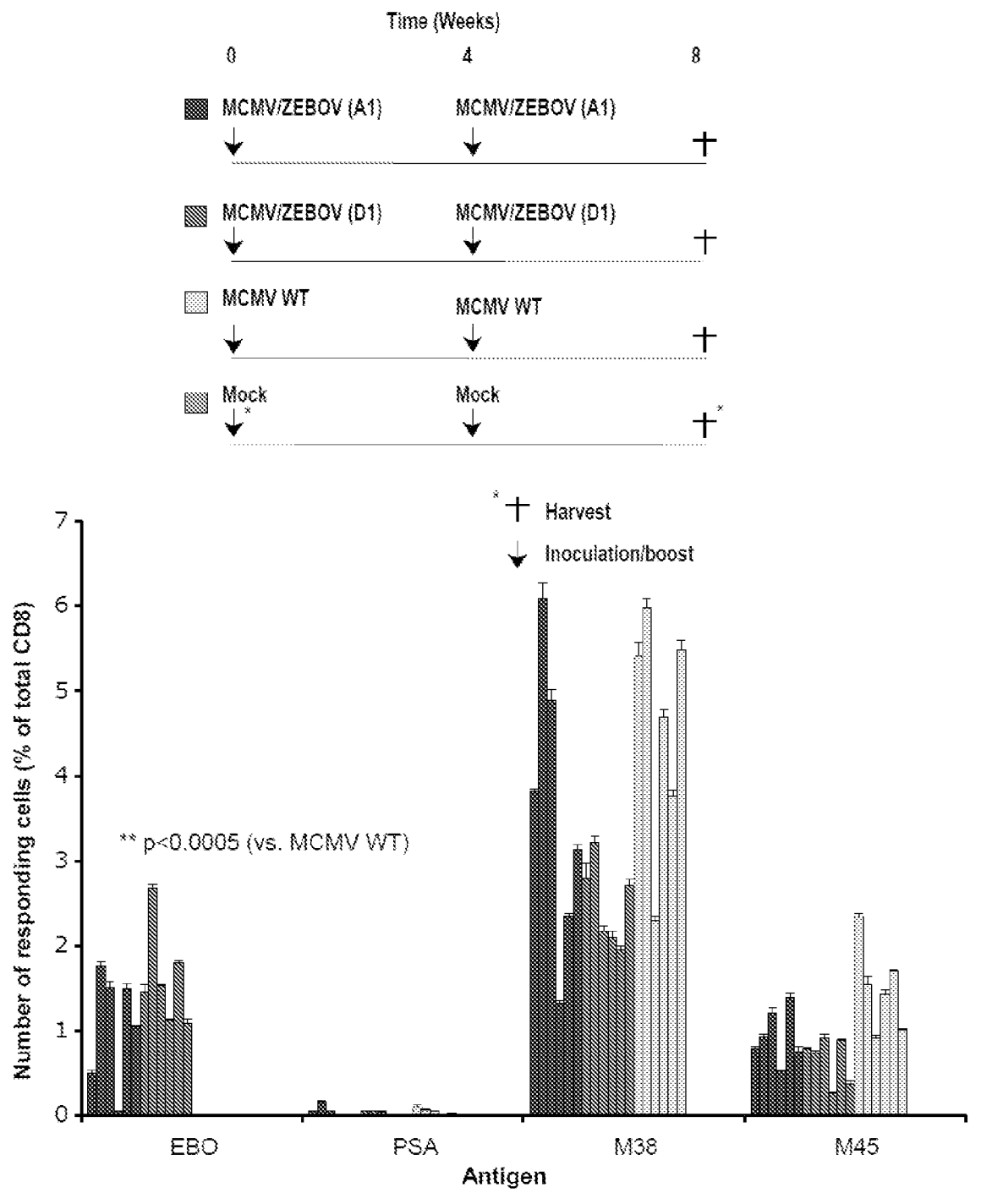

To determine whether MCMV/ZEBOV-$NP_{CTL}$ was able to induce protective immunity against lethal ZEBOV challenge, Applicants performed challenge studies in C57BL/6 mice using mouse-adapted ZEBOV (ma-ZEBOV) as the challenge virus [Jones S M, Stroher U, Fernando L, Qiu X, Alimonti J, et al. (2007) Assessment of a vesicular stomatitis virus-based vaccine by use of the mouse model of Ebola virus hemorrhagic fever. J Infect Dis 196 Suppl 2: S404-412, Bray M, Davis K, Geisbert T, Schmaljohn C, Huggins J (1998) A mouse model for evaluation of prophylaxis and therapy of Ebola hemorrhagic fever. J Infect Dis 178: 651-661]. The ma-ZEBOV is uniformly lethal in unvaccinated mice, which succumb 5-7 days post-challenge [Jones S M, Stroher U, Fernando L, Qiu X, Alimonti J, et al. (2007) Assessment of a vesicular stomatitis virus-based vaccine by use of the mouse model of Ebola virus hemorrhagic fever. J Infect Dis 196 Suppl 2: S404-412, Bray M, Davis K, Geisbert T, Schmaljohn C, Huggins J (1998) A mouse model for evaluation of prophylaxis and therapy of Ebola hemorrhagic fever. J Infect Dis 178: 651-661]. Four groups of mice (n=20/group) were immunized with MCMV/ZEBOV-NP$_{CTL}$ 5A1 or 5D1, MCMV WT or diluent, and boosted at week 4 (FIG. 30). At week 8, splenocytes from 6 mice/group were analysed for T cell responses. 5A1 and 5D1 induced comparable responses against NP, enabling mice receiving either clone to be considered as a single data set. MCMV/ZEBOV-NP$_{CTL}$ induced considerable levels of CD8$^+$ T cells against ZEBOV NP (mean=1.34% of total CD8$^+$ T cells; range=0.05 to 2.68%). These results also show that the ability of MCMV/ZEBOV-NP$_{CTL}$ to induce NP-specific T cells is independent of the mouse strain (FIG. 28C and FIG. 30). All mice except mock-vaccinated controls had CD8$^+$ CTLs directed against MCMV-encoded M38 and M45.

At week 10, the remaining mice (n=14/group) were challenged i.p. with 10$^3$ LD$_{50}$ of ma-ZEBOV. An additional group (n=14) that had received VSVΔG/ZEBOVGP (5×10$^5$ pfu; i.p.), which confers high levels of protection against ma-ZEBOV, was included as a control for vaccine protection [Jones S M, Stroher U, Fernando L, Qiu X, Alimonti J, et al. (2007) Assessment of a vesicular stomatitis virus-based vaccine by use of the mouse model of Ebola virus hemorrhagic fever. J Infect Dis 196 Suppl 2: S404-412.]. ZEBOV disease was then monitored on the basis of survival, morbidity based on clinical signs (ruffled fur, hunched posture, paralysis and weight loss) and viremia. Mock and MCMV WT vaccinated controls exhibited normal ZEBOV disease, with significant morbidity (FIG. 31B); they succumbed to infection within the normal time (mode=7 days) post-challenge (FIG. 31A). In contrast, MCMV/ZEBOV-NP$_{CTL}$ vaccinated mice showed no evidence of ZEBOV disease, with 100% survival and no signs of morbidity (FIGS. 31A-B). As a quantitative analysis of vaccine efficacy, viremia at day 4 post-challenge (peak of ZEBOV viremia in mice) was measured in a subset of mice (n=3-4/group) harvested at this time (FIG. 31C). MCMV/ZEBOV-NP$_{CTL}$ vaccination resulted in a profound level of control, with viremia reduced to levels observed for the VSVΔG/ZEBOVGP controls. Specifically, 5 of 8 mice showed a complete control of ZEBOV viremia down to undetectable levels (sterilizing immunity). The remaining 3 mice showed a 2.5-log reduction in viremia compared to WT MCMV vaccinated controls. MCMV/ZEBOV-NP$_{CTL}$ vaccination does not induce ZEBOV neutralizing antibodies, as would be expected from expression of a single 11-mer CTL epitope of NP. However, low levels of ma-ZEBOV replication following challenge could feasibly have induced neutralizing antibodies which would positively impact disease resolution. To determine whether protection resulted entirely from T cell-mediated control, Applicants measured ma-ZEBOV neutralizing activity in sera from a randomly selected subset (n=6) of protected MCMV/ZEBOV-NP$_{CTL}$ mice at 28 days post-challenge. VSVΔG/ZEBOVGP control mice had low, but detectable levels of neutralizing activity following challenge [Jones S M, Stroher U, Fernando L, Qiu X, Alimonti J, et al. (2007) Assessment of a vesicular stomatitis virus-based vaccine by use of the mouse model of Ebola virus hemorrhagic fever. J Infect Dis 196 Suppl 2: S404-412]. In contrast, neutralizing activity was not detected in any convalescent serum from MCMV/ZEBOV-NP$_{CTL}$ vaccinated mice demonstrating that protection was mediated solely by CD8$^+$ T cells (FIG. 33).

Conclusions: Applicants demonstrate that a CMV-based vaccine can afford protection against ZEBOV—the first study to show that a CMV-based vaccine can protect against any human disease. The level of protection was profound, with ZEBOV control comparable to that achieved by one of the 'benchmark' vaccines, VSVΔG/ZEBOVGP. This level of ZEBOV control, achieved using a CMV vector expressing only a single CTL epitope, underscores the potential of this vaccine platform.

FIG. 28 depicts T cell responses following immunization with MCMV/ZEBOV-NP$_{CTL}$. (a) Schematic representation of MCMV/ZEBOV-NP$_{CTL}$. An H2$^b$-restricted T cell epitope from ZEBOV NP (VYQVNNLEEIC (SEQ ID NO: 15)) was fused 'in-frame' to the carboxyl terminus of MCMV IE2 (M122) generating the recombinant MCMV, MCMV/ZEBOV-NP$_{CTL}$. MCMV IE2 is a non-essential protein. (b) 129S1/SvlmJ/Cr (H2$^b$-restricted) mice (n=5/group) were immunized intraperitoneally (i.p.) using 5×10$^5$ pfu of the following: one of two independent clones of MCMV/ZEBOV-NP$_{CTL}$ (5A1 and 5D1), MCMV/PSA (clone 3-1) (a comparable MCMV vector expressing IE2 fused to an H2$^b$-restricted epitope from human prostate specific antigen, PSA), WT MCMV, or diluent (mock control). Mice were boosted at week 4, and splenocytes were harvested for analysis of T cell responses at week 8. T cells were analysed by using intracellular cytokine staining (ICS) with a 6 hour incubation in the presence of brefeldin A (BFA) with peptide (or anti-CD3 MAb, for total T cell response). Levels of responding (IFNγ and TNFα double-positives) CD8$^+$ (top) and CD4$^+$ (bottom) cells in individual mice are shown. All MCMV/ZEBOV-NP$_{CTL}$ immunized mice (n=10) showed significant CD8-restricted T cell responses against the NP target antigen. (c) Typical responses from MCMV/ZEBOV-NP$_{CTL}$ vaccinated mice. The majority of ZEBOV NP-responding T cells are polyfunctional (expressing both IFNγ and TNFα) and are specific for the NP epitope (not observed following incubation with the PSA peptide or unstimulated controls). Consistent with MCMV infection, all mice demonstrate T cell responses to MCMV M45. T cell responses directed against M45 are known to be 'non-inflationary', generally representing <1% of total CD8$^+$ T cells during chronic MCMV infection. Error bars show the standard deviation (s.d.).

FIG. 29 depicts Kinetic analysis of CD8$^+$ T cell response to MCMV/ZEBOV-NP$_{CTL}$. 129S1/SvlmJ/Cr H2$^b$-restricted mice (n=14) were immunized (i.p.) with a single dose (1×10$^5$ pfu) of MCMV/ZEBOV-NP$_{CTL}$ (clone 5D1). At times indicated, mice were bled and peripheral T cell responses were measured in pooled blood by using ICS with a 6 hour incubation in the presence of BFA with peptides. All responses were normalized against cells stimulated in the absence of peptide. Responses are against ZEBOV NP (black), or MCMV M38 (grey) and M45 (white). Error bars show the s.d.

FIG. 30 depicts MCMV/ZEBOV-NP$_{CTL}$ induces a ZEBOV-specific T cell response in C57BL/6 mice. C57BL/6 H2$^b$-restricted mice (n=6/group) were vaccinated (i.p.) using 5×10$^5$ pfu of MCMV/ZEBOV-NP$_{CTL}$ clone 5A1 or 5D1. Control groups received either MCMV WT, or diluent (Mock). At week 4, mice were boosted as before. At week 8 mice were harvested for analysis of splenocyte T cell responses by ICS using a 6 hour incubation in the presence of BFA with indicated peptide. MCMV-specific CD8+ T-cell responses against MCMV M45 and M38 were used as markers of MCMV infection. PSA peptide served as an $H2^b$-restricted epitope specificity control. Responding CD8+ cells shown are IFNγ and TNFα double-positives. Mice groups presented in this figure were vaccinated in parallel with mice groups (n=14/group) used to ascertain protective efficacy of vaccination regimen shown in FIG. 4. Error bars show the s.d.

Figure 31:
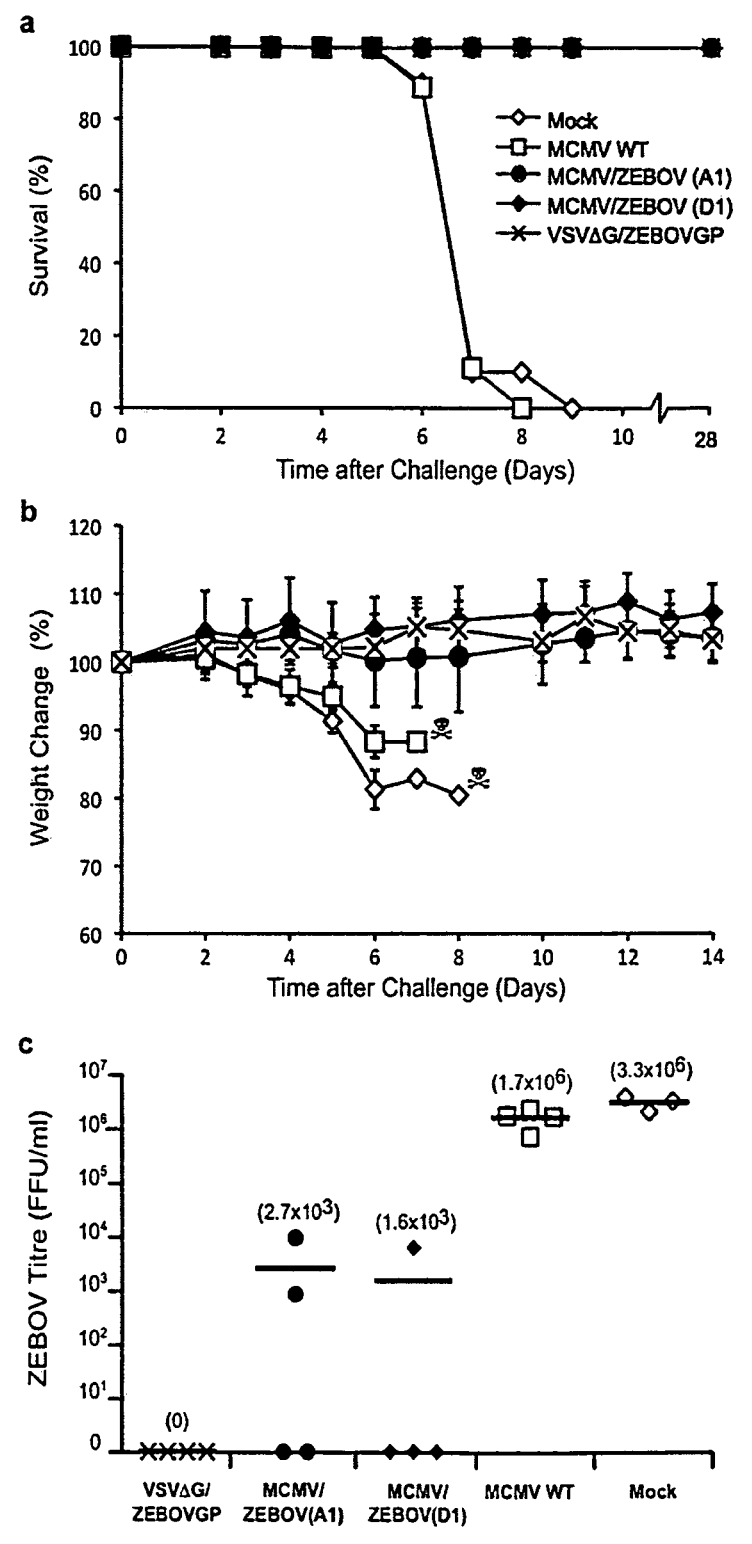

FIG. 31 depicts Protective efficacy of MCMV/ZEBOV-$NP_{CTL}$. Groups of C57BL/6 mice (n=14) were vaccinated by i.p. administration of $5\times10^5$ pfu of either MCMV/ZEBOV-$NP_{CTL}$ (clones 5A1 or 5D1), MCMV WT, or diluent DMEM (Mock), followed by an identical boost at week 4. An additional group received VSVΔG/ZEBOVGP as a positive control for vaccine efficacy. At week 10, mice were challenged with $10^3$ $LD_{50}$ ma-ZEBOV (i.p.). Data represent (a) Percent survival. (b) Body weight change over time post-challenge (error bars show the s.d.). (c) Viremia levels in 3-4 mice harvested at time of peak viremia (day 4) (mean viremia levels for each group are shown in parentheses). For body weight, groups were weighed daily until 14 days post-EBOV challenge, or until all animals in a group had succumb to ZEBOV disease. MCMV/ZEBOV-$NP_{CTL}$ vaccination had a significant impact on survival from ma-ZEBOV challenge compared to MCMV WT controls ($p<0.0001$) using a log-rank test. Analysis of ma-ZEBOV viremia show a comparable level of viremia control between MCMV/ZEBOV-$NP_{CTL}$ vaccinated groups, compared to MCMV WT controls ($p<0.0001$). No significant differences were observed between VSVΔG/ZEBOVGP and MCMV/ZEBOV-$NP_{CTL}$ vaccinated groups in survival, morbidity (weight loss), or viremia (p=0.3).

FIG. 32 depicts genomic characterization of MCMV/ZEBOV-$NP_{CTL}$. BAC DNA from two independent clones of MCMV/ZEBOV-$NP_{CTL}$ (5A1 and 5D1) were digested with EcoRI followed by electrophoresis. The comparable digest pattern between MCMV/ZEBOV-$NP_{CTL}$ BAC clones and the MCMV WT BAC shows the lack of any gross genomic rearrangement.

FIG. 33 depicts multi-step growth analysis of MCMV/ZEBOV-$NP_{CTL}$ (5A1 and 5D1). MEFs were infected at a MOI of 0.1 with either 5A1, 5D1 or WT MCMV. Supernatant was collected at days indicated post-infection and titered by standard plaque assay. The assay was performed in triplicate and standard deviation is shown.

Example 8

Recombinant CMV Vector with a Deletion in the Gene Encoding UL82 (pp71)

This example relates to a replication-impaired RhCMV that was able to infect CMV-naïve animals and induce a CMV-specific immune response. A recombinant RhCMV lacking the tegument protein pp71 (encoded by Rh110) was generated. The homologous pp71 protein encoded by UL82 of HCMV was previously shown to stimulate viral immediate early gene expression and growth of HCMV lacking pp71 is reduced by several orders of magnitude in vitro (Cantrell et al., *J Virol* 80:6188-6191, 2006; Preston and Nicholl, *J Gen Virol* 87:1113-1121, 2006; Saffert and Kalejta, *J Virol* 80:3863-3871). Similarly, RhCMV lacking pp71 (RhCMVΔpp71, RhCMVΔRh110) grows only poorly on rhesus fibroblasts, but normal titers were restored in rhesus fibroblasts stably expressing pp71 from a retroviral vector. FIG. 36 shows the deletion of pp71 impairs viral release from normal fibroblasts, but not from fibroblasts expressing pp71. Two different vectors are generated: RhCMVΔRh110 has a gene deletion of Rh110 which encodes for pp71, in RhCMVΔRh110 retanef the Rh110 gene is replaced with an expression cassette for a fusion protein of the proteins rev tat and nef from simian-immunodeficiency virus (SIV). RhCMV-WT refers to the parental (wiltype) virus. In the top panel rhesus fibroblasts that are life-extended by telomerase expression (tRFs) are infected at day 0 with 0.01 viruses per cell (multiplicity of infection (MOI)=0.01). The cell supernatant is collected on each of the indicated days and the viral titer is determined on tRFs that stably express pp71. The data indicates that pp71-deletion reduced titers by more than 1000 fold consistent with a severe deficiency in viral production. To confirm that this growth defect is due to lack of the pp71 protein, pp71-expressing tRFs are infected at an MOI of 0.01 and the supernatant is collected. As shown in the lower panel, the same amount of virus was released when these complementing cells are infected with ΔRh110 or WT viruses. Infection of pp71-expressing RF allowed generation of high-titer stock for infection of CMV-naïve RM. Two sero-negative RM were infected s.c. with $10^7$ PFU of RhCMVΔpp71. The cellular immune response to RhCMV was monitored in bronchioalveolar lavages (BAL) and in peripheral blood mononuclear cells (PBMC) at weekly intervals using intracellular cytokine staining as described (Hansen et al., *Science* 328 (5974):102-106, 2010; Hansen et al., *Nat Med* 15:293-299, 2009). Strikingly, both animals developed a significant immune response to CMV within two weeks of infection that is comparable to historic control animals infected with RhCMV-WT (FIG. 20).

FIG. 37 (upper panel) further shows that the T cell response remained stable over 245 days. Two sero-negative rhesus macaques (RM) are inoculated s.c. with $10^7$ plaque forming units (PFU) of RhCMV ΔRh110 at day 0. The CMV-specific CD8+ and CD4+ T cell response against RhCMV lysate is measured by ICCS in PBMC and BAL at the indicated intervals. The immune response is comparable to that of animals infected with RhCMV WT (black lines). These results indicate that despite its severe attenuation, pp71-deleted virus was able to generate a long-lasting WT-like immune response.

FIG. 37 (lower panels) demonstrates that replication-impaired RhCMV is not secreted from infected animals. To determine whether pp71-deleted RhCMV was secreted from the two CMV-negative animals infected with RhCMVΔRh110 (Δpp71) virus was concentrated from urine samples and co-cultured with pp71-expressing fibroblasts. For control, two CMV-positive animals were infected with WT-RhCMV expressing RhCMVgag. Expression of SIVgag, RhCMV protein IE or the cellular protein GAPDH (included as loading control) is determined from viral cocultures by immunoblot using specific antibodies (S. G. Hansen et al. Science 328, 5974 (2010)). The two animals infected with RhCMV(gag) secreted RhCMV (as shown by IE expression)

because they are CMV-positive at the onset of the experiment. At day 56, these animals also secrete SIVgag expressing RhCMV indicating infection. In contrast, the two CMV-negative RM infected with ΔRh110 did not secrete RhCMV as indicated by the absence of IE-positive cocultures up to the last time point tested so far (day 231). This indicates that ΔRh110 is attenuated in vivo yet retains the same immunogenicity over the entire time of the experiment (245 days). This result further indicates that the pp71-deleted virus is unlikely to be transmitted from one animal to another. Thus, pp71-deleted vectors are replication-impaired and spread-deficient.

This example further relates to a replication-impaired RhCMV expressing a heterologous antigen that was able to super-infect CMV-positive animals and induce a immune response specific to the heterologous antigen. To demonstrate whether pp71-deleted vectors are able to super-infect CMV-positive RM and induce a longterm effector memory T cell response to a heterologous antigen, two essential features of CMV-vectored vaccines, four RM are inoculated with pp71-deleted vectors expressing the SIV antigens rev/tat/nef together with a WT vector expressing the SIV-antigen pol. This co-inoculation allows the determination of whether there are differences in the kinetics and duration of the T cell response to the SIV antigens expressed by WT versus replication-impaired vectors.

Figure 38:
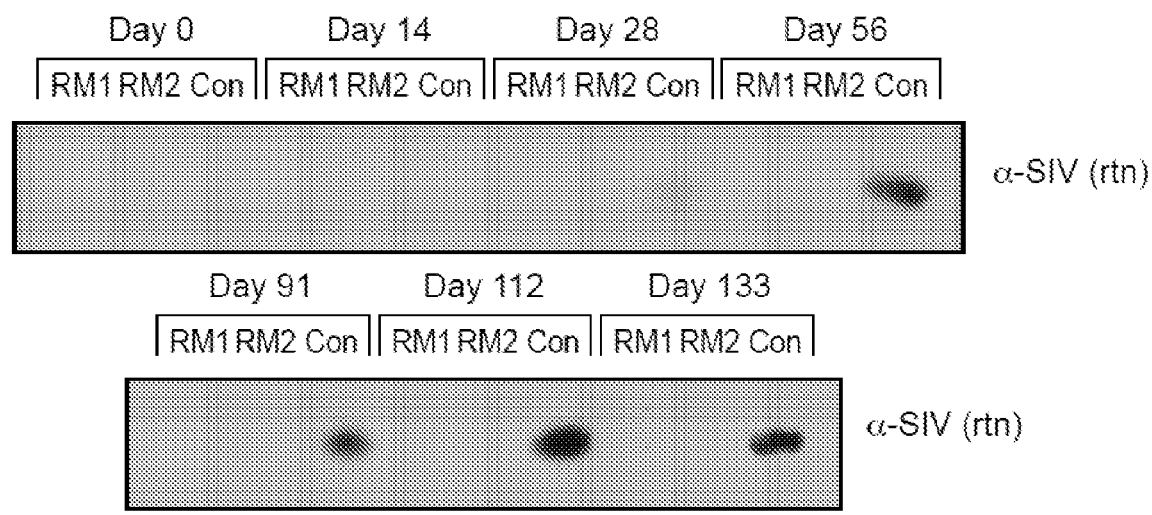
FIG. 38 shows that PP71-deleted CMV vectors expressing a heterologous antigen are able to super-infect CMV-infected animals and induce a long-lasting immune response to the heterologous antigen but are not secreted from infected animals.

FIG. 38 shows that pp71-deleted CMV vectors expressing a heterologous antigen are able to super-infect CMV-infected animals and induce a long-lasting immune response to the heterologous antigen but are not secreted. Upper Panel: Mean frequencies (+/−SEM) of SIVrev/tat/nef- and SIVpol-specific CD8+ T cells from blood and broncho-alveolar lavage (BAL) lymphocytes of 4 CMV-positive RM inoculated simultaneously with RhCMV lacking pp71 and expressing SIVretanef (Δpp71 RhCMV/rtn, in red) and wildtype vectors expressing SIVpol (wt RhCMV/pol, in blue). SIVrev/nef/tat-specific responses of 6 RM given wt RhCMV/retanef are shown as an additional control for comparison (in black). Response frequencies were determined by intra-cellular TNFα and/or IFN-γ expression after stimulation with overlapping rev/tat/nef or pol peptides. SIVpol or SIVretanef responding CD8+ T cells from blood at day 133 post-inoculation were also analyzed for memory phenotype—the fraction of the total SIV retanef- or pol-specific response with a phenotype of central memory T cells, $T_{CM}$ (CD28+/CCR7+), transitional T cells, $T_{Trans.EM}$ (CD28+/CCR7−) and effector memory T cells, $T_{EM}$ (CD28−/CCR7−) are shown. These data clearly show that pp71-deleted vectors retain the ability to super-infect animals already infected CMV and induce a longterm effector memory T cell response to a heterologous antigen.

Lower Panel: Urine co-culture after inoculation of RhCMV-positive RM with Δpp71 RhCMV/retanef (RM 3/RM4) vs. wt RhCMV/retanef (Con) vectors, respectively. Urine is collected at the designated time points, and RhCMV IE (primary infection) or V5-tagged SIVrev/tat/nef (super-infection) expression is detected by immunoblot of co-culture lysates. These data show that the pp71-deleted vector is not secreted from infected animals consistent with spread-deficiency. Taken together, these data demonstrates that immunogenicity of CMV-vectors is not compromised even when vectors are severely impaired in their ability to replicate in vivo and in vitro.

Example 9

Figure 34:
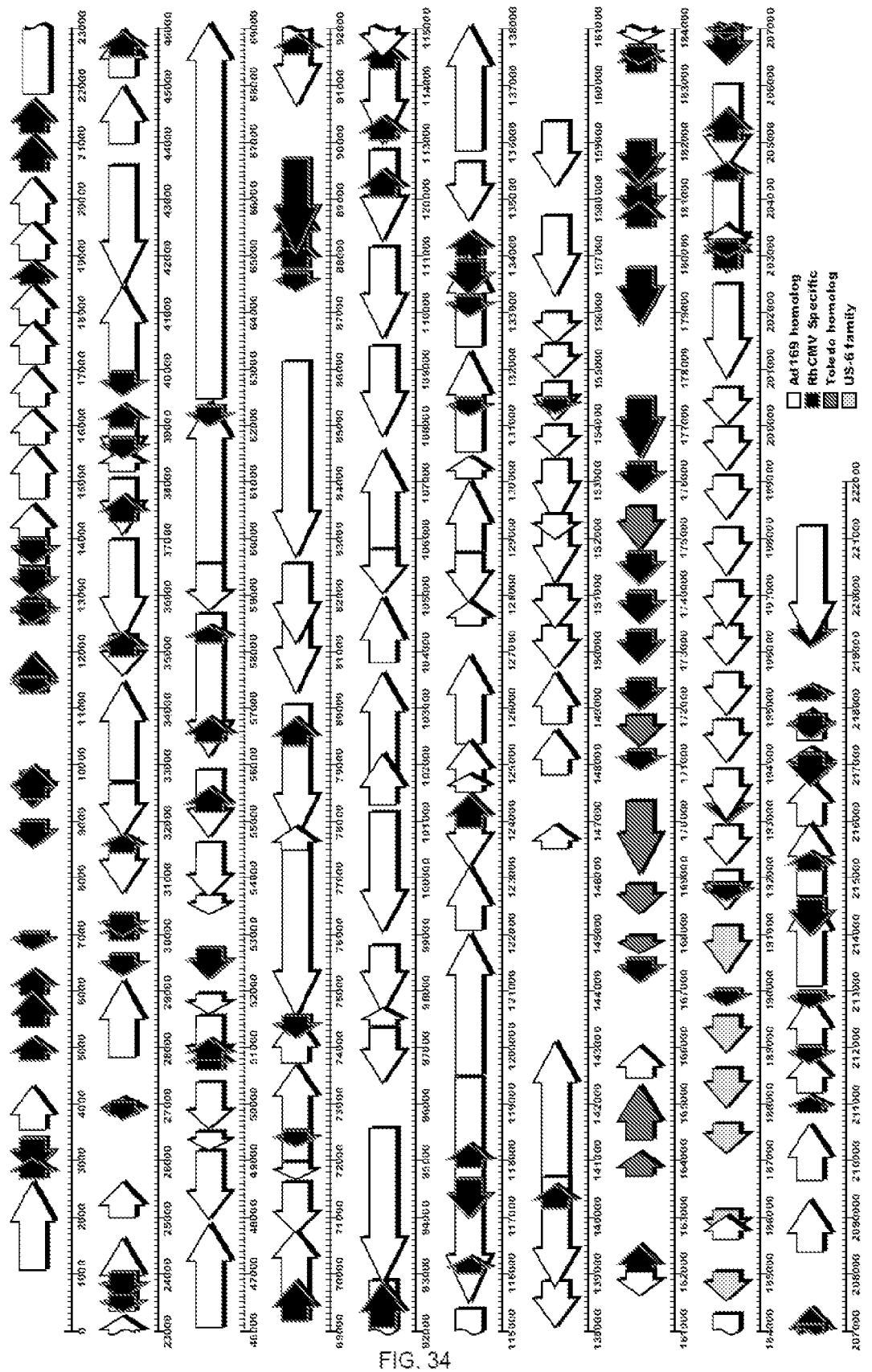
FIG. 34 shows gene regions of RhCMV that are non-essential for super-infection.

Applicants observed that multiple genes of CMV can be eliminated without compromising features that Applicants consider essential for vector efficacy, specifically the ability to super-infect and establish long-term antigen expression and thus induction of durable effector memory T cells ($T_{EM}$) responses. Applicants' data revealed an astoundingly large number of genes that can be deleted without compromising the ability of RhCMV to super-infect and to induce long-term $T_{EM}$ responses. Specifically, Applicants have constructed a panel of RhCMV/gag recombinants containing large gene deletions (up to 10 kb each) that together comprise ~30 kb (24 genes) (Table 6, FIG. 34).

TABLE 6

| RhCMV gene regions non-essential for growth in vivo | RhCMV candidates for replacement (% identity to HCMV) | Homologous HCMV Candidates (kinetic class) |
|---|---|---|
| Rh13-Rh29 (RL11 family) | Rh13.1 (40%), Rh20 (26%), Rh19 (34%), Rh24 (35%), Rh23 (36%) | RL11 (L), UL6 (?), UL7 (L), UL9 (L), UL11 (E) |
| Rh111-Rh112 (pp65) | Rh112 (35%) | UL83 (L) (pp65) |
| Rh191-Rh202 (US12 family) | Rh190 (33%), Rh192 (24%), Rh196 (29%), Rh198 (36%), Rh199 (32%), Rh200 (29%), Rh201 (40%), Rh202 (58%) | US12 (E), US13 (E), US14 (E), US17 (E), US18 (E), US19 (E), US20 (E), US21 (?) |
| Rh214-Rh220 (US28 family) | Rh220 (37%) | US28 (E) |

Figure 35:
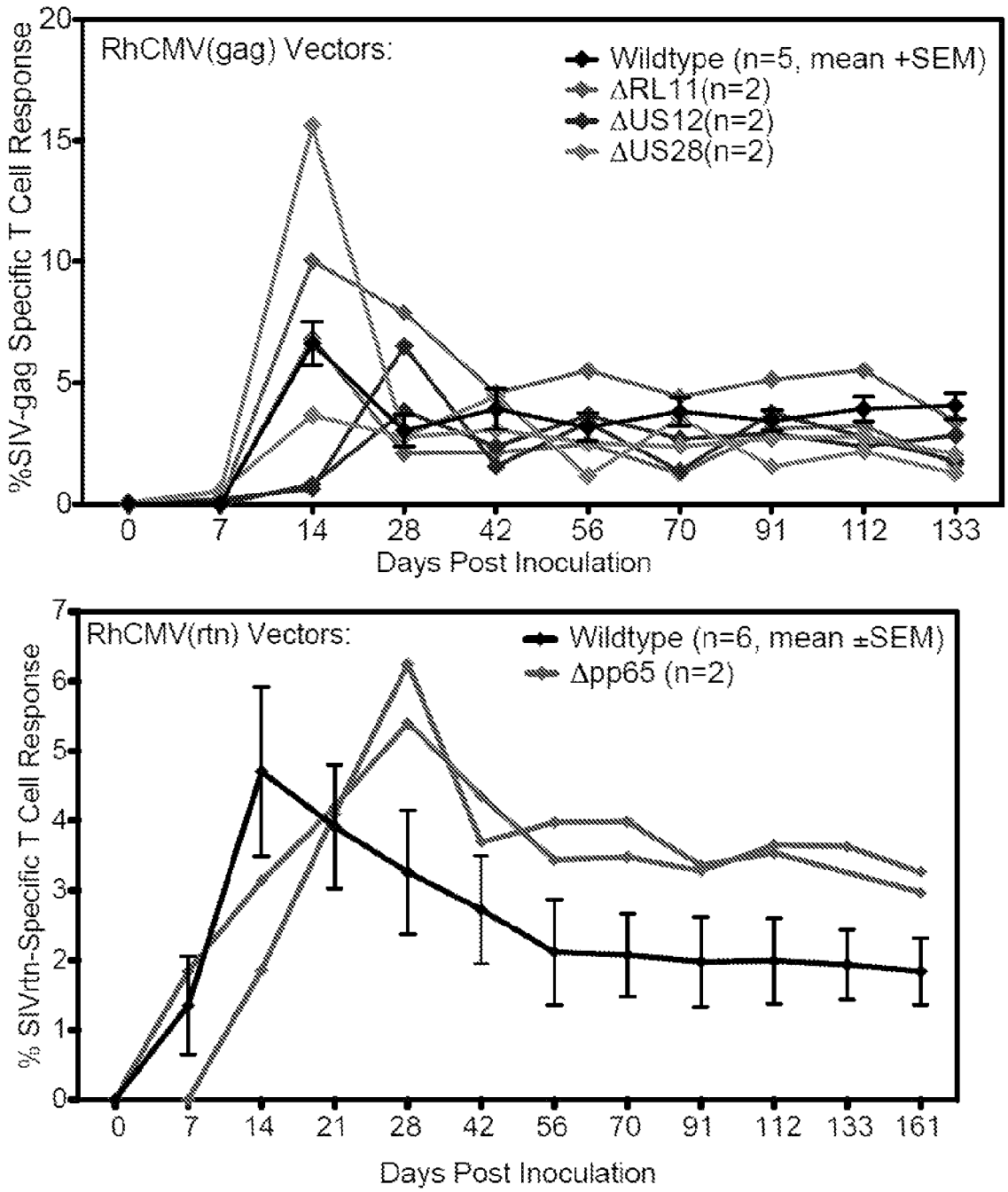
FIG. 35 shows immunogenicity of RhCMV/SIV vectors with deletion of specific genes or gene families (SIVgag- or SIVrtn-specific CD8+ T cell responses; broncho-alveolar lavage lymphocytes).

Most of these genes and gene families are conserved in HCMV and are known not to be essential for HCMV growth in vitro (Yu, D., M. C. Silva, and T. Shenk. 2003. Functional map of human cytomegalovirus AD169 defined by global mutational analysis. Proc Natl Acad Sci USA 100:12396-401). Deletion of these genes in RhCMV did not affect in vitro growth characteristics, super-infection efficiency, persistence, shedding or immunogenicity of RhCMV/gag vectors (FIG. 35), and thus any individual gene or gene group in these dispensable regions can clearly be replaced with heterologous antigens.

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

Sequence CWU 0 SQTB SEQUENCE LISTING The patent application contains a lengthy "Sequence Listing" section. A copy of the "Sequence Listing" is available in electronic form from the USPTO web site. An electronic copy of the "Sequence Listing" will also be available from the USPTO upon request and payment of the fee set forth in 37 CFR 1.19(b)(3).

SEQUENCE LISTING (16 sequences)

SEQ ID NO: 1 - DNA, 221454 bp, Rhesus cytomegalovirus
cgggggggtgtttgtggcgggggggtaaaatttggccagctgccaagtaagagcagacggagacggggtccagcacagcagacagacacggggcactgggaaagcacagaacaacacacggagaggacacacagagacccgcacagaggcgacaccgttcacacacacacacagcagcagggccgcagtgacaccgcggcaaacagagagaggcagacggacaacgaagaacgccgaagcagtagaagagaagggcgagggctatccgcggccccggcgacccccttccccagtcgccgtcgtgccgaggccgcggaggacggctgcccggggttggcggtctgccaagaacacgcggcccttccccctccctccacgcgagccgcgcacggtgaaacacacacaggcagacaccaccgccgtccccctgtcggcccgttccgggaggctggaggggggcccgggggtcgcggcggggggcgtcaaaacacgcgccgtctctgcggggcaggacgccggcagcctggcgctgtttgctcgcgctcgctttttctcccccgcgccgcgaaacccgagccgcccggctgactcagcgctcgcggccacaccgtctacaccgccggcgcccggcgcacgctgaaataaaaaccggttccttcagctcgcttcactgctcctgcgctgagtcaacaccaacgcgccccgccaaaggcagcactgagagacgggcagaaagggacttcccccggcccgcgtgtggcgctcgctgcgccgcctagcgtcaggccaccctcgcctgcctgcgcgccgcctactatcaactatccgcgacgttcgcccattatcaactgcacaccctcgccatgccgccactcaatccacaatccgcactcacacactcctcatttcactaccaactctccgctcccttgaccccacactctcccgcttacaccaacctcccacattctgcacccaaccctctccacaacacactcctcgcccgtctcagcgcacctcctccaccccatcacgcactatgcttctcctcatccctccctccttcgcgtttcccctacactccctccagcactcccaaccacgcactcttaaaccctccagccttctccgcgtcgcgctcactctcgcatcacccaccaacatgtcacacactcccggcgcctgcgccaacacctcctcgcctttctcgctctcacccttaacccgctggcgcgcctgcaccatcttcctacccgcacagcgctgtccaacctgcggcgactggagcaccgccgaacacgaatccggcacctgccgagctccagatgccgacctcactgactactcaggtggatccacctccgatgacgaggccgtgactgcctacgcccacgccctgcgcagcatgcccaccaacccatcctacgccaaacacctccgctcctactccgcacgctctcgctcttcacgcgcacgccatcgccaatgccgccgccaacccccctccgccgccacccactcacctgccccccgtcaccctactccctccctctcctcatctacctccgccacacctccacctcctgcactcacctgtcccctcactcaccttcgcacacctccacgcaaccccccacccccagacacacgccaacaacacgatcccctcggcgaccaggccgacgaagcgctccgcatctacggctaccccatcagccgctacgatatgcgcaccggcaccgcagaccgcctcagcccagaccgcggaggccccctggaacccaattgctggtgcctctggggagtgcacgcacacaaaaatcaccgtcctatcattcctttattaacagcgcgcgctcgcgacggccccatcaaaagcggcggctgggatgttctgtacggtcgcggctacggttaccgcgcattcccaggtcccgaaggcgaatctcgccccgtctggacacaacacatcgtcttcctcctcggcggccacggccctcgcctgcagctgaaccgcgcgtgtgcccgagaagctgaagcccgaggactcctaccactttggcctgtccactcacgcacacctcaaacatccaccgactccgacagctccatcgacggcattccacgctccaacctacccagactccttcaaaaacacacagcacaacacacccgcaacggcaccagccgccaggccgaacgagcagaacgaggtgcttggattgtctcagacaccttcaccgcccctggtttacggaatacttggaacacgcgtactcatgaggaattctggcaacgcaactataccaaagactacatggaacacagcgttttcctcccaacttcgccgaaccgcttctacgaccctttccagagccgccgcccttgtcgccattcatccactaccagctctgatactgacagcgacggcgacgacaacgaaaacaccgtacccatcacacctgacagttacatccctcccgatggaacctgcaagcattctccacccgaaactcactctcatacttcttccaccactcccgagacagaaaccactcgcctgtgatcatataaatagcatttattttaataaatacaaatcttgaatcccagtgttatgatctttgtcagttttcttcccccatgccttctcgtacgacacatcctcctcgctatctgcccgccgtcatatacggcagttgtcataattcatccctttctggtcccttctcgcccttcgcatctccaaaatgccagttccaagcttccaacgcgccgtgcctgcgctctgcctcctcctgctgctgagcgctccactgctgcgttggtcgtaccacttcgcccgacgatattgtaccgactgcttcatctcggcgacgcactggctgctgaacgcaagcttctggctcgtacctcgcttgctgttcctgtttgcctacattatggttctctcttggatcactctgctgtgcatattcctcgcactcagatgcataggcgtttttcgtggggcagagatattcgacgagccaacgggccgcgaagctcagtagtatattgctccacttttcccttttcctagtgtagatgtaccgtgtcgcttcccattccatagtgttcacgaacgctcgaccgcacgcacgccaccaaggcgtgtcgaacgcgtccaccaggtcttccatgcgatccagcaattcatcgcgttccacagcgctggaacaaggcacaagtgccatgtttgtccgccttcccgccgagcaacaggtctgtaggctgtcagcactatacaaaggagagcgccgctgcctccaaggaagaggagagcgcacgcactttcctctgcgcgctccgattgcaaaacgaggagtgttaaaacgacaggaatccccggaggctctcattcggcaaagtcaggatcggctcccaagtgtattctccgaggctcgctgggactgtttattataaagcccgtgtacgtcatttttatacatctatatcgaaaccgactgggaaagcccagcgctatcatgtgtccgggacttttcacctacatcacccttacaggaatggtgatgcacacagtgtccgggaatccgcgtcagctcctgtgcaatgtcacccgttttccgggaaacaacgtgtctcaggtgcggctgagcacgggcgacaatgtcacctttctgtacaatgtgtcgcagggccactctctgtcgtggctgtactcgaacctgaccgccaatagcagccgccacctaagaaagtacaccttgtgcagtgttacttctaactacagaatgaccgagacccgcaacaacatgtgcctgcactgtaaccgctcgagcctgacgctatgctcggcgagaccccaggactcggggctgtatgtgttacgcgatgacaccaataacactgatgtgatgcgatgtaatgcgactgtgaccggcaacggacagctgcctgtcacgcacagaccgcacagcaggcctacggtgaccaggatcagcagcgcgcacttgtcgggtatcactctaggtaatcagaaacattcccccaccacctggaacacgtggatggtccacatttcgttcgccaccatggccctggcgtgctttggggtagcggtggttttgtccggctgcgtgtgcctacggtccgtgcgcgcctggactcagaagtatcggccgctgaatgaggaccctgcgcctcagaaaatcgattttccggacgggacgatgaaagaacaccctcatgtgactgttatcgaacctacgaaaagtgcagatggcacggttgtgggtttatcggcggtgagcgatgataaacccgccacactgtggctgtcgaggtaaagatgcaaagtgaatgtgtgtatgtttccaggaaatgactgccgttttccaagaaataaaggcgatatgaaacgatgtcagtactcgctggcgtgttgtgttttctatcatcagtcatgagaatcagaatgcgtatacatgggagctaagtgcgagacgtttatttgagatatggtgagcctgtctcagattgtctacctgactgtaatagcggctgatgatttagaaactgatctgttaccactgacttttttgcttcttcgcaagtggttgctgacattatgtaaacgttgccgttctgccacaatactaacgaaaaaacgcggatacaaaaaacagtaaacgattattcggattgtcatggtaataaccattattgtcctttatttattattagtgaaaccctctaattcaagtacaaacacacatacatatgcagtaccaatcggaggtaatgtcactttgtcagactttaccaacgacataacacattatacattaggtatatggtactttacaagttcttcaggaatgtgccaaatagatatcagtgataacgataggcatcgcaaattgtgcaatatctattatgcacggacagaatgtgaaactctaacattacggagcgcatgcaaactagcgatacaacactcatgtaatatgacaacattgaccatttacaatgtaaaagattatacacctaaagattatacattgaaaaagcgccataaaaattctacggaaactacacaatactataggattcaacttgtattcccaaccacacaaataccaaaaaccaatactgttgtctacccccccccccaccagagaacccaggtgctttaacttccgacaattcatcttatacaacaaccatcgttgtgaccggtgtactagcgatgcttttcgccatgattgtgttactgtattgttgcctaaacaaatctcgagatcaacatcaacattagtataatgcgctgttctagctatgtgttgtacagtattacctttctgttccgtgaaatgtgttatacaaaacacattatatacaattactcaacggttgcaggcggtacagtaacattttttgatgtcactggatacagtggatttactaaaggtacatggtattttcaacctgttaatgatagttgtttcaacacatttgtgacaaatgatgcatttacgaaactgtgtggcgtctactaccaaataaattacacagatctatctaccataatagaatcctgccaaacgtacttcaatcacacatgcaacctcacgtctttaagtctgcacaacattaccccacaggcaccaactacatataagctagtaaaaaacgctgtcactcgcaaacaaaacattacattttataatttgcagattatatcaatagagaatgtactcccttctcaagctaattatgcatcacgaggttcactttataacacaccgataattgctactgtgatactgataattgtcattaccgtcatagtgtatatgcaatatcaccacaaagatcatgaacgcataccatacactcattagctgcctctgcttcttcatactgtatgcatatattacagaatctacaagggttgtaactttacaatatgtttataatgtatctattggcgaaaatgttacattatctaaacccgataacctatccttccaactacattcctggttctgtaacaacagagctagtgcatgtaataatccaataatgaagttatgcgaagaaactgcgggtaataataaaccgaacagttatactagatttcaaaataactgccatccgccgacatttacgtgcaacactacaggattgtatctgtataatgtacaagaaaccgatccaaccacttatacactaacacaacgcgccggtaacggcaatataacagatagaaacacgacttacattatacattttatcactagcaccacccccccccccgttacaaaactacatatgcaatttatcttcaaccagttgcacaaacacaagcaactaccaactatagctacataactatcacattaactgttataacacttatactattcatgttaggagccggatatctaaagcatcggagatcattaaagcattataaacaaaatacacataaatgtacatcattaggtgaaagcagatatcccgaaagctccatataagatgctatacacaaatatgttaccagcaatgcagtatgtttttccatatacaaacattaatatacatgctacttagttatgtaatttgccaaaaggaaattaacattactgttgttagtggaaacaatgtaacattagtgaaacccgacaatgcttcttttcaactggaacaatggttttttcaatcccgccttaacgatatttgtccgaacacacaactatgtaaccagtttccgaaagacattcgtacgtatgaaccaaaaccaccatattgtatgccactcacatttatgtgcaatcgtacaggcttatacttacaaaacgtgcgcacaactgtcccggtgacatatttcttgatacaacaaggcggtttgtcagaattaccatataggaacataacatacaacatacttttttccaccaccccccccccacttatcaagcataacaccttataattctcaacaacattctgtatctctgacatctatatctcaaccgtatgctaacaaccacatttacattgtaatcgtgtttgttgtaacaatgttttgtataggattaggatatctacattatcgtaagccattacaaaagcgttttcaacgattgtaaacagtccgctataaaaaaccatacatccccaattttatcgttagatctctctgtagcgtcttttgatgttattaatctagctccttatccaattatatattgaaaaatgtcatcaagtacaacaaatccaacatcaccgagtgtgaactccgtacttcttggcactgcaccagatgttgacgcaatctatatactaattgtaattctagctatcctatcaatcattctggaaattcaatgcattattcatttttattgctacacaagggcgtctctgctactgttcaaagcacgtgcataaacaaaagcaagaaatgacatccactttcccataaaaaccaagctcagaaactccacgcgatcacaagatgcccgggacaagcatagtagttttcatatccctgggcgtcatcggcggactttctctgataatctttggatccttctgcctttggaaactgtacgacagaatgcttcaatacttttacaaatacaaaagactgaaccccatggaggctactgccatagaacagtgactttttaaacattgttcgagctgcgacataccaatatgctcgcaactctttttatctttgtgtgtttgttcactgcgcatctgttaatgaattttgcatgtgaatgccttgacagattttgcgagaagttgcttgaacgatatgaacagtacgaaagaattgtgtgagtgacattgtattaccactgcaatgtgagacgccgtgagcgttataatggaagcaaaagctaccgaaaacaaccgttgaaagcatttatcgagtattgtgcaatatcaccaaacgaacatggcgaacttcaccatcgtcattgtggtgttctgcttcatgttcagtttggtatttgggctgctacttatcattttgagcattatctgctgcatctgctaccgattaaaaagatgggccagcgcagtcagtgccgccctcgctgtgaagcagcaacaatcccgtatgattatcatttgatacccatacgcgttacgcaccaatatcccccacccactaccgctatatcaacacgctgttaaagattgagtttccagtatgagccatccgagaatcgcaattctcgggattctcacaatgggcaacgaggtcgtgttcgctgttatcgctgtggtggcctcgtttgtcgcccttatcatgggcattctactggatctcctgtacctgcatgcatatcagaaattttgcaactattactgctgctgcccctttcagagactgtcgatatacgatgcagaggtcttggaagagctcgaagtgtaaaaggctgactatggaaacaaccaacaaaaaagacacacgggagttcgattgttttgtgatcataactcagcatgctctctttttattacaaccccgggatcgacatgctgttgcaccgagggtgaggaggatgaagaagaggaaggagatggtggtgatgatgaggacgaagacgacgagccgttgcgcgccttgaggagctccttattgggaactcggaacgcggccaacggacaccctttgacgttgctacagactagagactggatagttgcactcttgacgatcccaaaccccacgtctccgccgaaggtgctgggtttccagtaacccggggagcagatgacgttcgccatgaggcctttgagggaaaacggagcccccagctcgagaatgctctcaccgaagatggcgttgggacggggcttttccaccaagaatccggtgtacaactccacagcctcgatgtctccgtaaagggccctgagttcggcagcgatttccttttctcctgttttattaataaaaataaaatgccacggacacataatcaacacattttgcattcatattgtatggacaaaaaaaataaaaaagactgttgaaaatgtaatagctgtcacctgtaagttcttcgaacgactcgtagggctttaaactgaaccgctttcggtactggttgagggattgaaacctcatttcacggccatgttctatggccgcccgggagacccttctgagggcggggggtacgttcctgccgccggagatctaggaggggagaagggtggatagtgacagacgattaatttgttacaaaaactacgtggacagagatgattgacagatttaacggcgcacttactcggccagctatttgtttcgtgaacgattctactagctgggtaatgccgtgggtcatgagtatggaattgttgtaaacgaagttaatgtagtcatactttgttttatcaatctcaaacgcatccggcatgagagaatgccagtgatacaacatgttaaactcggaaaatatacgattttggtactggaacgaagtaccaaagagcagttcgggcttaaacagcaactgaaagtggtagccgctgagctgctgaacatactgcgtcacgataatgttgattgtttccccgataatgatgagtcgagtggtctgaaacagttgttcgtcactccattctggatgttctcgtttcagaacatcgcacactctgttgtgttccctgagccagatagtagcgtacatcatgagaccaggcaccaggccaaaagcctcttgaccgacagccagacgcatattttcgggcacttcgggaggatagatcatgtgcacctggacatctttgaccgaggggggatacatttcaccgtcaataatctgatacttatctttcgcgtctctgaagagacgcaactttgactgtttttctggcgtctctccatagatgtggttgagatccacctagggatatagagacgggaaccgttagaacgagtatcatgacgttgtgaagcagatggataatttgacaggacacacattgttcttaccccatgtcccagtcctttagtgaaggccgggcctcgcgccaaatcagtcctaaaaaactggtgcgtgaaatgttggccaaaaaaggcaaacattaagttggtgccctggggatcgggagtgaaggtcctccgaagaagagttttttccacaacgtgtgccgcatccggcagattttttttacctggtgaacgagaacaattagccaccgtgccagcgatgacaacgatcgcatggcgggcacaccgaggaaagtcacctttgaccccaagaggagttggacaatcgtgaggaaccggaggtagaatccttgcgtaataggagagattggagaaagcttcccagcttgggtattcgtagtccgcgttgtagatgggagggctgtcaatcaaatcggatctacctgaacaagcaaaagtggcataaagcaaaaattagaatgactgaaaggcaagggtagcgtaactcatctaacccgtcgggataacattacttactggtcagtatgtaccgcattaccgcgtggcggaggaaaggaatattgttgaccagccaccatatcgttgagaagtgagtcaacgtgtaatacacggtgtctggatctggcttcaggaaaagtttaatgcgagtgaataactcggctgtaaaaagagaatgaggggaacgccatgataacaatatctaaatgtgtaacctagtaataaacgttatcacattctacaatcttacgagtcgtgcagtcatggtcgtagaaacccgtgtgtgtgcaatcgcatttgtaatgatggaaccccacggtcatgcagatgcctctttttgacacggatgggagcaacaagggttggctacgatgcgaagagagagaataagagacaatcagtacgatgatgtttttactcatagccagaatgtagtgtcttttaatacgtaccggcatgatttagaaaagtacaataagagataaaggagaataagagaaagattctgcgcatactagcaccaccaccaaggacccagtcgtctacgactgaaggcaccaatattcgtggtattatatatcggcttcaataaaataaaacacgccaattgtttgttaatagctttattttgtaaattgcttagtcaacattcattccggaaaaagaattgatataaacacttgactccgagccacaagatgaggcgagataagcatgcatttttacataacattcattattttgacgttcagtccctgtggcgagagcgtttctcttctgatcaagaaccacactgtaacatgggatagttctgtcattctgaaagacgtggataacaatacaatgaataacttgggtgaatgggcagcgtatcttgtcaatacgacagtgtgtcccaacacaaatgtgacattgtgtatgattaatccgcatctcttaccaaataagacggataaccgaacaaacactacacgcatatcacaatgcttaaacatgacaacgtttatttgtaacacaactttacagattacgaacattacaaacgaaacccatacagactacatgttgacaagatatcgcaattgcacaaacggagaccatagcaatgagaacactgagcccgagtatacacagtttcatttagaattcacaatgacaacgttaccgcccacaactgttcttctaacaacaaccatggaaactactaccagtgaatacactgcgacatcaacaccattagctttagaactaagtgaaagcttttacatggcttcaatcggtattcccgccatgatatttgtgggaggagggttgctttttggactttgttattatgcctacatacaaggatggtgttcctgccgtacaagaacgacgtcctcagcgcacacagaacgtttgctatcataaaccgccgtacacggcggtttccagaccgcaataaccgctctgtgctcgagaaatatgggaggagttagcgagcaaaagctcattttgtgtaccactgagcattagaagcggatcacggaacgccgttgtgccttggcgtgctggacgattgtcaagacggtgaatgttacgaaaagcggacagaaaaacagtgccatgactaagtatacgtgcttcagatcgatgtctgcctgcggcatttttatgctgctgataaatttggcattagcgtgtgactcccaatgtgcctgtaatagtagctgtgggtttgcatacaacgttacccacgtatccggctacgaacacagcaacgtaacattgcatacaagcatcagtcacagtaacatatcgcatatgaatgtcggttactggatacgttacaactatccggtaaattcgtatacaatatgtaccgtttcgggcaacaatgttgctagcaccaagcataatggctgatttttcgagtgcaacggcaccagtctgacgttgcacaacttgaatgccgatcacacgggaagctatctttttaagaatcttctaggactgatggagcactataccgtcaccgtgctacctattccacagccgccggcccctcaggtgactaccgtgaccaattgctcacttacctttttcagcgaacacctctggcgaaacgcaactacgagaataataaccacaacaacacaaagtacctcaacaactaccactagaaccacaaaacccacaacgacaacgcaccgaacgaccgccggtcgagtcagcacccccacgcccgaggaaagttccacctcgacaactaccgaagaaagtactactaccacatggccacccggacgaccaaagtttatttccaagtactctaaactctcggtgtatgcagcgtggacggccgggctcttcggtacggccctattcatctttctcgtggtgtttgtgtgtgcgctcaggcaccttaataacagacaaggcgccctctaccgaccgccaccaggtcttcctgaaaaagacaaggaaaagaagaagacaaaaaccacgcggtctggcgtgtaccatctgctcccttcggagaaaaaaaagtcctcaatcaacatcttgcgctgtgaagtcaatgttttcctagagtagctactcggtcccacccggcattcgaacgtgcgcgcggatcgacaagctaccctgagaagccattgcgagtttttagacgacgagccacataataatccagaccaacataatccagatgacaatccccagcagtacacgcagaaaaacgatcgcgtcccaaacggtaacggtgccaagtggaggcggcggtgtcgtgggaatgacgagcgaaacggcgtccatcgtaccgcgattgtttcactgaaaaaaaaatgaaaagtgaaactcagcgttcgcggtgcaaatacggtcattatatctgtcacaaataacggaaacattcggaccgaagacaatggcaacatggattcaatgttgtatctcagaagcataaaaccgacttcaggtaaaaaactcacacaagctcgtgcaaaacgttgctagaagcacagaccgctatgaagaagcacgtttccaggcttatgtgctcctatttcgtcatgttttggccgattctggcaacggacaactcgacaaatagttcatcgagtgttaatatgacgactgaattaactacgctctcaacaacacccagatcgacaaatagttcatatatcaacagcacaacatggacaacgacgtatggatcggcaagtacttcgcaagggaacactacgacccctatgtcaaggacggttacgagcatctcatatacgtcacaaaatgcatcttgtacttcagatgtaactctaacatcatatacaaatacgttatcaaatgaatcaacgaatgtatcaagaaataattcgtatacaacaacaacaacctcttggacaagtacgccagaaatgaacataaccacaccgcccccatggccttttgaaatgcatggtcattatttcacactatgggtgaataattgttattgtggatatctgaaggtcctccctggaagcaatataaccttcaatggaacaaaaaagaatgacaccgactccatatggtttttagcaagatattttaattattggctttgcatctttactgctgatgcaaattatacaatggattatatcaatttaacacatacatgtacgtcagaaactatgactttatggaacgtattggaaggcaattcgggaatctatttccaacgaagaacggataatcagaaatatgattctacatatatctgttatatcctaaatgtcacagcagatgctgctaacaccacgtatcctgaaataactaccactaaatgtcaccggccaccatggagaaatcgtcccgatttcgcaagcattgaagctcatccaattacccccgactatgaagaactaagtattcaagatattttggaatcgttaagtcttaagggcggtctaaaaggttccttgcttaaatttgtacttagattcggatggttatgcggcattgtagttggcgtaacggttacgctcattataattttgaaactccctcaaaaactgtgcttcttatccagttatgtaccacaacgtcgaggttacaaaagactgtcatctaatcagattctttaattgtattacatcaaatgtctgcaagtgtatatattgcaatattcaataaatggactctttggatcaaacgcagctgcaaccatgcagatctcaaagttggtttatgcatccatagctgtattctgggctactgcatttatacacggacagacgagcgattcgtcttacaaagcaacaacgactctatgggcaaataggaacagcacatcgcaatcaagcacaatgcaactaacgaccgaaccgacggcaagtggatatcgcaatagttcacatcgaaacggcacaacggcaccaccatggacaactattgcagatgacaacacaaccaccttacctccctggcccatcgaaatacagagcacatacttttcgctatgggttaacggctgttattgtggatctttaagcgctcttccaggagccaacgtgacactgaatagtactaagaagcagaataacaccgagacactatggtttcgattaggaatgtttaccaatttactctgcatcttctactttgacaacgataatgactcaataaaatacgaccatttgacatttacatgcacacaaaacaacatcatactgtggaacgtttcggaaaaatattccggaatttactgtgaacgccaaatgtcgttaaccacatataattctacatacatctgttacaatctaacggtgactgcagacgctaccaatgcaacggatccttcaatagtcacgacgaaatgctaccgcagcagagaacaatactattcagtggaaacttcaactacgagtgatagcgctctcaacattgacgatattctgaactcacgaaggaactttcgggacaatggtcagagaaatctgcttggatctgtacttcagtttggatggttgggtgtgattgtaatcggatcaacaattaccctcgctctagtgtttcgtgtgccacaaaaattctgttatttgttctatgaatggaaacataggtatcgtggctacgaaaagatatctggtcaaattttgtaaacattgacacacagaataaactgtacatgtattttcaataaacattgtattataattatgaaaatactaattatgcttatatttgtaatatgcgactcacaaaccattcacttgcctacatgtagtttgaaaacatgttgtataggtgatgatgtttctttaaactccaatataccaactggatgtaacagaacgacgtggtatcgacataaaaacaatagtggcataatgttatgtagcttttcgggagggggtatgacgtccagttctaaagaacgcattaacagaacttgttcacgtcaatcttttatttttatcaacattcaaatgccatcaacaggaacatactacgtcgtcggaaataattgcactacatcgccacttatgtctacgtgttacaatgtgacagttgaacccaggtctaccactgctatgactgttgccgtgaacccgagcataaatataactgctcaattaccacaacgtcttgcgagtcacttcaacgcaactagttttgaaaatgagactgtaacggtccacggtgcttggggacttgtcattgtcgcgttacttttcctgtgggtggctattgagttccgtttacataaaaaatgttttgcttatttcagaaactatgtaaccacattttaattactatacaatgcaacaatattgtgaataaatatgtataatttcaatacggcaatgatagtatgtacactgattcacaaaacattatcaacatatatcaggtgcaataatgattttggaatttcaaacacttgtactcaatataatgaaacagccactgttggacaaaatgttacattaggtatatgtatcgaaaagtataatcccgtatcgtggcataaaaaaacaaacaataaagcaattattatgtgtcaatattcagattcgacaaactgtaatccacatcacgacatatgttatcattgcttatccaattattctttattacttattgatgttcaaacaaattacaatggtatgtactacttatcgtatctaaaagacaataagtacacagatctgtgctacaatctatcaattaatacgccaacattcaacgtctcacatacacagattaatcgtacaaccgtggaatgtatattcaaatcaaatataaataatgtaaagaataaaaatgcacacactactgtaaacgatgcacgaacaacgaatatcgcgtcgtatacaaatgatctaccaaatatgcaacatgcttggttattgttaccattcgcaataaccattacaattgtattattctgggtctatatgcctaaaaaataccaatctcgactaaatactcatagagaatatacaagactacagtattgatgtttttaatttccgtaagatgatataaagctgcacgtaccacaaaaatgctttatttcagaacacattacttatatttcataaatatacatatgaatataaacaaatgtatattacaagcatatcagttgttacatacgtattcattcaaataaccataaattataaaacaaaagagacatgttccgaatatagtatagcacttaatagtcacagaaaacattgtaacacaacattatcgtatacaggacaaaatgttaccctgggtgtacatataggaccatggactcccgcattttggaacctacaaataaacaacacagaaatatcattgtgtgaatatacacatactgtactgaaatgtaatttacatacaatatgttaccaatgtttatccaattattctctactacttatcaatgttacaaaacaatatagcggaatatattggttatcatacgacatcaataatggtaattacaaatatactgaaatgactttgtgttataatttaactgttcactcacgaaacgcgacatctaacaaactactaacaacgtcagcaacacatacaacgattacaccttatgtaactaccaatttacagcataatgaatccatagtaaatgacacatttcaaacatattacacagcaaacaatcatacaccttggctagccttaccaatattaattgttgttctaattgtactatgctggttcaatatgcctcaacgatacaaatatcaaccatatacatgggcgtcatgtttttacagagtatgtactcagacacattgtcttcaaaaaaaataacttgcataccagttaacagtaccgcaggacgcaacgtaactctcaatccaccaccattcaatcatcatactacgtatgtttactggtatcgacaactcggcaagggaaagaacgaattatgccgatacgttccgaacaaacaagagaggaacgccagaataaagtttcaatgtcttagcaattacagtttactactgattaacgtaacgacatcatacaatggtaactatacagtaaatctagatttaggactaggaacaacgtccactacctgttatacactaacagtaaagacagctacgcaaattgtaaagactacaaccagaaagccaactacaactcgaaaaacaactaccacgatgtcgataaccagcacaaccaccgcgacaaccactacacaaaccacatgcagcactaaaagtcctaatactaatgtacattcagattctgatcctgatatggtagcgctaaatgaaacacgcgaactgcagattcgtgaacacaccaatatacatgcgatatggctgttattacctgtactaatagtaattatttgttttttcactgcaaactcaaaaactaccgaactgtaacactgttttaacagagatgataatgcacatcaatgcactaacaatgaacaaaaaagggtcttttgtatggattatgtggcacattccgcaggtttatatatgttatgtgacaaatactaaatatgaaattaatacaaatggtacgaataccagcttagataccccgacatctgaagcaattacagcatccaaagcgtatatggcagtaccaaatgcacatactgcacatgccgattctaacccgagtggatatcatgtaaaaggacaaaacgacgacgattacgcaaacacaacgacaatcatcatattagtaatattgtttattgtaatcattttactattttttagaattccacaacgatgttgggaagggtaccaaaaaacaagggttaattcaccgtattgaaatcattctatgtatgactaagtaacgttgaaaacactgtttgaacgttgaaaatggaggtaggtcagcctgtcaatcatgatcccaatactgagagaatgtggctggttcggatacattggcataacgtgtctacttgtggtaactcaacttatcgacacattaggtaacaaatgctcaaaaacagaaacaagaactggaaccgtaggtactaacatcactctcgttactaattcaccccctaacaacaaaggattactgtactggtacaaacccaattgtaccagcaatgatagattgtgcgactactcagggtttactggtaccaatgctgtgtcaaacagaacgaagttgaaatttacttgcatgaataattcaacgaaactaactctcattaacgttacggctcactattctggtcaatattgtagtagaaccattacatcgaatggaagcgtcgatatctgctttaatgtaactatacatctgcatataaccccagctccatctcctctacctgttccttttcaaacaataccaggatggaatcaccgcaccaccgtccttcaggtacaaataccttcaagtggccagccaggtagttatgaaagtcagcaacaagacgcggcacacattgctagtattttgatattacttctactatttatcgccatcataatcttgttttttttgaagatccctcaaaaactatgggacaaataccacaaaagtaaacatgcaccatctgcctaacaaaacacatttcgcacatataatgtggaaaacacttctaacattaatatctttaatatatgttaatctggcagccgaatgtaaatcaaccacccattatagagaaaaagaagatgattgtgctttatttaaagtaaaactaccagattcgggactttcccactattggtatcgcccaaactgtacgacccgagacatgttgtgttacaaaacagctactggacaaggtgatcttaaagcacacaatccagatttaccgtttacatgtctcgacaatcatactgaactgctatggtgtaatatatggcgaaatcattccggaatatactgccatagtgtttttacatcaacaaacaatggaataaatagagttgatacatgttttaacttaacagttgttcccaaaataaccacaacaaaaaaagcaaccacaacaaagacgacaaccacaactacgctagcatcaaaattgaagactcgcagcacaccagtgataaaaaacccacatatagatggtacacccccaccgtcacatgaaaaaccatcacttaaaaaaccatcattaaaagatacattgcaagcacatacaaccctaactactttactacaatcatatccacccttaactaccacaccaggttacgaagtagtgcagcatactccagaaaaacaggtacaaaatgtcacacacctcgcaactattgtggtcctcatagttgtgtttgttggcatagtcactcttttcatattcaaaattccacaaaaactatggggaaagtatcgtaaagctaaaacacatgcacattttttggaacgggactatgattactagaatataggaaagtccaatagcaagcgtacacgaaacgattatctatcacgtaatcgtttctcttcgttactaatatcacctgtaccagccgtgtaatgaatagtacaggtgaagtttaaagcgcaccataaattacaaattccaatgactctcacatggacacgtcttatattattatcgaatcaattacagatgatttggactttagaatgtacgataactaaagttgtcacaacacaatctggtgctaatgtgcgacttggagactcatcgcgccaaggaaacattgtttggcacaggccaccatgtggtaacgaacaagacgtgttatgtaacaaaacatcaagaagcgaggaaatgttttttattaacagatctatttcatttatgtgcgaacagaagtccaacatgttgaatctacgtagattaacgcccggtaattcagggcaatactgtaagacaatatccactacaaggaatggtaaaaaagagagttatcgagaatgctataatttaacggtcatatctaccaccaaatcaacaccaacaattatgacaacacaacaggaaacatcctcacatagaacatcaaatgtaacaacaccttcaagatttctaggaagaaccgtcaataacaaacgagatagatacgatgatctcgcacctgcattggaacttgtaggctttctattttttatcactattgttgtattattttgcttgcgaacagagctattcgagggtatgtaacatgacaatatacatacaaaaatacctaattcaatggatcatagccatatcattagttcatacgcgcattcaaattgcacatccatgtaaaattacatctctcattaatgtaacagcttacgaaactgtagttttgaacgccactctagcactggacaaatgcttcataatgtggtacaaaagcccaacagaaggaatgtgccaatacaatgcatcacatgcgatgaaagcaagtagctacaatggtaaactaaattacacctgtacattttatacattaaccatactcaatgcaaactcatcggccacagggatgtattatacgcttggtgcacctaacgatgaatgtgttcgagaaaaaatatgttataaagtacaggtacagtttacagtacaacatgaagcacctattgccacacaaattagcccattaatccagaatgaaccctcaatgtctgaatccaccataatatggtatgtatttttagcttcggggctactcataatcatgttttatctagctaaaaatgctcattcatactggaaacatggacattaccacgtgccccaaatatggtggatacaggtggaggaacctcagctataccgttccatggtttcctagagctttccagttgactgtttgactacatcggtttttaaaccgaagaaaacatggagaaaactgaccaccaataattatgtttacacggcgttaccgtaccacacacaacttttggcaacttgtgtttatctcaatcctggcatttattatacacttacattattcgacatctccaagtatacctgttaatgtaaggacgggagacaatattactttaaatgccaccttaaacctaacaaatggtattggatactggtatcataacgacagtatactttgtggatgtactcccaacaacgcggaatccgcttcacgtccactgttgaaatttatatgtcatcggaattgcacaatcactcttctgaacgtgagcagccacagtgctggagactactgcctaatggctaaacccaaaaacgacaaaccaaaagatagcttatgttacaacgtaactgtgttaccaactaatcatcatttaagtaaaactacccaacattcagtaaccacaaccattactactaacccaacagccgttacggtaaccgtaccaactaccacgataacgcccgtgttaactacaacgacagtgcaaattacaccactcgccaccaatgcaaccactatgttaccaacgacaaatagcacatttccatcaactagtatgacaactaataacgaaacaactgtaccacacataaccactaaagcaaaacggactaagaaaactagaaaaaagaaactcggttctactaaagcccctacgactgcactacattcaagtaatcctttgctaacgacagtaaccactactgctgctaccacagtaccgttgactagttcaactactgtaactactactgctcataccgcattaactactgtgactactacacgtaacgcattaagcactggcatagtgcaattaactactgtgactactaccgctcagactgcatcgcccgacagtaaaacgcgttccaatatccaaaatgctgtaactactagtgtatatactactgaagggaacactactgccctaacaaataccaaacccgcaactaccttacccacgacaacttattctacggtacctcccacaacagtagctaccgcatctacgctttccacaacactacccaccactaggtggtacaccacgtcaactagtacctccacaaaacagcgaaacacacagacctcctcctaccaaacaaccacgcctctcctgaactctcctacagcaaccacaattagtcaaaacgaaacaaagtctccacacgttaaacaccataacgctcatcatcaccatgccgtcacacacgctttttgggttattctgttaattgtagttatagtaattataattttgtggtggaataagattccgcaaagactatttcagcactatcaggaacaaaagtatggcggcgtagcgttgagcgatgattggcagttctactaaatgaccttgaaaccaggaactctaggaaactcgtcaactacatattgtcactccgttaaagaaaccgttctaaaatcaccgtctccaccccgtccaggggccgcctccaagggcgatggccaggcacagatgccataaatgctggctcctgtggctgacggtgattctgggaagctggatacacttgctcaatgctctggaaattgtagaggaatacgtggaagaacaggagatcatcatgcaaacaacgagacagatggcgttaagattggcagctgctcctgttcgtggacgacgatcggagattgacggcagaccgccatccatcccgtcatggctagatgttcggtctccaagacccccaagacgccacgatgaaaacaccatgcaacgtaacattcgctggcaacatgaacagatgcaagttttgatgagcttgcaccactcccggatgcaagctcgaggctggaatcctgatcaacgtactccagccagacttccagctcattttggacgctctgcttcgggttctcagcctgttccaaatcacagaattggtatatcgacaagaccaacaccgatggcagaagaagccgaggaacctagagtaacaattgtccgaaacagacgtccagacaattcgagtcccggaccgcgtcttccacacaaaagacgcaatgctatcactcttacaggctccacagattccctggatctcacaagactgcgccttagctacgaaaggcgtcaccgcaaaggatactgtcgttggaaacatcatggaaaacattcacccacaagaaaggcatacataccaccgtccagaccaacaatttcaaatcccatggaattccgaccagcaccatcacctgttccacaaagacgcaccctgaatgaccgcttaaacgacttgcttcgcagacacagcgcccatgagaacatcaggcacaaatggcatgtgcgacctaaacctgaccccgtctggatctataatgacgatgaatctgaagtcacatctatcggagaacgagcaagccttctcacaagaacccgttcatggatccagagccgtatgcaccgcacacacacttggcgtcttggaagctcagggggcggcaatgaacctttggtgaggtcactatcgacagagcagccacgcaacaacaacgccaatcaatcaagaccgcattcaccatcagaatccgtgcaagtgaatctcgagaccggagaagttgtggttacatgtcacaacacgggagcgaatgaacaacatgtgttgacatccaatcaactatgcaacagaaactccatggaagtgaccgatgcatgcaacagagaaactccacgtcgagcactgctgggttccagcatagctctctggctctccggggtgtggatgcggaactaccgtaagtcgtcctaagatcaccttgacattgcatgctcgagaggtgagtgaatcggtgaaggtgggagagggtctcgcatttttttatctctctctataacctagtgatccgcaccacccaggtgatcgtgctaaggacatagctgccagtaaactctgcatattagctcattgggtcccgccccagcaccaccctaaccttttggaatagaatatatatccaacattcaaaacactaagatttcaccgaacatagattattttgtccaccaactgcactcaaatacaaccagtatgtacttcattattgtattgctgatcactatactaactattgattgcgtcccccctgcctactgggaccaattcctgcatccatcaatggacaatggcgaagtatcggctcccctgatgccaccgtatggtgatcgcttcaacctaacatgtgactttccaaccggtgattggagcgaagcggcgttgcagattcgtttttgctatcaccccagctgccgcagctttctcatggtaacacccaaggacattaacggggagtttaaaaacaaaagcgacaatcatctgccggagttgcagtggaaattagagaccgtcggccccgtacagagactgactgtgtcatttctagttgtcagcagtgtatctggcatttacaggtgtaccattctaactggaataaacatagaggtgttgaagaccgtgatcatcatcgcagatgtggagctacgccgacgacctgacacgtactgcgatatcaggttcagccatctgtcccagttgcaatacctatggacccccaaccctgataaggtgaggctgctaaactgtggagaggttcgcgaaaggaacagtctatggcaaaaacatgtacattacgcggtaggtatgtctggcttggagccatcttgtacagtgaacagagatatggtgttgtgtcatcggtatgtggctgagagtctgagagacaataactgcacgagggctgccgaagagaaacgcgcaatgattctacgcggtaagccgctcgaggaggactggttttggatgtgtatggcaggcatgttcaccatatgtatcgtgggcatcctgacactgtgtttgagactccggtacaagaggcatcttgactggagtcacgatctggagagacggaggttgaaaaagagaaactgaggagttggcattttttttaagttgtgggtattggaaagcgaataaatgaggtagctagaaaaagccatgcgttgtacaagctagtgatttttttaatgctatgtaaatcatggtgtcaaaggtgacgggatattgattataatgtgaaagtgtgaatctaacctgatcggggacatggaaggtgggagggggaagtatgtgttgattatttcctaaataaaacatttatactgttaaagaaactccatgcatgtttgtcgttattttttatattatgaaaaagctatccccacacgatcatgatcctacataaaccttcccaagacaatttctcctgggtacacaaatggaataatatgtcaaacgcaggtaataatatctatccgcacattgacaatctgtcatccgaggagcgcataaacttggtccaagcgccactaccgccatgggcgaccgaaaacgacagtctccaggaacgcatcagcatatttatactgtgcgttgccgtggtgctgtttttttgttttcgaatccctcagagaatgtggtggttctttcgttccagacccgttcgtcattccgggaactgctaatccctattccgcgaaacgagtttgcgtaagggatagtgtttcagaatgagagcgaggcgtgcctgccatctgatttcccagaaatgccgtctccgcgcgagcgcatggcgactatactgaccgccatagggataatgttaatctttctattgtggggcatgcgaatcccccacaccattttccggcagtggaaacgtgatccgggggactaccgaatcagcgaccgccaggaacttggcgattacagcgtgatgcaatctgatttccgaagcacgctataaaaatattaagttccgtaacctggccgtgattcaagccgctgcagcctgatcaccaaacggggaaaatggagcacgctctgttcgatcacttcttcggacgcccccgcgtaagtggctccaggcactccctgctgagagccgagaacgagtgtgatgatgaagaataccccccgatcccgcgggtaccgcaagtgccgccacgagtatcgcagacgacccgagcagcctggaacatcgtagacgtctgccgcctccttccattgcagatgagattgatggtagccgaagaagaggagaagatgacgctcacaacatctccaagaacacataaaaagaaaccccgaaaattagtcgagatcagtcccagaatacggcgtttatttacttaaatcaaagaatgattgacaggtgaagaagcggagcgcctttctgagtttatacaataaatccgcctgattcaatcatgttggcattcgtgtgttttatttgggtgtgattctagtgtctgaatcagaaaatgagtgtgattgtaatcgtaaatatgcaatcagcacgctcacgctatccggcggccactcctacctggtctgatataaatgtaacgtaaatttcataatcgcctcatatcaccgtgcaacgttcatacggcattatcaaattaattactaacagaagagttgcgccaccatcaggtggttttgggaatctacaggcatcatgtcccagctgctatacgaatgttttaaacgacagctgcctaggaaaccaacaaacagtgtggttttcctaaaccgcagagcactgaccggcaaaacagaaaatatgacgtctatggcaaccagcacacaccgaacactgctagttgtggatcatggtaaactgaggctagaaagacccagcacctcggagaccacccagacggccttggcattgtcgttgcagcgatttgcactccagtcatctggggatgatccggaacatgacgatatggaccataatgactgattacggaatgcaaacggcaatgcgatgtgccttgtcactcatgtgcgtcaatggacatttcgaaataccagagacaatgacctttaaaaacaaaacaccgtcaagaagatgcactgcatcaacatgccgctgaggaccttggccagctgccttgtgttcctcacgctgttcgtgtacctgcacagtgattatgtgtacgtatctgtgttgacccgctcgcatggactaacatggaccagtatcggcggcgttaacgatacagagattagcaacttatccaattacagcttcaatcaagataatgctacaaacaccaataattcatccaacggaaatggcagcgtgtcgcaactgtctgacggatgtctcacgcgaactgaaacatacgtgtcaacgatctggatattcaactgcactaaagatacatcagtgacggacttttggtatctaggaaatggatacaatcaaagcgatgacacatgtaaatcatctttagctacatacttgagcagcatgtgtaacatttgggctaattacagcaatggcaacgaatctcgtcaagatcacctgaacatatctgaagtgcggtgcgttattcctgaaacatactccgttaacaccactatccaacaatacaacgatacagaattggaaaatcaagatcagcaatatcaccagctattccctcttcgacatacatgcagcttggtggaggcgctggcctttgacatcgtcgagagatacgtgtacatctcaagattatgttggaacattgcccagatactcgcactgctatgtattgtaactgtcagtcttgtggtttggatacggttccagtattgcggtaaaatcccttgtatgtgcctgctacctcccaacgtttcagccgttcctacgtgtcaagacgtcatcgtggagaatgtcaatcaaaccgaagaagacaacacatctctaaacagccccgtggaaccagagtcttcagaaatcactcccattctatctgcttctgaaaaaccctgcgtgcagaaaccatctgtaccaccaaaaccaccaaccgtatcttctcagttcaaagtgatgcatgctctcaataaaccatgcatgttgccaaaaccaccaccaaagcctgcatcgctccagtctccaaaaccagacgtgtttacgtttgacgagcaggacattcaaaggcacaaagaagaaatatccaaacaggttaaaccaatgcgtattcctgttttggcacatcaaacatcaacactaaccaggactacacatgcttcaagattgccaccgcctcctcggcaagcaacattttcaccacgagcacctacaatgattccgtgggacagaaagagtcaaatgtcaccagtacagtattcctcatggagacagcaatctgaatcgctgcctgcagaattggacccatggaatgtaaacccgcacaggtggttgtgacctgacatgatcggaaccgcaaaagactgacagtacaatatattgcaagatagatatggtgtataattgtgtaaataaagtttatattttataatatacaaattaagcgtgtgcttcttcattattggcgttcggcaaacgaaacacgaatcggggtctgggattgcgattctcgacttgggctcgaatctcttccatgacgaggatcataggctcccccataagtggcaggtcatcatctaaatccataggaatttccaccacctcagccacctcgggaatctgtagcggttggatctggatctgctgtcgctgcagatagttttgaaacagccgtctgcgggcccggggagcgtacatgccgagcggacgatgagcgggttgattgactcgcataaaagatactcgtatagagggcataagccctcgtatagcctccgtgaggagcggatcggtactgcctcccatgatacgccagcatggcagccctcagaaaccaacgttcctaaatactactctaggtctgacgtcagggtggaacatcgccaatttaacctgcaaaaccgtacctatacaaagttacgccccgtcattggtcccttgacacaaggtatttaatgggacgagagccaggaaccgcctcatttgacttcagtccaacagcagcatcatgcagaacatgaagctaatcgcgattctgctggcgatcggtctggtggcagtgcatgccctccccaggtgagttactgaaccgtaacacggacaggcattccagagtacagacatggtttttcgtgtactatacaagtgacgttttgtcgttttacaggtataccacacaagataaagatggagtaacgggaacagatgtaggaaatccagacgggacccagggaaatgacgactctggcgtatctaaagttcccataacgcttgagggtgacgacctcccatcgggggacgatagtacggaagaaggcagtggagatgaaatccctgcatacgatgtattcattgaaggcgaaatgaatgatggagaaaactctgaagaatctgacgaaggttctacagaagactaaccgcagtgctgccagttcccccctttttttatgacaaccacctaataaaacgtctatcgtaatgcctgtgtatgcgtcgtcatgtcctttcatgcgccggctctctacaaatatgaaccgaacaagcatttaccgtgattgcaaacaactatgcctggttcagcactgagcagagctagatcagtgctagctattatcgcaattataatgttagcaatatgcaatctttacaggtgagtaagactgctctagaatacaacctgttattgaaaaagcaacgctcatactttactgttctctattgtgtagctacggatttccagttactcgtcccgacccgccaaatgagaggagcccggaagacattgatgagccacaaatggaatgattataaaaaataaatctttattgattacaagtgtgtaccggttttgatttattgcataaaaagatgggtagatagaaatctgagaacaagcttatgtggcaaaatgggtggagctgcagctgatgcgctgggaacgacgacaaatgctctttcgctcatagatatgcgttttaccataagggcagaccaaatttccactgagcttgcgcatcttcttatcgccatagaacacggtactccagcggtatcgaacaagcccgcgcatggcaaactccatgaccgtgtcagccaccacgcacacgccattctctgtggtagcgtacatgcgcaggtacgaatccgcaaagatgctgattaacctgtccgcgatcgctatgcgacccacgggctctactttggtagtacccactatgcgtcgccagtagtacagatccagtcgactgaaactggtaggtagagacacacacaacatgttcccgtcacccagtctcatcaaactgctagcgtgcgcattacgccactcgcagaggtcattgaggttctcacagatgaccaaccgtcgcgtctctttcttcctcagcacattggcattaggcacgaccatgaagctgcatcttctgagtccgtgcaccagaaagtcgtctatgtcatcggcgatccacgtgagagcatcggagtacaccacatccacatagaggtagacgttacccgactgtccgacatacaattcggaaggcggagtgccttcacgatgcttcaaaaaagccttggtgcagatgctgccgacaaagtgtagtttttccggacagcagagatactgtgacagacgctcttcctccttttcagcatttcgaaccgagcgccaacgacgcagaactaccagaacacgatctttaggccaaggcaggtgtatgcgttggcccgatttccatttgcttctgttgacgccgcttcctctgcagcacgtaccccaagtgtaccagcaaaacattgtgccgagccccacagagggaaaggagccagctggcatagttgctttatacaagcacgtcagacgtgtcccattgtgcaaccagctgacgtatgtcagtcatcgttgtgctggcggcctctgggacactcgggcacagtgtcgtgtaattcacaatctccagtgaatcgccgattattcaacagttgccgtagccccaaacacatgaaggcggtcaaatcgtcggcaagacgaatgtagcggagattaacgaggtcgaggcagaacacgcggccgccatccaccaggacaatgggaactctggtcacgggccatctcacatagcatggagacgagggcatttcacctttcagatccacggtgcccaaacagatgacctggtcaccaaaatggctccgaagcgagcgcagcataaacccgctggttgaggtcacttcaaaacacttgagattgcacagtctcagacaggccccctcaggataaggcagctgaaggtagttaccgtgattccgcgttacataacgcgacacggcctcagggccagatttccaagcatttctaatacgcctaaaagagcgcttgagggcggatgagcgtatgtggcgaggacagtaaagaacatccacggcccggagacccacccgctgaagctccgagaggttcttggctacatagtacagcgagaaatcttcttctacataacagaaaacctgtccctcttctgatactagaatgatgagggtggtcttccgctgtccgtgcaccagcacaggttctccaacgacacgccccaggaacgccagacgcgtctgacagcagaggtagtagctgaggcgcctgatgtcctcggcagtgtagtcatcatcagcctccagttcttgcagcaccaggtaccagccgcgaggccagggaagcgcaatcttttgtcccgaattgagcctcacgtaggcctccacgcaacccagcccgaactcaacactcatggcgagactttctatatcgctcatgggttggcacgccatctcaccgcaagactttacactatataacgcctcagacgcttgccacacaggaccctggacgtcgcaatgtacaccaagcgtgggcaacagcgtcgctcgcacgagggagccgggcggctttatacctttgatgatttggacgatgaggtgtttcttgacccaatcccccgcgccccagccaatgaattggacgaaatggacttgatggaagccggtttgttatcgtccagcagtcaatccgataacaaatcatcttttgaagtcgtctcagagacagacagcggctccgaagcggaggcggagcgcggtcggcgcgcggggatgggcagtcgcaataagcccaccaaaccccccagacggaataaaacaacacaatgtccgacggggtgcgtcgccagcgaaccagtaatcagtgccatcagcagcgaagacgagggggcgaccacgcagagccaggaagaggacgacgacgaagacgaccttgacgagggtcatgaaacaaccatagggcagcgtacggtcactatatttcgtcagatatactttgaacgttcattagcacgtaacctgggcttcgaacccaccttgatttcccctccaaacaccgaattcctcaagttcctcttgtatgatttttccgtgcaacacatcacccgagtcaatcaatgcatacccatgcccacctttctactcacgagtctcattaaccctattgcgaaaacaacttcagctggtgagcgcgatttaacgcgcggaatcgtcacccatgcggtcttggtaaactacttttaccaagccaaggccaaagttcgaagcatgcaatgctctctaaacgctaccattcatgggcaaaccatgaataacatagcaacttatgttactaatttaacaccaggtggacgtgcggccgccctagctcttcattttctcatgcctcaaaaagcggttatgacaaaacaataccaagcgtgccttcggcgactgagcgaggagctccgcaaacgacgcgtcacagagtcgcccagtaccttagaaatcctagaaaccattcgcgactacaatctaatatttcccatagccccatacactaaccggggggcactgtacctgtaccgcaacaatttgcagaaattatctaacggatacaggaacgtgctaaaattactctcgagcgagaaactaaatgaagaacactttgtgaatgacttggcattcatgcttggggtccagttaatgcttgtccagtttgaacaaacacttcacgtcctccgcgcatacataatgcaccacctccagaacctggctactctaatttacatcatctatgtgcaatttccttctcttcggggcgactatattcaagtgaccgaggccatctatcgcgccactactagccatggcgatgaacctctgtttcaggttaacacatggctgtttgattatctcagggcagtaagaaacttagaagccgtggtgtgcccagattacatgatgtgtgcccttcgtcagtggactacagtccacgaggacaatccaatcacagactacatgtttcatgatccggccatacaagactcacgcatacgttgcggagacactcaaaccaaacttttggttcgtaatttgtgctttacacgcatgcaagggcgccccacctctcgccagactcccgtagagcacgtgctcgtacccaccgcctccctcaacaggccctatctaagatgtaattccacggaagagagggaagtaaacagtcaccgcaatctgacattgcgatcgttcctagaaactaatggcaatcaccccatgagccagctgcaataaaaaatataacaaaatctttattgattgggcatgaataatatacacatatgcatacaacatttatgtagatgacgaggatgatgttccaaccccgctttttcgtgcacccgactccggctgaagagaatagtcaagggctggtgtaaataaagatgatgacataattccactggcaaacatctcttgcgtgagttcttctgggtcctccccttctaccaccgcgttctgtcgcctcaaacagggtcgggtaaccaaagaggccgacgcatcgctctccgaacgacttccccttctgagtcctcttcgctgagagtgctgcaacgctcccgctcgagctcgccttacgtcatcaaagtagccttctcgcacgccctctttgagcaactcagataacgagttggccgccttaaccacatagttatgctcaccaatctcataacaaaaaatgccaccgcacccacctatggcggccaccggtcgatcccaagtaaacatctcatcggtgccaatggtgccaatcacgcgcaactgtcccttcatgagcggcaaaagcctccagtaactaaagtcccggggggtgagaatagtgtcatcctcatcgcagacgaacaacgtataacctctaggggagggcaagtcaaagtgacggcctctattccgtcgcacataatcttcgacattaaaaacgcatccagcttcccggctggtggccatcctgattgttctggtgccaatgacatcattctgcttttgattgatttcatattgcacaaccgcccacctcgtgtggtcgaaaacgacgaacatacagccggtgaagcttctcaatgtgtccctgataccgcaccgtgaccgtggcgctggtcgggatttcaaaaggcgccttgcggcgacaacggttggcgttgttactgagctcgcaatctgccagaagcgagtcgaaagtcattaagagacccggatccaaagtcacgtcaccatgacgaaaataataccaagccagtttttcgcccttccgcgtctctgcagatggacactcataaacgcggcgcagtctcaacagatgcaacaggaccaattcgcgcttgatggtcagtgaaatgcactgatagtcaggaatcttgttaactatcttaataaaatcacaaaacgtctctaagaaattggaaacggtaaaatgaatgtgcttcagatcgtgaatgtgccgtctaaaacgggacagctccatgcgctgtgtcgcattttgtgctaaccctttacggatgatggacgcctcgtaacgaaacatcctgataagaaaagcgacatctttacacaaagcacgtacacaagcactatgttcatgacgaatagtgatataaagcagcctgatgactttgagagccaaaacagcattagacatcaagtacatagcataaccttcgcagggagtaccgcaggacagccccaccggcaataaaaagtaatcgtctaccagagtgtgtgaccagtccgtaaagccgaggtccctggccacactctgctgcacacgcagctgctcagcagctgtcaggtgacgaatagccgggagatgaaactttcccaaatgagcattgtgaagcaaagtgagctcggcgtcctccagccgaggctggggaggagaaggctcttcttccgatggtgttgcctgggtatcggatgatgccacaaacaaatcatggcagtcaccgcatgtgcaaaagcgcgcgtaaagagtgtgtagtgcggcttcggcgcgcagagcaaatcgggggttgaaaaacacagcattcttttgaacgcggtaattaacagggagtttcttacagaggtgagggggtaaacatttttgaattaaatccctatcaccggcatccaaaaacaaacacacggtacccgccaggcgccggaacagttcttcggtaatgacacaaagctggcgtagatagtgagttttattgccaaaaactttgtagtttaggagggtagacacagcgtactgtccagtggccacggctagcgcaatcctttttccgctcttgctgatctctggcagaaacggacccgccgccacgagccttcgaaactgcatgaggttcatccagtgaaagtgccctggatcgggtctaagcggcacgccgcgtaacagaccccagacggccagatcggtttgaaggctcagacctcgaatattgtacttgccgtgtgccgtggcaaatttggaattcaccagaaagctgcgacgtatgtagataatgggactctttttagcactttccgcattctggaccacccgtgtatcgcgaggctttttggttaaagaagacgaagaagagtcaacagggaacaagccggcgagagcggcctcgcgcagactgcgcaccggcgtgagataggtccgcacgaagttgtgacaaaaatcatcatccggacagtcagcgacaaactcgaaagcggcatgctgatcagagtaaatgtcatctagcggcggattcgctgtcatgtctgcgcgctcgcagcgtagtgatgaatcttaactatataccctaagtaactgggatgtctgccaggccacaaaaaaaaaggcgcttcaaggcgccgcagctacagattcgtcgtgcagcagactgcgagtcgagtaaacgtattcactcacgtcgcagaactgtgctttttgactgctgacgggcatcgacacggagcccagaggagaaaaacagaagcgacgagagcagcgaaaccagaatgagccctgtctgataaagccccgaagcgtttcggccaatttcagcatcaccgtgccgtagagcagcacatgcacacagccgttggtgtccagaaaaacggccttattgaccggctcgatccagccaatgacagcgtacttggccctctcgagaatcccgatcacaaatcggttggcctcgttcgcctcggccacattccaggaaccgaaagtgaaagtgcatgccggccgaccacccaagcgaatcttggttccagcatgcaattgacagaaacgcacgacggccttgcggtcatgcaacacttgagacagatcatacatactggtaaaattgtgttcataccaagcaccctccacgatctcgtctacatattcccgttcaaagtagctacagacggcaaaaaggccggtctcaaagagttcgtggaacgacaccgccaatacataaaccttgtcttccgaaggcatgtagcagaacacgtgtccatgattggaaacccaaacctcgggcgactgtgccgcttggggcgaacattcatagactgtgatgacacccaagaaatataacctagaagcttctcgaaaacagcagaagcgttgataggtcttcctatcgcgcgtcaccccaaagtacttgagatcacccaggagaatgccgtgcagggggggccaagcgagaggcagccagcgccccgcattcgcgcggacgaaacgctgaagatgcaaaccgccagggcgctctcgggaccgtccgcgcgtgttgatccaagcgtcgcgcagacctcgccaaaacgcggtaaatctaggctgtcctcgcagatagagcgccgtcagtggctcaaagtgccccaccaccatcctgtaggggacaaggaagcaatacaagatttcaataaatttagcaaaaaccacacattggataggattttttctttccctgcgagatttttgttaaaaatgaaatttacccatgtattgtttcttgtccctaccttcgcttcttgaacggcagtgtggtacccggatagagctcgtaaagcgtgtgacgatccacaggtccgatgttttcgtaacgataatcatcaatcagcggacacagtccgatacgcacaaaggttttcaggtcacgtgctatgcgcgtgaggcgctcctgacccaccagcgccacatacacaatgccagaatctccgcagaaaaccttaacccgctggaaaaatgttttattcccttccccttcaatgacccccagaagcaaaatgggttcacgaccatagctgaacctctgcaagcgccgtatagcgataggcgacatttccaaatcctgagcattggccaccaacacataatggttctccggccagatgagtgacagcttggcgttacgatgttcctccacatactgactcctgtgctcgttgtcggggcaatccagaagctgtctgaaacacaacaacgagtgcaagtaacgctcgcgcgtgctaatgcgagaacgctcacacatttcgactttttgcgccgatgacaagggagaaacatccggctgcatgcgccggcagatggtctcgtgcacgggatcgcatcgaatcatacccctgataaaaaagtcattgagatccgaagccacctcgtacagacagtcctctttagcgtcataaacaatgacagccccgcaaggatccagaaacacagggtacttgttggtgtaatgcgacacggttcccaggggttgcagaacacgagattccccgaaaaagtcattttgacagtgctcgagatcaatttctgtaatggcgtacggcgagtacatgccgccgaccacaaacgcgcactgagcgggccagcccaacgacacacacgagccctcgaaacgcataagatagcgtttgaggccttccgagtcacgtctcatacagagttcagacaagctgcgcgaacagaacgtttcgggcgccgccgctctcttccgtcgaaccaagcgcggtcgactctcgtcacccatattgcacacgcctttcacctcggctcgctcagcgaaaagtgtacaccgcaaatgagcgaagatccgcgcgacactagcaacctttatagcccatcatcatcccacagaggcgaaacaaacaacagcacacttgaactttttcgtctagcatttcatctttatttaactctgcgttaacctcatgtcgagccgtatcccaaaacacagactggtcttcggaagataaagtatcataatactcgagcattcgggaaacatctgccacggctacgcttccccgcagaaaacgtttcaaactttccatatgccgctgacgctccgacatcatttcaacctccagaacagatgcattcgcgcttcagattctgccgcgcccgtctcagctgctgtaaacgtcgatgctgtactcctaagtccacctcccgattgaaatcgtcttggtcgcgaatagacagagtgctataaaattcgcaaaaggcctcgataccgtccatatctagctggggtttaagacaccatctcactcgcatctcccagaagtacacccattgaacgcttcgagcggccgtgctgacagccttggaacgacgtttacaggtcggaaagctacccgtgatttggaacttgatcttatatagataacaggatgtccgtcccagcaaatgtcgaccccgcaacccaatcatcggtcgtggaggagtcgcccaagccctcatcaccatccaccgttgtcgtttcatcgtcgtcatcatcatcttcatctccttcgcctaccaaaataatacagccgctgtctcaacaactattgccccaagcaccgcaaccgggaaacatcgtagttgtccccgcacctggcccggatccagattatagattacccgaccttcgagtggtgcggctatggctagaaactctcaaaaccgcagacagggacaactttggtcgctgcgtgcgacatgcgaaaacgcaccgcaccgcttaccacttgacagcgtacgagccgtacctcatcgctctgaccgatcagtacaacggcacgccttccgtgacagagaaggcttcgtatctgcacggctgtctgtttttgtcattccctgtgatttacaacaacacacaaggaggcacgtacaagcatgactggagtaacgtatcggttccgcgaaccatgctacgcgaactgttttttctgctgtgttctaccagcgaaagcccggccatctttcaacctatcattaccaaaggaggcacgtgcgcctccatggtggtgtatcccgacgagacggccagtaatttcaccaatccccaacacattggtttcgtatacagcaaactggtcatgattccctttgttccacacgcattcccatcgtacggcgttcccttcctgaccttaccgactcacatgcgttactgctggatcgaagaagcgcctttcggtcatgctacgctgacgcgctacaacgatcacatgctgttccacgtagaacacttaacgtggacgagcaagaggattactaatcatggacagaagaaaatgtcacgatacacggctcaattcaagggcatgttaccagacacgtatcttaatgggactcatgtttggacatcttccaagaacatccagtacgaattcatgggattgctttttaccatcaacatcgacaccctgtgtctggatctgcatcacgggcaatgcatcggatccatctcaagttcatactgccaccgtgtggcggacaaattaacagccagaaacatgcctcgatcattcgttttttatttactaattgagaatcaacaacaatgtactgtacagttcaatcgtaatccgtatttgtttttcagcggcgacgggtttaacagcccgttgctgaacgaacccagtcccttctatctaacagttcacgctccctacgacatcaattttggacagaacgctcggcagacggtggagatcgacattcgctacgcgcacacgggcggacggtgttttttggtcgccaacctgccgtacgaagactccttctacaccggcatgtgcgtgtggcaggcagatgcactgaagataactctctggtcgcgcttacgcaccaccattattccccaaggaactcccatagccgtgttgtatcaaatcaacgagacggatggaaacctgtacgcgtataatcacaacacggttttccgtcaagtaaaccatgccgaaagcacggccttttaccttagcgatctgaagctccctacgaataacttcctaacctcgccctaaaatataaaatttattcctcatttattctcgagtcttctttaattttttctataatagcttgaacgttatctggaacgggtatagtgcctgacgattcatctaacaaatcttttaacttagcttcatcggaaagttttggagtatttcttggcgaggttaaaggctccgctttcattttttgcgcacgtccacctggaacttcagtagacgatgcagtttgtgcttttgtggacgttgtggtagttaaaccgggtgtaaacgtttgaattgtcgtgggaaccttcacgatagttacatctttcccggggattggcgcagaaaaactggcaggttttaggacactgccatcgacagtgagaggtgtagccttaattacttttctaggtttaagaacactcgtgcttggcgacgtgacagacgtaaacggaccaaaactaggcttaggctttggtataatctttgtttttggcttcaaaattaaccgacgttttgcttttgggtccgacacaggagggacgggagtagcaggaggaatagatgccacactaaccaccgattcggcatctgacgcctcttcgtcaccatccccagaagcaatatcttcatattcactctcacttatttctgcttcgcttttcacctcgcgtcttttgttaggtgaaaaactactttcacgatcactgtaatctgaagcaggtggtgtctttgtctcataatctgagatactatctagacccgaaacctcttttaacggggtctcaagtccaggtattgtttctgatgaacccgttgcgaataaaggattcgaaaactgggtagcaaacggggaacttagtatcggcgtctgaataaatttcggaagttcaaacttgtatgtagatgtagacggtttgtcatcatcgtcaagttttaggcttcctaaaccaccatcaaaatccactaaggtgtctacttttacatcatcagtttcatctttcgcgcgaccctgattttcatcgtccgaccaaaacgttacgcgtttactaacagggtgaggagttttaggctttgtatcccagaactgggacgattgtttagtaggtgacaaaaggctaaaagcatattgtctttcactcttatctggcactttgcgttcttgtttcttggtggtaagcaactgaccattgtcgtcatcatcatctttagtctgtcgcccttcccaaccacctctcaaccatttttgccactcgcgatgcagttcttcgtcatcatactctaaagaaaagggatcacccaagctctgactgacagatcgtgggaaaatatcctcgtagattgcaaaatcttccatcagcatctccaacaacatatcggccgattcaccgtcaataaccttatgtttgataatgttagagcagtaattagattcaaaagacctgcaagatcgcagctccttcatcagtgtcttacatagctccttaatcttaatgagacacttttcggccaagatgtcccaagaggttctgacatgaacaatcacttttccgagatagatgagtttgttagtggcatttaccagagaactattggagtgacgctcaagatgaagcttcactggccgtatttcgaacatattgttagatatagctagtaaagaatcttctaaagccatgacgtctttctgacgaagttgaataaattctatctcaccagtacccaaaggctgacactcagacaactttgccaaggccgttgcacccaccatggcattctgaatcacagtaacatccgtccgagaatcgtcaccaaaaacggtggcctccaaagttcgcaggtgaggccgagcctttactggatctcggaagggatacatgtgtgctcgccgagtgacagcattagcattaacctcaaactcatctaaaagcgatgataaatcaggaatatgatagcgcaattctcgatagtaggccaaccagaggactaattggttgaacagacagctccgtctgtgcaaaaacttttcgccgcattttctgagaattttaggatgctgctctaaatctacgttctctttagtcggcagggtctttaaaaagttagtgatggcagtcactttacgaggcggcagcccgataaactttaaactcatgattgtcagccacagaaaccggaaatttcacgagatacggctgtttcagcgttctgctatccgtccaggcgggttatggaaaccattcttcacaaccgaacggtgagtgacatttaagacagtttaatagccaacactcgtaacgtctcggaagctgataagtttcgtttttccacagagtgaaactaattccattttgcacatcaacaccacctgcaatgtgaccgactcactgtacgccgccaaactaggcgaagccctcgtgaacagcgcgctagctttattcggtacccccctcaacgccatcgtcctcgtcacacagctattggccaaccgagttcatggatactccaccccgattatctacatgaccaatctttactctgccaattttctcaccttgatagtacttccttttatcgttttaagcaatcaacaccttttacctgccagtgcagtaacctgtaaatttctctccctgttgtactactctagctgcagcgtaggttttgctacagtggcactgatagcggccgaccgataccgagtgattcatcgccgaactcaagctcgccaatcctaccgtaacacatatatgatagtaggcttaacgtggctcattggcttgatctgcgctacccccgggggggtctacacaaccattgtagctcaccgcgatggggaaagtgatgctcaaagacacaatacttgcattatgcactttgcgtatgatgaagtttacgtcctcatggtctggaaacttctcatcgttttagtctggggcatagtgccagttgtcatgatgagctggttttacgcgtttttttacaatactgtacaaagaacagccaaaaaacaacaacgtacgttgaaattcgtaaaggtattactcctgtcattcatcatcatccaaactccctatgtgtcaatcatgatttttaacacgtatgccaccgtaggatggccgatggaatgcgccgatctaactagacgccgagtcatcaacacgttttcccgtctcgtccccaatctacattgcatggtcaaccccatcctctacgctctcatgggaaatgactttgtgtctaaagtgggccaatgctttcggggggaactcacgaaccgtcgaacttttctgcgttccaagcaacaagcccgcaactcggacgatgtaccgacaattgtcagtcaacaacccgccacacccaccatcgtcaataagcccgaaaaaaacccgcacgtaaaacgcggtgtatctttcagcgtcagcgcatcttccgaactcgcagcggccaaaaaagccaaagacaaagccaagcggctttccatgtcccaccaaaacctacgtctgacgtgaattttcctagaggctgcctccacgggtttacatacatatctcggtacttgctacacttgatcactttactgcggacaccacggccaatcgcatcgggtaggagtggcgacacggcattataacgaaacgccggctggtgccacacgccactctgatagattgccgtgagtctttttctcaaacggtaggatatccgcattcgagatgacgatgaacataatcattactacccgagacttctccaacgacgaatctgtggtggagacggcggaactccacaacagcgtcgccaattccatttccaaagcttacagaggtacgatccgcgcagagggcaagaagaaattgctgattcgcaacttgccagccgcacctgggtgcactcgacgcaacagtaatttatttattttttgtcatgaccgggactatcgaaaatttcaccagggcatcgtgcagttaaagcgcacccgcagccaagtagacccctccgacatcgtgaacgtgactaagaacataaaatgtcgcttacaaccgcacaatcaagatccaccgttaattgccggacagcttcagaacaccatcgcgcacgtctgtaccctgttcaaccagctggtattcacggcccaacttcgacattattgcgagaaccacgagcgagtcgtactgtacgcacgagacgagctgacccggcgctgcggagacaaatccacgctaggcatacacatctatcaactcatctcgctgttggaccaagaccgtcacagcgaattgtgccatgtactcgttggcttgctgcaccaaacgccccacatgtgggcccgatcgatacgccttatgggccgattaagaaattacttgcaacagaggtttctgcacattctggtggaaagcggactccaggttgatagtattttcgagagttgctaccacagcgaggcataccggctgctgtttcagatcgcacaaaacgaatcaaacgcctcgctctcttacctattcagctagcgttttgcctgtcatcgaaaacgaaactgaagctacacctgtcccgccgtgtatttaatgaaataataaaatgtttcctatgaataaataagttttggtttcgtttttgaaagagctaccatgagtctccccccgtcgatcccagccctgcccgtagacgccagtctaaaccttcgcccggacttgttttccgatgagcaccgccacttgttggtcgatatactgactcagggttgcggaggctacgtgggtctgttgtgttacgggcttcccatgcctagctatgtactggaaactctgattgactttcaaatcaaaacgatatataccaaaattaagcagatcgccaatagcgttatcagaatatgtatcttggctaattatctaaaaaacagtcaggatctactggtcgatctgcaagctaacctagacgaaataaactcaggtgcaaacaaacaaagattgtatcgcggactacataggatatgtcgccaaacaaacatgatggatgtgtatcgaaacatgagtcaactgctagatgccggggacgtaaccatgggtgtgtacagacagggcctaacgcagatgcgtgcgcttacagaagcgttggatctaaatcgggaacccaatttacaaccactatacgaaacgctcaccagctacaacctcttgtacattcccccgccatatctaagcgctaccgctgtagaaatatacagcgaaaatctcagcgatctaacaaaacgcattaaccgatcgtttaacttgcaaacgcagattaacagatctaaacgagccgactatgtggtaaacgatgtactgtttctgctatcggcccgacatttacaatttcgccatagactggaactacagatattggagacctggattgtgaacaaatgcaactacctatgtaatgacctgtatttcgcatacgtccaggttccggaatgtcgcggcacgttctgtaactttgtaagcggtttacaagtcgtccgcaaggaacgtcatccgacattccgtcccttactacacaacctgtgtagccttttgaatacatttcacgaagccaacgtgtacctctgcccccaatatttacatagcgccatctttctactgctgcggagagtgtccagagttagagagggcgactcttcagactcggattctgaaaaccaggaagcagcagaagaccgagacactctgctaagacgctttcgagagggagacctcgatctcgaagtggatcctacctccacccctttacaaaacttttactttgccaaaaacccttttggaaattcggaaatttttcgtattccagaacaagcgagtcgctaccttcgtcgcaacgcgtggatagaccgcagcaacttaacatacatatcctataaactccacaacgggacattatctgaagagtctttcccgatgcgaaatttgtacagccttattatggaaggcgcttcgcgacaagcgggtactaacgccagacagtttatggcagctctacaacaagcacccttaggacacgatgaacccggagcagcggatcatagcgatttgtttgccgatgtggacattcgacccgcacaaccgtcctcagggtcctctgcctcattgtcaacaccttcaacgtcttccgccccctccggccaaccctctcccagcagactcggacctgaacaaccgcctcgtcagagacgttatctcagtttgagcaacttttcaccttattcagtggctcgtcatcatcatcggcgacggcggccgcgtcctcctcgaggaccggctcacacctcgcggcaaggaccagacattgctgcctcggcctcagcttctggaggcgaggaccccagagacagtttggcagaagaactggaacaattgtaggtgtgtatatagacatgcacggaaactttacaaacacgtttgtatgatatgtaataaaaactttattttgtatatattgtcgttatgtgatttattgctacacatcaaataaacatgttacacataggaaactctagcacgacccattccgcgtccggagcgaaacagtcggaggcgccgactagacacacaccgcgtgcacacagtgtcgtcaaaaagatatcctcggactgtttcttcgcggtctgaatcgttgtcctctgcgagtccaacgaacgacatgtcaaaagctcgcatgtccgcaatattgccgagcatttttgatctaacatcttccatatcgtagatcagagaaggtagcaaaggtgaatcggaaagggcttcgagatgctgaggccagaacttttgagtgacagacgagtcccgcatcatcatgtccacgccaaatctgatatcggcttttatggcttcataaatgcccacaacgacatcggcctccgttttgggcggtttttcgtcttcactgtcatcattgaacatgatcataggatcactgggttcttcaccgtgcatgcaatacgggaccttttccaacctaacgatagctgtgcgtctcctatcgtgtctgtgattccggtaacccttttttcccatcatgcaggtaaacattcgcatattctcagctaagcgatagatggagtttagggcgggatcaaagccataaattgtaccgaacttgtcaactagtacatagagtctgactaggaactcatttttttctttacggaagcaacctagcaccccgagcaattgattaacacacactatacgagccacgcaacgcaccatgatttcaaaggagcgcagccctgaaggtgacatgagactaaaagaagtgtcttgaaaattggccactgcgctgtcactggaccacaaggcaaaatgactgtctacttgttcacccaggggatccctaatatcgtagacgcggtaaccgttcttcgcaaccacgtccgatattctgtccacatcccagttgaagatcataagctcctttataatttcatcacagtcaatcacaggttcctgatacagctccattttttggagatagtcgcaacgacgtagtccgagttggatgaaggacttcatgtcaggtgccaaacaatacacgcacttttcggtttcttcataacagtagatagcaccgcttcgaccgatcatcatgacgagctggtagaagcctagcttcgaaagctccaccactccaaacggctccatgagttcgttgcagcacacgtactttcctgataacagaaaagtactgttagttttccattatcacccttaaccccccccaccctccctaaccaacaatcctcaccttggcagcacacatcgtaatacttggagctgaatggtcccatgagagtgcggggacggagctggatatagccattgtcgggccaagcaagatgcaatttggttccacattcctgatccacaaatgtgtataagctagcaggatcttgagcgcgcactgcgatgcagccatatgccatcaaagtatccctaagatcgtccatgcccgacatcaaccggtaactcatacgacaaagctgaggttatgtttgttgacgaaccacgttgagttcactgaactgtgaccaagcgacatctctcactatttatacataattctccagctcagtcacaaaaatctgctgactcattaatgtagaaaagtttagatttctgagccgcgcgaatctcccgtcgcgcagcatgcatctcctggatatcggctcgtatatgccgttgactgcgtcccaaaaacccagcaaacagagccaccaaaatgaaagcacccaacgcgacagaagaaatgctgaataatccccaggcacacaatgtcagtttcgaagagacaactctagaagaccacagctgcatgacttgtgtccacgtgggccattccaatacgccgtaagtggtgttatccgcgtagtcctgatcagtgatgtttaccggacttgcttcaaacttcttcaggcggtatataagacgtatgcagacgtcactcaaaaaataccgatcagtgtccagatgtctttccagccatgtagaaacataccctttcacagttgaattttcagcttctgtagagttcccctgttgccacttacagttagtgtttcggcgatctgcgcttgtcgccgataacacatgctgtccccaggcttgactttgtaacacaattttgccctgtgtcacgttacgactggaatcgttacaaatacattgcaacattcccgtaaaagatgtagacagattgctgagcatatacaggcgatacataattcgcccgcctacataatactgaagaccaatgttcagtatcatactatgccaaacacgacgtctctttggaaatgtcatgttgagtctcagtttattcaccgccaagtgacaaggtccttgatagatgagcgtcccattgtaagtgcagttcaattcacatttcatagtgtcattcacatcacccccatactggcattccagagacaatcctttgactctccaccaaagcgccaggagagcgaggcaaacctacacgtcaaagaatggagtcaataccacataacactcttcacacacgcatattcatgacacacaaagtgaagattacctgccaagcgcagtaccttcccatcatcactcaaaacaatgagacacatgaatgcaggtgaagaacaaagtgctttattacaaatgcagtgcataatgattgacagcaggcgtgtctacaagcaagaaataaacagtgcgttttacagagatgcagcgccctccatcgtcaggtccacaatagactcatcactatcagagtcgtcaggatgtgcgttaacctttttcggattaggggtagggagcgaacactgccgagtcagtgcctttttactgtccacgcccctctcaggctcttggacactcggagtcggaagagttacgggaatcacgttggccatcaggctatctctatccacgaacggcaccggaatcttgccctcccgaacgcgtctttcggcgtccagcagggctcgcacataaccgcagagaaatctggcaaacgtccgaggactgttctgattcttctgtctgcgggcttccaacacgtctcgctggtggtacacctggttgaaaatcacaatgagatcgtccacagatttggcatactgcctaacccggtgcctgacttctaagggaaagatgccattccagtactccaaaacgatgggagctgtccaaaactcggacatggtaggtgccatgaagaacaggattccagtatcataggcgtaaatgtcatagttatcactcataaacagcaccacctgtctggaaggtcgaggagcagcctcgtcccaagcctcgataactccaaacatagttaaggcatgactcaggggcggacaattgcgctccagccaactgattttacaaaggttaattcccaaaaacgtgtacgtatgatcacatatgcacacggtaacaccaaattcatgcttaatatgtgtttcacgcgccatgagcttcttcacttgagccctgagcgccgtcttgcccaacacagaagcctgaatgagactgcctatgtccatctgattctgttgcatcctctgttcctgatcgtattctgcagaagtagccataatgatgttttcttaccggctacttcgtctgtgatgcggaactaatcttcactgcgcttcagccgacagagacttcttttcagcgcaaaaaatgcctcccggaccagaccggcgataccgtctgcgggggacagaacagtctcttcttgttcttcctccaattctcctcgttgccgcttcacttctctcagatattctttaaaccagggaggcaaaggaggaccctggtttcgcttgcgctcaatccactggtagctgagaatgccaaaagccaccataccaagagcacccgcgcagttcacatactgaatagggatggcaggcatggtgaaagcctgtctgagcattgaacactgttcatcttatatacacaggtctcgcatcccggacgtgacggccgctgatcacaacaaagaggcacatgacaattgacggattggaaaaggtgatgatagaaaagaccctacgtatgacaaccacattattgaccgcaaacacgacagtaaatattcggattacgtctatttgtatgtagcaatggtaagtaaagcatgacacacgttttcaatgtctcaatttccccaatccgtgttaataattttgcgaataaaacacaataatcacaaatgttcaaaatcatacttgttttttattaacaaactctggttagattatggaatggttatcatttcagaagtcatcgctttcaagacacccaggtacagtgaggccagtatatacacacacagggagtcaaagcccagagacgcagcaggataaagtcccaaatagcgaataaagtccagcagtctggagtttgcttcacaagaaagcaagttgatgccccccttgcatgtagactgaggaacatgtccgttttcatgccgcacactgctgacgatggcactggacaacgacccattctgacagcggtctccgttccgcgtagtgtagttggtcaccgaagactccaaagtaatacccgataagcagtagagtcctgtcagaggcacattgagtacacggggttcattcactccgggtatgtacagcgatccaaagtacgccggcatacagtcgacatatccgtatttatttatcggctgcggtacccccaaagccaccgtagacagcagagtcaggcatcccaccaccagaagcagagtcctaggagccatcaccatcgccacgctgagcagcattgctgtgagtgaagggtgccaagtatgagcgcttaaaaagtcttgttccaaaaggttgcacaacagtaatgattcagaactcaatgtccttagtactaagcggcttcttttcccacactatgtcctcttcttcctcatctgtggttagtaaatgatgatactttttccgagaccacacggtcttcatgagacaggcaaatatcaaaagaaacagccccaagacaaaacaccccacccccaccagccaaggacacggtagaaaatagttctgtcgaagctcagtgaaactggcattacaccacaaaagcatcatgttgaagagtggcacgatgacttcagccttcgcattccccagtgacaaaagacacagagacagtttgtagtgacagttatagtattattgacgcaacaggcaagcacagtccggtttgattttcaacagctcaagtgcccttattattacttttgttcaaaaccaaaataacggagaccaaaacggtcatcaagatgatccctaatagagagaccacaaagaccactatagtacatttccatccatcatcgtagtacgcttccaccggggggtgcatgttagctggaaactctgtcatgtccatacgaaaattatcaggacgcggagggacttccccgacgaccgcatgatacggaggaggggggctatcagggggtgcatctgttgtgagtcctcttctattgcggcgcgactgagtaggtaaatcacgaggacgaggcggcgagcccacgatttcatcataagcgggaggtctaacatcttcactgtcgttacggggtgatgattcattcgtcgctgacatgttttgaaccgggacagaaaaatctgctcttttgcttttggttgcgagtttgcttgcggcaaaaaggttcccgagggcacgtgttgcacaggtaagctggcgggatgttgcaatgcttcttgtgacgaacgcactggcgacagaaatattgctgatttcccagtcgcagaacgccagccctgaagaacgccgggagactgctggctaagtactcaacgcgcttggtgtctggattgaccgcaaaaactctcagctgctcgttgaccacaatgggaatgtcgatcaatttctggcgccagagcatagagagcacgaaaatgtgcagcacgttgactgagccagtatcttttatccactcctggtgcgccggattttcgtaggtacgctctccctccaccacctcagcgaggtaaatgttctcggtgcacgtccaggaaaattcctttcccgcgtttctctggcagagtcgccagatgcccataagatcagtaggaatttcaaactcaagggccagcgaatcaccaaaactgtaacggacgggccccagtttttccctcagaggagggtatttcataagaccctccgtgagaagagaatgaaaaccggtgcgcgaaatcagttgcacgctgtcacaatttttatcgtgcacatacacgcgccccccctcactgagcaaaacaatgaaaacattgccagaggttaaggcctcctcgccattgctcaccgtgcccacaggtatcaaaaacttatcgcagcataggtacttcttttccaaatctttaatattgagacgtccaaaagttccctggcgcaggaaattccgataggtgaagatccatcccctgggccagcggataggaaaggtggtcccgctcatctgtcgaacatgctcaatcagtcgcttggccggtttctggctgctcatagaacatatgaaggtgtgacggacgagaacatcggcacgctccatctcagagagaatcatggatgatgttgacaaacaaacaccgttggacagagtcaggaatggcaaaatgcccaggaaaaatatacctgtgtgccaaatgacgcgccgaccacaaaatctgcatgttcgtcatgtgtttgtctatgtacatttctgctttttgctgctaggtacgaattcgaaactgacggaatcctcgctatcgctttcttctttggcatcattaaagtaattagagtttctttctccagagttggcggctcctttggttgtcaggtagctggtgatcttgtgttgctcgtacttttccttggaattgtgatcgtgctcattggatttccgaggcggcatgcgttcatgcttacgactgacaggctcggacatcatctcggaatccagtcccgagccgcagccgtcgtcatgcatggcgcctgaattggtgaccgccaccgccctctgctgtttgaaatttttatcgaagctgagatcgctgcgctgaaaaggctcctccgtgagaaagttatctaccgcaaaaagaccgttatgactagaaatgtgcaccaccgtatcatgctcagtgacgattcgcaccgtgcacggcagcttggtcaccgcacagttcatgagcgtttggtagaggttcttgagctgcacgtgaacgcgcatgttttttacaccatgaaaactgacgcgcgtattagccgtgaattccaactcactaccgctgttgagaatgaatttgatagccgggggagcagaatgtaccagaatctgaaccgtaccggtgggacaaggggcctttttgagattgcgcttgacccgtgtgtggggggaaatccacttaatgagctcgctgaccacactgtggtccaaatccacatgcacggccgagttgtcgctctcgcgcatcaaatcctggccgtgtacgcacggagagctaaactccatgttaaagtcgggcgcgcacatgtgtatttttgcggacaggtcagagatgtcttgcacatagaacttggttaagtccttgctcgaggtcaggtacatgaaattgcccaacataggagtggagttgttgatggttttggcttgaaacgacttgtcagtaatgtacaggcaggagctgttgaacgtgatttttgaaacaaactgattgcgcacggtttgcagaaccaacgcgggtgtgggcaagaaagtgacggtggtattctctttgagggtgcggatgaccgagcggagctgctgaatggccgacttatagggcttgagccgcaaagccagcgtcggaggctcgggtaaacgcgctttcctctccatatctgttaaccgcacgggaacccgcagccttgcaagatactcactgctagctcccagatgcgtcctcgtccgtgcccaacagtcaaataagctgaaaggcgttaaataattgacttttatagaggacacacggcaacacaaaaagcgcacgctgaaagtagagccacagtcgcacacagcgaggttgtatcacgtttaatacagctctgcgaatctcgagaccagcattacaagtcccatctaggaggcacaatacttatatactccaaccttacaccgcaagtggtaccatttcaacattctcttcattaaaagatctggagtcattgaagactcgtaatagaaaggcagggggacacactgatccacaaacatactgacattaacactggccatttccacgtctgcctgcagttcagccgcccgctgaaagacacagctgggcacgtctgcgcgctgaacggtgccctgagttatgcttttggccttgacctcatcgtgatgctcaatccaagcgtaattaatgatgggaactttcaggtgcttctgcatcacagttgggaaataacattcatcgctgggggggctgacaggcaacacggtctcttcgtcgacgatgcgatcccgggcggcccagatagatggcgttacattccacaggaaagccgtctcctcatcggcggcgatggacaacaactgagcgttacgcaccccgtactcctgcatctcagttcggagagtctcccattgcgctaccgggagcgacaggtgaggcttgcgatacagttcaaatatgaacttgccctccttgtaaatggtgcgatcaaaccactcacatggcggcagtccagatttacacaagtctacgctggtgcgcaacgccgcataatacatgttttcaaaaattctctcaatgaggtcccatgacgcaaagtatgtaaagcccaacctcattaacaccgtgtgcagtcccgtaaccccgatattcaggctccgcattttacatatagccgattccaagggccagtcaccggaacgaattaaggcgtctaggcgggcgttaccccaaacaaccgcctcggtgaccagggtgcgaagcacctgcatatcaaagtaacgtctcgtgttccccaaaaccacattgtcccgacacagcacgtcatcgtcggtgcgcgtgaacaaacaccgtgtaaggttgattgacagccgctgtaaaggcaggtcagattctccaaaatggcacgatgccatgtctggacccaaacatggtggcaagggcatattgcccgtcaatacagaatacttaacaatgtgatgcacaaacaccagggcacactttcccttcaaagcgcaaaacaacatgttgcgcatgaactcgctagccttcaccgtgactttcggtaccgtcgtctcatatcgaacatattctttttcaaatgcaaactcattgccacactctgataatttacgagacacggtgcgcccaaacaaggagtaatggctatcctgagcgcgatagcgtttcattagtacagaggggatattgaaagcataatgtatcccaataatgtccgtctcttttaacacaaagttcagaactcggatagccgccacgtcccacagatccacaaagatgcgcactatgggccgatgaacctccttttcgcggatcatgtcacaaaatccaccaatgcatcgaatgacactgatggcttccacgttgaatcgggtgacattaattgacagcgacactccccgagttaagttctcatacagccacttgtgtagagccaaccagtctacctcacgagaatacaaatcacatgaaatgaggtagtcatactggggtagctccacaaatccaatattggacatggaaaatggagtcaatgataactgtccatcacgacaccgcttcactacactctccagaacctcacattcgtgcctacagtccatgtgaaaacgatacactcgagcacacgggctgctgactatggccaacgtgattgccatagagatcctgagaaaaattccccccaaagattcatcctggccgtagatttgccgagaaaccttatctgtcaacacaatggcgccataaaatccccaacagccggccaggtctagatatcgagtgatatctgccaggattttaggtaggtcttcggaatggcgcatcacaaaatcgcgtagcggcccctcgcacatagatgaggtatagttcagggcatttcggctttcccgtaaccaattgaccttgagataaaaacggccgatgagaaggtcagaacggggaatttgtctaatgagtgcgggaccgtatctcataagcatctggaaaagacgatatgcgcctctgatcccggactgtcgagaagccgaatcgatatcgcgccacaaggtagcacgatcctctacatgtttcacgggatccggcactccacaaaagcgaaatttgccccaacgaccgtggcaatggcactttttgcccataagtagctgcacagtgttcatggccggcatgtgttgcaccagggaagacgatgcatctggcctgcatgatgtggcggtaccctgatcggcgagcgaccaacatgcatgaacaccgacttgaggttgttgttgctgctgctgtgcttgttgctgttctgcgtcaggcgacgatgtagccacttccatggcctccacaccattctcctccgtaccaccatcaccaccctcggatccctcctgcatgaccgcctcgagcccgccggcgccggtgttcctcaaagacgcctgagccataacaacattcacccgctactagacaaactctgtgaactcggagagttctacgttgaagtgttccaaacgcaccgtggataatttaacctcttggtgggttaaaacggaggtgtgaatgtcatcagcaagacaccaccccagtttttgaatgaccccagtacataaagaaatttgtcgtggcctggtgattcttttatttacaaaactgcaccgctccgcaatgaatttatggcgcaccaagtccgttaaggtgtgccgattagatatactcgacgtggccacataaatcgccaccttagtttccaaaacctcgtagtcgtacaccatgattaaatacacattttgcagtcttccctgagtttcctccaaagtcatatacatgtccttcggaatccataacgaaaagatctctgtctttagcgtgttataaaggtatccgctgagcacgcaagtgagtaacgacgtaatgcccaatgacactgactttacacagccaatggtgcgcaggcgacgatgcagaactttactgcccacgtccaaccaggccaaagcggcctttgcaggtcccgaagtatagattccctccagctgacacttggtagccatagacacgttggtagctttgatggccatgagatagaggctaatgtagaggtagcgcggcgattcagcacccgtctccatgcgaaacatgagagaaccgggatgaacctcgaattccacgagtccttcgggcacgaaaaagcgagacgtgatggcctgatgatcagcctcgtacaggtaacgcaccgctagtgtatttacttcccgcttcagcttgacagcaagaacgagttcgttatcttcgtcatttggatcccgcggtcgcttggcgatctcccgcgcgtccatgatgcgaaaacgcacagtcgactttcaggtgatcctcaatgagctaaaacagaaatcaacggaggttcaggccgtgttaaataccttaagccaaatagagatcggcgcactggatgtggagacagtgaatgcaactaaaatacaacagtttctgcagcttataccgcaagaaggataccatttcacgtttattcagcaaaatgtggtttactacatactgagtcacagcacgttgcaaacgtcccgtgattccctcagctccgctcaagaattactcaaagaattgcagaaacatcatcaacgccatgccataaccagtccgtgcgaatacctaaacaaccaaactacgctcacccacctgcaaacttttatggataaaatgcaagatcttcaaaagctctttgataccaatcaatttctagcagccaccgtcccagaccgcaaaaatcaaaaaccacgagatatcagtgataacggaacccaatatctcatacgaagcgtgtttacacagattgaagaagccacagaacatatacgacccttcagtaactgccgcctagtggcagaacttatagacatgctttatcacaacacactacgatgggccatgggactcatgcaataccacgcttttatagaaaagcacgatcaggaattagataccattctgaaaatgcattttttctacaaatactacaaagctgtcaacagcgagctaaacaccgaattccaaacattcatcactagcgacaagcgaaatctcggacccttcatggtgtctgatgcagatggagatcagcaaattggagcagaacacattagagatctaagcttcaaggtattcaacgccaacctaaatgaccgcgacacaacaggactggcattccccatactgctaaccacattatcggttctgaaccacatggcggtacttaatctattctatcatccaggattagtttttaggcttcttagcgaagagtcaacaccaagtgctagtgaaatgcaacgtctagatctcatagcacaaatgtgtagtcaggttagcaacgagttttttcgcacaattactaaaaaacccgtaaaactccgagacctaatgacacgcatacgaaaattcacatccttgggattgaaccgccaaacctccagaacgtacgcccaaatggcactgcttcaacctagccgaacgacacctaaaaaaggcagcgagatgtggttcgaaattcgacaacaacttatcgttgcgatttacaatacatatgtattttttatgtgtctgtgggtttatagcccaacgtttctcttcatccatcgacgaaagatcattctcgaacaacaaagatccacactcataggatcgcgccgcgaacttcaatttatctgggacaacgtaactaacaacattcaacacgatttttatgtaatgttcactgaagacgaattcaacgttactaccaaaggggccacggagctggaaaaagattacctttatcgcgatctactgaacaagtggggtgacattctcttcgtaatgaaacctaaactcacgcccgacgctcaatccccttcactagataacgtaaccaccgcagacgtaattaaacgttgcgccatgattaatctatccgaagttaatgtaccttacgagaccctgctacctctcactcatcaccccagcttccttgacacatttgttaatttagttatcgtgcctgaattctcgcaaattcttgcagtccctcataaccagtttctcactatgggatctccccgtttgttacgtttaactcaagcctgccgccttttggtaccagaccagattgcattgtataataaattagtttccctttataacttgactaccttcatttcagagattgacgccggagtatttcgtaccatttataatctaacactggaaattgccgctttattggaaaacctttgcggcgaaccagtgagtccagaactggatctactggtcgaactcatggcacaatcgctgtcacataatttacaaaccacggtgaaccccctcatcgaagaagtgatccaaaacaacagcaccagcgtcgccaaatatctagaacacactaatttatgttactcatttgcacataccataggccaactctctgcagacatgagtactgtcgagctcactcttcagtccaaaacacttgcaaaactcagcatcactcaatttctaaaaatggtacaagccctcatccagaaagatcaacaactgtccgacagctttcacaggatccacgatcgactacagcagattaaacagcggatgaaacaaattacagaagatgttatccaattgaatgagtattcaaagaatcaccccctggcggtcgacgttgtaaagtgcctacgaaaggccgcacggcagctgaaaagtttggaggagcggttgattttaattatggaacagactcaaaaatcgaacagactcatcattggctctctgaaacgcatcgagaaaacctgtatggtgctgagtagcaagaatatcgaggaacacggcatacgatactgtatcgcggaatctcggggcctgttgcgcacgcatcggtccgtatccgccatacccgcttcggccgtggattacctgccagacaacgccgagtcgcagttacgcacctttctgaaggggttccgagaagccggcgtggaacacagtccgcttcagatgagcggcaacacggatatccaacaacaaatccccatccccgaagtcttgacaaaccgttatgaaccatccaaccaaacaaatgacctattaaactggtatattacgtcaaaagatcaggcggaaaacgacatcttgacttcaatctacccagaggcccggcatgagtaattacccaacgagtgtgaatcatgaaaatctatccagcgcgcttcgatcaaacccacagccgattcgggccacgggcggggagccaatgtgtttccaactgttttatgtatctacacgccctacatctgcacggtgcacacacgacgctcagtaaggataccttggacttgatattgacagagggcgctcagctggacagcttggtggaaaccatcttacagcaaaagcgcccgggtgagaaactccctgtcttccgtttaggtgaagagattcccaacatcatcaccagcagctttggaaagaccgcccatgctctctcacgaccgttcaacgggaccgcggagacccgggacctcgatggctacacttgcctcggcattttcgactttctcatgtacgcgtatcaaaagaccaggcccgtgtacatcctagtgactgtgaacgctctagcccgcgcggtgattcttctcgatcacgacattttcgtgtttgaccctcacgcatctgaacggtctcgctatgccgcggtgtaccagtgcgactccctctatgatgtggtcatgctcctcacctacttcggcgcgcgcctgggagatttttattatgacgcattgtttgtgtacatgcttgacttatccatccacccggtaccagaagcggacattaacggcgtcattatttcgtcgtttcgagacccagacatcgcgttgcctgcatccagcgcaccaccaggatctcctgttcagacaatcccaagtctaccgcctccagaatccacacccaagaaaacacccgagaaaagaaaatccacctccagcgcctcccacggcggcaaaaagaaggccgctgagttcaaagacccaggttcctcctcgtctcgtgtgtctacgaccgccccttataattgtttagaagccttacccgccctgacccgctacgaacgcttgattaaacaagccgagaaggaaatccaaaacatcactatcaaggccccaccaaccgctggatggatattgttttctagttctggaatgccgtttgacgaagcgttccttacagaccggatggaacaacttgtcatgtcaagcatcgaacacgcctcttgtctccacacccgatggcgtccgacaactcctatgtatcaacaagtgcgacaacttagaggattttcagagagtattgatcgattcttgactctttggctgcaaaacgacctccacttactggacatgtacgaagccctcaaaaatgttaatacgtcgtctctaaccgtgttacagagagccatgctagacaagctgcgcgccgtgttcgcgcaatacagctccagccaaggtccaaaagtggtccagtgggttaaggatattctaaaggctacagagaaagtcaactatactcaccttccaattcggttaatggaatatgttgaagaacacccgctcgacatcgacgaaaccttcgtgtgtctgaagcaacaagatttttcgacaattgtgaacgccgtcaacagtcgccgacagatcaccactcagcagcaagaacaggtccagcaggcgctgcaaaaactgtcagccgctatctacggaatagatagtcgttatctggacagagtttcgttcgacgacaaggaaacaaaagacactctatcgaaactcgataatcaatcacgcacaacgttattgcaaaggggcaacaccaagatgaatgagctgaaagacgatctaaagcgtcaaatcagcgacctgttggagcgcaagcacaaccagattatcagcggcacgttgcctgtacaagacatgcaagctctgcagcggcgactggaacaagctgtaaacttggcacaagaaatgtcggagctacgtctctgcgatgtgaactttacgatacctttcagagagctttccaatcaactggattacctaatcacgggacaagcgtcctcgtcgaacgctatgtccttctccgatgagctgatgcagctacgatcgcaatttacctacgccacccagactaaagaagataccgaaagtaaaattcatgacctgatggttcacatagaagataccgtacaaaacctcacgagccgcagctccaacatcaccatgtccatgatccaggaacaactcagcgagctacagcaactcggaggcggcaacatgccggacatagcaaaacgtctggaaaaggtgcagaagacattacatgggctgtatcaagaagaacaagcgaccagaatttttgtccatggcctgaaatacgaaaacttaccgaacgatcagacgatgaagcgatacacccgtctctcggagttactacgcgacgatgacaacttgcacgaagtgttcattgagaagatcctggacattttcaacaccatactggagcggttatttgacaagacgttccctaaagcacaagcatttgacatgatcaacgcactcattaatcagattccccatgcatctaccataattaaagatctccataccgctaatgcggcaatcagccaactttccaaacagctagaggccctaaacaaagtccctccggacaaacgcctaaacgcactcaccgagctcgttcagtactttgtctcgaacggcaaagtttttagtcacctcatgagcatgcaagtaggcaaaaacaccctgccaacactgtacgaaaatttgaagatggaactggaagacaagcataaacaacaagccgaaaacaagtggctgcaagatgcaaaaaaactgaccgtgacgtcagccgaaatggttcaccaattcatgcaaacggcccccagcgccacggccgccgagctagcccgacccgaactgagcgccaaactgcagacgttcctagaacaggaagcgaagaaacaagaagaagaacgcaaaactgttttcaaagaacgacaggggatggtgacctctgaactcgctcgtataaccgacgcgatcaaggcccaaaccctatcggtcatacccagcctgaaactggaaagtcttcaagacgtgatcgcctccttgggctcgggagcccgagacatcttagagaagtttgatcgcagtctgctagctacactttccaatctggtgaaactgatggacgaacgcgtctccttatgtatccaagacgtcttaacaggtcaggatacgcactatcaacaatatcaggaagacgccagggcaatgcgccaaggactgacgtacatagggactttgatgaggaaccagctgtctcaagaaaccctaagaacattatcaaatctggttctacaatccatgtttgtggaaaagtgccaactgcgcgatgctatgacggtgttttctaacagcgactatctcgaagactaccaacgctaccgggccggacagcggcagctggaaatgcagatccaagaagccaggatggagttgcaccgtcaggccaccacggcagagcgagcgctgcaccaacctaacgcgcgcgttgatgccaagaacctaacggttggcaaagacttggcagagaagttggacctcgaatccgcgggccctttccagcgatccgtgtttgccactgtgctgactcagcaactggaaacgcacaaaaaaactctgaaggacgaaacggagcttatgaacactaagctcaagtctgaaaatgaattacggcaagccaagatgacgtccctatcggaacaatggagcgacttggtaacgcgccagaagatggacgctatggaggtcgccactccagacgccaaacatctgatcctaaaccccgtggccgccttaaccgagctcttggccaaagcctccacgcagatgtcgtatctggacgccgaaaagacgttcgcatgggccttgctgtttttacacgaagctaaaaaccaaattgaaaatcatcccggacacccttgttacgcgcaactccccaattttcccgttctcatccaacaagcccagggcagactggacacggtgcgcgttcacgtgaataacaacgcgtcatgcgaaaacttcgtagcgcaacatgaatctggaggcgcgattacggacagggaaaccattatgacggtagagactgtgtgggctaccctcgaacccaaacgcatcgctggaggagaagctcggtaccaaaaagtccaagaattgctgctccgtatgaaacaatcgctctcagatgtagaactgcaggacaccctagccacagaatactatcaactcttgagctctatccaaacgtttggctacagcctggactttaatatgcaattacaaaagattagagacttaaaagcacgttttaatgaattaatcaaacaacagcacctgaatacgtctgaggaagtgcctttccccatgcctccgattccagggaacgacattaccgtagcttcacctctgtctttcgcaaaaggtttagccgccctggaaagatatgtactggccgggtatcaatacctaacggagtgtatcaaccgccaaccgctcatctgtcagcgaatagatgacattccggctgtcttgccacctactgacatcgatcacaaaaaagcggcgttagaccgcttgaaacgtttgaactttagtaaaaagaatgacacgtactacgaagtaattgatgcgttcggcctccatcagctcatgtcacgaacaggcactcccttgcactacctgttaagctacggcaacgtgttgttcaagtatctggccctgcatcatgacgaaaaacacctagcaaaaaagtttgcccaagttaaaaatgtagtcacaggcagatacaaagtggtcactgtgactgtagccgtagctcaaaccattaaatctttctggacccagatctcccaatatgacctaaaacccctgttatcgggccagccgttactgggtttaggagaaacaaacagtcttgtgaatttgaaaatttttatttacatcgttgtttcagcgtggaacttgcaactcgacgtgtcccaggatatcagcggaccagtcattcgaattcccattcaggacctctgcatcaccatcaccaccttttatccagaatacatctatggcattgtaaaacaccccatccagaacactctatcctcccttgtgcgtgctctaaagaaggatatcgttcaggaggccattaacaatgtggtccaaatgccgccagcgtataacgctgacgaaatcaaaggattttgcgtgaatcccaaaatttggtcatcggttaatttaagccgcgtcttgtgggaccacaacctggtacgacagatttgtgcggtgggcccccgcaaaaacggcaatggaaaactttggcagtatgcggtagctatccttatcttcccgcaagatctcttacaatgcctctggctagaattgcggcctaaatttgcggaagagtttgcgaccatgtttgacttcttccaaaccctgtttatgcttttcactcacgagtacgacatcgcccgtgagtctaacaccaacacacatctgaacactggagaacccattatgcagaccattagcatcagacacaaagaatacaccgagaaaagtttgttagacatttttattgagactgaaaccgccctggattacgcgttaggatcctgggtgttcggcgttccggtgtgctgcgccatccacgtagcagacatcctaggcggcaaccgattactgttggcacgtcatctagaatatacaaatcgcgatccagattttctccacgttcagagagctaaagatctgaatctgaattacctggtaagccaaacatggacaaacaccccgctggaacaatgttggttccaagctcaaattcaacgcattcgagaacacctcagaaccccattacaactcgattttattcccctgataatctacaacgcccatgacaggaccatccactctattctccgtcccccgaccaccgccgagcgagacgtgtctcgcattatggtagaaaatcccttccccaccgtacccttgatagacgtgcccgagtccgacttgatatcttttacccgtgttcccattaatacggactttctccgagaagacccgcctcccatatcccgtccccgaagtcaccgcagcaccgctagcggcgtcagcagaggcagtaaagccaaaccatctaagactacacaaggcggcgctacagcctcaaagttgccatcatcgtcgtcctcttctgaaagagctcgagtgcacactgtaggttcatccgtagacgtccccgaagtagtgtccgaaggcgaaacaacatcgggtgatgagacagagggagaagactttacccatttaccttcagaggaagaacagcaatcgctaccctccacacgaacctttgtggagccggtgttccgtcagagacctctgcaaaccatcgttcgcagggaagatgtgaccaccgtgtcccctagcgctgccagttctagttttaacaatccccccatcaccacactcacacagaatgttattagtgccattcaaatcttgtcatcggtacgcgtcgacctgagatcaatggcacgctcagtgaatgaaaccatcaaccgactacggttcctctatttattataaacaggcccaagtagaacgagaaggcacaaaaatcaaaaagaaaatagcaacatatacaaaaaccacggctaacgacgagttctggctaccgccaacatgcgcaacaggtccagtttgaacgcatatttgtctgtgaaatagctggacatccgaacgtatttagccagcatggtgttcgtcacggggtgttccatgctctcttgcggcaaatccagcacgttggtgcacacgtgccgccgcttgtcttcatctcttttcacggtgggaccggtgccgctcgagctagacatgactgccgtgacaggccgtctgtttcaccaaggtgcaaccccgacagagcgtggcgcagttctcgagctccaggcagctgtctcgatactctccggactggcagcgcgagcacaagagtccgtgcccgtgccacgtgagccgcagcaaccgtgggatgttgacggagcgcaccaccacggtggagtcgcacgtccgcgccgagcagggcaagataatgtcaaaagtcacgacgtgatcgtacaccgcacacgcggcgttgaggcccaacaccgccttccagccgacccgcaggcagcgatgcccataaatggtctcagacaccacctcgtaaacgcgttctttaatgacacgctgacttccgcaaagagagcagtgcacgagttcggcgttggtattgaaaatgacactcttttcctggcggtctctataatagaacatggagttcaagggaaagttctgctcacactgcagcttctctttgcccaggttgagacagtgtccgcattgacgacacaccacggcaatcagcgacctggagtctagatggcgctcacacttcaggcgacataagcaccagagcgggagttcgatgacgctgccaatcaagcctccacgcagcgccaccgccagtccgtgcatgacaatcttggtaggttctagcggtcgcggttgtttgtgagcgcgaacctcgtcgttgagccccagagctcgcagcggtaccaggtaccgcggacaggtgtcacagaaaaattgtatggcctgtcgagccataacgtatagtgggttgccgcaaggcacgggtccggcgtgacggcgcagcgccgccacgagcgcttccagctgcgccgagcgcgacttgcgatgccgcgcccactcattacgatggtacacagccaagtcggcgcggccgtcgaaccttttggcacgcaacagggaaagacagggagaactggtttggttgagcacaggaagccgcaggtccaccccgaacagaaagcgatgaaaatcccctaaggtagatgaggtcattccatccagcaaggcgctgagcttttcagcgggatactgttgcaaacgaatgtacacatagtccgcatcgtagcgttcgaaacgcaagaaagcgacagtcctcgaaacgccgtgaaaacaattcatgctgtacacgtaggccaggaacataaagtagggcttagtcatcaccatgcgctgaaagaacatggtgaccgcctctcgctccgcaggtgcacatgccagccattcgtgcataaagcgctggtagaagcgatccccgagctcgcggtttagaaatcgcttgtcggtgacaaagagttgcagggcgcaaatttgctcctcagtctgccaggcgccacggcctatgaccatctgcacatgaaaatgctcatcgtgcgcacacagaggagcaaaaagcctccagagcgcgcgatgaaagtcacgagacatatcggtatatgagaaatagcaggactcccatcaccactccgatggtgaggtagcgcaggtccacacgaaacgaggaggcccaccgcatgtgcgccagcgagcgcaccccttgcgccgcactgatacgcggctcctcctcttgcccgctgccacggccgccactacagcagctaggtcccgccgtcctgcagcgacatatgccatagaagccacctggcggaggcggaggaggtgtgggcggtggaaagggcggcggagcgatcgtcattcgcggcgagtgcagccgcttgcggctgttgctgtggtggtgtcgcaacgccgccagacgggatcgaatgacggctccgttggccgccgcctttttggcacagagttcctttagaagattctcgtattcggcctcgttctcgggtccgaaggcaatgagttcgatattgaagacagaaggagagttagacttgcgcaccacgcacttggtgagcaccccgtaggccgagggcttgatctcctcaatgtccttgagagtaacaatgagcgagtcgttgaccttgagcacgttgaactcgccgacgtgcctagacgagacgagtttcaacggcgctcgaacaaaacagcagagagacacggcacagccggtgtttttaaaaatgaagcacggcacgtgatctgtgcgactttcccaatagctcagcagatactcaacgcaataaaccgtatcggtctttaacatagcatcacacacagagtaattggggtttttgcagatgagccctgcgtcagtcacacgcaactcggtgggtcccagtttcaaaatccggcgcgtggccgaaacgagatcgtgatgaagccccttactgatttccatggcgcgcgcgtagtgtacatgcgttttatttacccgctgattcctcttttccctccaatatcccgttaatgtccatgagcttgttgacgatagccgttaatagtttcgtcttttcgttcagaatctgcgcatgattacaagaggaacactccccgtgcacgtacttgagaaacgccgcgtacttttggcccgcgttgatgaaatttaacctcgcgtccagtgagggcaacatcagttcatacacgcgcggcagcatcggctcgaaggaaacctccagctcgtcctctggatccagagtcccatcctcgtcatcgtcaggatcctccccgtgtaccgcccgcgccgagcgaaacgacgccatagatagagtgtgtgtccgatatagatagatcactagccctataaaaaacctttatcactcctctagcctctcttcaacatgaatcaccaccccacttcccgcaattacgcttacaccggctgggaattagatctgacacaaccgctcaacgaaattacgaatgaactgttatggcacgcgcaccctcgtcaagtacctgaagccgccgctgtagcagcagcaactgctgctgccgctaacgttgctgctggcacgtcgcaaactggatcgatcacagctggtagcggaggaggggaccgtgccagcaacaatccctttctcttcacccagtcccaatgtaccgaccagttgttcggcggcctcggcagcggccagttctgcgacctagactcggaactggccacttttgaattctccgacacagaacgactcaagaagttatgtaccccactaaatatcgacacacgatgcaacctttgcgccatcatcaccatctgcctgaagcaagaccccgatcaagcgtggttgctcgattacagtctactgtgctttaaatgcagttcggctccacgcaccgccctcagcctactgatcgtcatgtccgaactgacccatttgttgcgtcaacacttcccggacctgcacattgaccaactttttcgacaacacgtgttgacggtgtttgattttcatctgcactttttcatcaaccgctgtttcgagaagcagcttggtgatgcggtagaaaatgagaacataactttgagtcacgtggccgtggtgaaagccttagtcatgggcgacgagatggtaccgtacgccaaacaccgctgtttcagccaccacaagcaaaaaattgtagtaaaaatccccgaggccccaaaacaattgttgcaaacattcacagaacacagcacaccgactcccgaacgcttcacctatctattgttttacatgtgggcgggtaccggggtcatggcaaccacgggactttcggagctcacgcagagtaagcatcatttgctcgatagcgtagcggacgctgatgatccagagattaacaaagacgtcggccccatttacctctcccccgtccccgtgtttcaaacgaaaaaccagaccaacaccgtgtgtttgctgtgcgaactcatggcttgttcacactacgacaatctggtgctgcgcaacctgtacgaccgcatcaccctgtactgcgaaaacaacgtgaaaatggtagatcgaattcaactagcgctggcagacatgatgcgggagtgtgcggtgcccatgcattcccagttcgaggatatatcacgctacacccgtctcccaccccctgcaaactatctctccgaacaccccgtgcgcccagatcccatcgtttgtattattttgcgacaagcaggtgtgaccggcatctacaagcattttttctgcgatccgcagtgcgcaggcaatatccgcatcacccgcgaagaggttctgttcggaagactccatctggaacacttgactgaagtgaaactcgcgatttgtcacgacaattactatataagccagctgcccagacgcgtgtggctctacattaccatttttaaagcattccagattacaaaacggagctacaaatccaaaacccagctgtcagattttatgcgtgaattcacacagctcctggaagcttgcgaaataaaactagtagatccagcctttgtggtcgataaatatgtttaacggcgtgcgatccacagagcggcggtccgctctgcggtcgttgactcgcaagcggcggccgcgacgcggaagtcttctgtccccccctaatcagaaaccaacatcctcatcgccctcagaaatcgcaaccccccgaccacggctgacgctgcacgagttacacgacattttccaagaacaccccgacctcgaaataaagtacctgaacatgatgaaaatggccatcacgggcaaggaatccatttgcctgcccttcaactttcattcccaccggcaacacacgtgtttggacatttcgccctacggtaacgaacaaatctccaagattgcctgcacatcgtgtagcgaaaaccaagtattccccaccgcttcagacgctatggtcgcattcattaaccagacttcaaacattatgaagaatagaaatttttattatgggttctgtaaaagcagcgaactgctgcgaatgtctacgaaccagccggccattttccaaatctactacatcattcacgcctcgaaccacgatatcgttccgttcatgtctaccgaccgcgatcggctgcacatgcacatcattttcgagaaccccgacgtccacattccgtgcgaatgcgtgtcgcaaatgctgctggcggcgcgcgacgattaccacatcaccctcgacatcgtcaaaggccacgtggtcatcagcgtgctgtgccaaaccctgaccctcagcagcgtgaagatcgatgtgaccgttctgcaacgcaagatcgatgaaatggacatcccgaacgacgtcagcgagtctttcgagcgctacaaggacctcctgaacgaactctgccatgtcaacaatgctcgctcgccttaacgcaatatggcaggaaggagggctccagatagatgcgatgcggtaaaatgcctagcaaaaacttgtcctttcttagcgtctggggaggaaacacgggggagagaacattggttacagatttaatgacctgatcgaaatacttatcggcatgaatcggcaccccgtgctcgcgcacgtaggtgggatcctccgcgatctcgtaattgcgcaccccgctactgcgaccgtcaacaggcgctgtgagcacgtaaaacacacggtcacccaccaccggcagttcctccgagcgggccgctaatcgcttaatgaccgcgatgtgtggtaagttggattgcttgtacagcgaaacgtctttcgacaagacagaggagagaactagctcttcgactcgcgctcgagacgtataaagctcgtcccgagcctgggacaggcgctgtataacgcgcccaaatcccggaggcacgccctgcatcttgagctcgtctaaagtcaagcgcgagagctgaaccgccgcccgagaaacttccggatcatcaaaaaggagctggataatgtcacgtgtgacattcttaacgaattcgcacgacgttttccgcaccagatccactcccttcatgctgagctccgtctcccccactatcttaccgatatatcgttttttgcaaatcatcatgagggacccgaacactttttcgaactctaacttgatgggatccacaaagagacactgggtgatataatgagccaaactggggccgcgctcaatgagagctgcggccgtgacaccgcgatagcacacgaaaacgctatcggtgtctccatatatcaccttcactgctaccggatcccccgaataatcctccctattaaaaaaattgtgtaaaaagcacggctccgcaaaattttcttccacaaactgcgatgtgcgcattagcatatcgcgacctatgcgggtgatactggcggcaatgggtagacagggcatcatgccgttcaccacgccggtgaagccgtagaaagcgttgcaggtgaccttgagcgccagctgctccttatccagcagcatgcgcttcacgggatcgtgacagctcctcatggtctcgcgaaccgctcgccgctgcgaaacccattttgtcagcagctcggacagcacagagttgcgcacggtgttcttgacaaagcggtaagacagcccactctccagctccaccgtgagcacatcgctctccggcggagactcgcccccaggcgccacaaacgtggaataacagagattatgtgccatgataattgacggatacaggctggcaaagtcaaacaccaccacgggatcactgtaataccccacctcgggttcgaacaccgtggcaccttgataggaaacatcagtgggctctgaagaattgtctgcccccttgtgattgggcattataaaatcccgacaggcacactcatctagcagagacgtgtaaatgcggatctgctgtccatcaaaaataacacgacgcatagggattctcgccaaccgcgcgatggcccccgcctcgtagtgaaaattgatggtgttgaacaagtccttgacaagtacagcgtcctgaacacaatacttgcccacctgcgcccgtccctcgcacccagaaatgaatttgacgggaatatccttgtaagacatgtcttctttttgttgtttcagatacaactcggccatggtgttgagcttgtaattgggagaactagtcttggccatgcacacgggatacatgtcaatcaccacagtccccgagataaacactttagtggtggtggtagtgacgaacttcttaagaggagaatacatgctgaaacggccctgtgcaggcaacttgctgtacggacctggactcagcttgtacacaaactccagccgtgtcaaaatgtacttgaaatcaaaagagttgatgttgtatcccgtgacaaaacacggtgaatagcgctgaaaaaagatcagaaagcccaaaagcatttcatattcagagggaaattcgtagacatcaacccctgctaacggtgcacagctacctatggtgaacagatgcaatcccgaagtcccaaacaccgtgttctcctcgcacccagtcccccccgtgttatagcaaacacacgaaatctggatgacaatatcatccgtttgctcggccgcggggaatcccccactggcactcatacactcaatatcaaaggacagacagcgatagaccggccacgacgtatcgtcggacacagccataatatctgcgacgtcgcagtctatttcgaaatcacaagtggatgatttatgagtgcgccactcatagcggtgcacgcagcaccatccaaacgttgtcatcttcttatcgatgacaagccgcgtcaagggatccacacgaatctcgtagacggggatcccattttccaaaaggtactcgccgattttcttggccatgctccaattactgatcgacacccgaaacaaattgggtataggtgacgtcccgtaaccgtagatggacatcttttgcaccggggtaatcgtcagagcataggccatgcgaggttctgatactaagtctgagacactggccagaagatcccgaagcaggtcaccatctgcatattcacagtaaaaatagcttctctgcccaaacacattcacgcagatgctgtgcccttgttcagtagcaccaaaaaagcgcaaaacgttccccgatggtgtgatgtgatgacggtagcgaggagacaaacattcctgagtatcgtgagtcaaaaccccatcgacctgatcgtaagtgtgaaacttgagcggtcccatcaaacgcctagcgaatgcctcgatggatggcggtggcgcaggtaaaggacacggccaggccatgtcattttcaagtacatgtttaatgtcccgataaaacataattgccccacgcccagtcttatgtttaatgagccccgattgtccatcgtgcatcgccccgcgaggcacaatctccagaaacgtcttcgccacggagcgcttggcgaccagattcggaggttttcgagcaccactcaggtaaggattgaagaacatatttgcagcggctgtcaatcacacctcgtactcgttctgaatcttttggtagccccctcgccgtctgttgcgcaagcggtccaagaagccggcggattgaccgttcgatgcgaaatcttcgtcatccgcttctgcctttctgcgtttttcttgatccagtttttgcaaagccaaaagcatctgataggcctcctctaaactgaattccttggttgcggaggctgctttctcttttatgttttcatactggctttgttcatacgaaggcggagcttcctttaccgtggttggtggaacgacatacgggaaaaagtgctcgaagggcttctcgtacgcgcgcttttgccgcatgtagatcaagtaaataacacccagtaccgcaagcaaaaagagaatcacagtgaaagaaccgaagggattcttgatgaaaccgacgacaccttccacaaaagaagccacagcaccaccgacagctccgatggccacacccaaagccttccctgcagaacctagaccgctcatcatatcatccagaccacgaagatatccaggcactttgtcgaacacctttccttccacgtgaatcattctctgcttgtacgtattgaactctcgcatgatgtcttccaaatcaaacacattactagaccgtaattcgtcctcagagtacagttccaaagctttgaaatcggtgttttccagcggatcaatgtccagagaaatcatggtgtctacggtggaaatgctgtccagtggaatcattcttttgtacagatagtcaacatattcgtaagacgaattaccagcaatataaattttcaaactggggtattcacacgcctctgtacgatggcgtccaagcaaaatttcattatattcaccaagctggccatactggacatgagaactgtttttaaaagtgtacagcacaaccggccgagaatagcaaacaccacattcctttgtacgcatatcacgtagcactttgacactgttctgatccacctccacacactgagcaagactgataacatctccaacaaatcgagcggcaatcggtttatcgtaaatggcagacagcatagcactgggattgattttgctgagttctttgaacacttccaatgttctcttctgatctttacaccatgcttcagcgatttgcctgagagcacggttaatgtaatttctcaatgtatcataagtgtactgcaattgagcatacactatgctttttagaacttcttctgaggttttgttagagtccgatgcggaatcagtagaacgttttctacgagtactactgttggtattgttgtaagctacagccaattcctccatctcaagaatcgatttttcttttacaggtaaccaaaacacaatcaatccaccagtggtttcatacatagaaacatttccagattgtacatatgtctcgttataagatgtattaaaaattagttgtaactgctcattagctttatccttaatacattgaaaagaaggatcagactcatttagttcctcttttgaagttaaaaaggtggccgtcatactgctagatgtataatgataggtatcatcagcctccgatctaattgtgcgttctgattgttcccaaaacgtgtattcacaggtattattagcttcctcaacaatatcccacgacataagcacatctggccgttcaaaaaaacccacaagcggatgcgcaacttctggagcattgtctcttccatagtacgcaatcatagaatagttctttctgacggaaaatttgtcacggttttctccaaaatgcttattgttagatccattgtaaaaaggagaaatgtccacaactttaccatcagaagtcacaaaaaagtcataggggtacttagatctagctgtagttacggtcaccatgcaatttacattacaacttgtagtatacagccaggtactgccaggtttgtgccaaagttctttcacagtcacaaagcgggaactatgagtattggagaaatcatcctcaaccagaagcatagtttcattcacataactgtccctgtgataatttacataagtagcacctgccacattcctgaccacggaattgtaacatctattcaatttattaatgtaatgaacttcccacattggtacggctagatgctcttgactaaatcccaacaaatgattttctctgatgaaagaatagctctggcgaaatgtcaaaattttttgatacatatgcactttgaaagtgtatggccgaatatcacgtttgtaaaccaccataataccttcttcaaaatcttctttcgtaggtttgaaactatcacaattaatgttctgctcaaatcgaagaagatccgttccctgggccattgagcaaacacgatacggaaatttggacatatttatcttaaaaacctcatgagttctcaacgttgtattttcaattagaggtcccgtagtattttcagtaggcgaagtaggtgttacggcaccagatgcagtgccagtactgctagatgcaattgaaacatacacaaccaacacgctagcacagagaagcgggaaccaattcttgctcatcttgatcccgtaccaagtcaaacaaaacagaaacgtcccgaggccgtttcctggaagctcgcgctcgccgaggaatagtcgctggcacgctcacactgtctggctcgcgaaacacgttgttctgctcatccggcctggccagatgcctatagaggaggagatacaggtcctttgatttataaagtgtgccttcgtgacgcaaaattagaggccactctttgttatacgtcagaattaaatcgtgatcggtggcaaagtcgtcacgcaaacacgcaatcgtgagctgttttccaaaggtttcgttatatagtgcgaccgagagaacgagttctcggacatgtttccacatctccttttgcaacatattcaagtccccacaagaactgaaatcaaagaatccttgatacttgaccaccatccactcactaggatacacggtgccctccgcacattttaccaagtcatctttgatgtgaggtaatactccagcgttatcacaagcataagccatgtccacattatgagaaagggggtagcgatccgtacaatgtgtgaacaggggaccgttacacaattggtagatctgctgacctaacagaggaagggactccacagggagacttttgtgaattatgttgtttactacgtataaatgttcgtcatagctgagcacttgcgaaacgtccaccacatcggggttgtctctgtatcgagtgcggtaaatgaacccattcatgagtctggagataaagtccagacacacggtaccgatgaggttaacatcaattagcttgctggtcaatcgctcctgcgattttatgcagcggatgaccttggcgtagcccacctctgacactttttgcaagtacgcgcgcttgcgtatattaacctcccgagtgacgttgtgaatccgcgtgcgcgcgtccatgtagtccagaaactcgttgtcttcgtcgggagccccgccgttactggacgtactctgggggtcctgcccatgaatggccgcgcccaccccctctgccgccgccgccccatctggcacgggacgcctgatctcgtccaggaggcatttgattttggtatacatttcgttgctttcgtggagtttgttgaaaaccgggttgtcctcgaaagcttgaatgctgagggatgtaattaggtcgatgatcctgctgggggcggcaaagaccgaccccacgaaaagacgctgctcgcgggaaagcagcttttccccgagcacgaaaatgtcctccacgtcctccccgtacaggtacctgctgaggacgttcatgaggaccctgcacaggtggtgatagatatttagctgctgcatgcttatccccacccgcttgactataacctccgaggtacgggaccagtaggtaaaatccgacaaggaatatattcgtgccggtatatccgtaaacaggttgtactccctcagcgcctcctccgcctcctggatatagctgtggtagaccgaagaagaagagaacaggtttttgagggccgtgaggaccccagaaaggctggggatgcgctgcgtcagctccgtgagatcctgctccaccgtttgtatattcacatcgcactggctcgacggccggtggaccacaatatggttgcagagcaagccctgcaggcgcttgttcagcgagcgcccctggttggggatgatggtcagttcctcgtagcattgggcgcacgttgttccctccacgtacgcctcttggcaggctaccggtgacactccgcacaggcgacgcagcagctggaggagttgcgagcagacctccagcccgctctccggggacaggatcgcgtatacgtagttcatcttgcacaggaagcgctcgatgtcgttgagcgttgctagcgtgacgctgaactttacgttgtccgtgaacgtaagctccaccgtgtggtgccgatcgcaccgatctaagcgaaggactgtacggtagtactccgcccggtcctgcctcctggagtacgccttgagagcgcggtcgagcagctccgtatcctcgtacagagccttcaaaatcatctccatgtacaggctcaacagcgaagtctgtgtacggttctggcgcaccagctccgggtagatcctgcggtacagataggcgatagccagtgcgttcttcttgaacggacttgactccgccagtaacacgctcggatcgcagtactttagacactccagttccatggcgtattcgttgcatttggaacacactacgcacagtttctgcaacaaattcatctcccgcaccctgctcgtccgcgtaacagacggcgtcctccgttatctgctcggagagagacatagggacggcacacaaataactcgctcagtccacagtctgccggaacgacgacgttaatatataacggcgttcacggcgtttattacagacggcctctcttggccggcagtagaccacagtcgtcgtcaaaggcatgctctcccccgcccgcattcacacccaccgagttggctaccgcctccccgacagcaggggccgtaaacagcgcagacaggtcgtgtacctcacccccgccaccaggttccaggcgactgtctaacacctgctgaagattaggcagggaaaagtccgacacccccatctcccgcagccgggaaaacttctccatcagagagtctgccaccacctggcagccgtccacaaaaaataacacgtcgtcccgctcggggatctcctcccgagtactcagaatctcgtacatagccataagctcgggatcaacatccaggttgtcagagtccaaagccgccatgactctgttctttatgatgtcctcatcgaaaagtacgttctcgcgccgcgagcgcttgatgagaacatcggacagcttggtggccaaaatacagcgctgtcgcatgaatttgtaatcttgccctcccatagagttcgtgttgaggctccgctccaccccgttacccgaaaagtacccaatctgcccgaactgatagatgtccttattactgttgaccccagcgtacttctccaccgagaagctcacagtaatcagagatctctgttcaaagatggttcgcatcagagactctcgcgtgactgtggccgctaacggtgcgatgacgccggccgccttaagatccttcaggcgcagggcgaaatcagccggtgacgcgaaattgggtgtctcccccagcaaataaggaaattgggcgtgattttggtacgtgagtctggtagttaggccgtgtaaggtacctatgtagtccttaaagccatagaaacaaaggaacttgttgtgaaaccgatgctcgagatagttgagcatgcaatccggtgccacgtcaatgagatcgtgctcgttgtaatcggcggtgaccgaaatgacaaacttcacaaagttgttaaactcccccatgtccccgatactcacattcttgggcaatgcgttggcacagaccttttgccagaactgtaagcatgagaagccacaatcagggaacaacttatcgtgatacttgtacagcaggaagccgagacagcccttcaccgggttctttttgggcacatgctcacggcgaaaaaacacgtgagccgtggtacctttactggctttggagatgggcctattcttaactctgaacatgagaagggcaggcacagagagccgagagagcttaatctccatggggatgactgagtacgtcccacgggcatagagtttaaagtccggcaggcggtcgtgatccacattcttagaggatttcacgttcctaataaacaaaaaaccctttctagaggaagtggtggaaaaagccccgtgaatggactggaagtgttgtgtaacccaacgggaaaccagactcgtggtcaaggggttgtctacaatgtatgaggtagccgtgatgagagccacattttggatgatagccaaaatgacacggtaatactcataggacaggatggggttgaaagcaacggcatagggactgaggtcaaggttaaaagcctgcgtggccccggacacttcgtcacgactgcttttcatgcgaacctcagagacaaagctcatggcctcatcatctacaaacttgttgagcgatgaaaccaagttaataaagtcggccctgccgttgatagtcatggtatcctctcccgtcactgagtctatgagtctcattttcttacaatagtccagaatacggttaagtcgatgcgtgcggtccacgctcgaactggcactgcgattagacgtcggcgctgacccctcgtccgctttggtgtccaggttcgtctcctttgactccgcactgtaccgacgcccaaacgtacccagtgtgtccacatcgttcaaaaagcgagactgcataaccaccacacagggctcttttttaggcagcctaggaatttggggaaggcgggtttgaacccgtacaaaggcagtattgtaacacgtatggcaacatgtcccgccgcaagccccgcacagactagatgagcaaccgattaaatgattactcagagtggatgaacccgttaacccggtattgtaaacagaaactcgattgaggtaccaaactagagcggaaaagagttgggggcacgtaccgcagatgagggccaggtgatgaggcgcatagcgctcgtccttcacaaccgtaccggaagatttgataagtttcctagcatcgttgtaggtgtcctcacacaaccccgtgagcccgttggcaaaatgaatggacttgagcagcgcctcttgactggccccggtaccactagcatttttgttggatgtcaggtagactaacctattttgatagagaatagagttacagctgaatagtaacgcactaatgtgagttgagaggtgcagcttgagctccgtgagcgccttgatgagctcgcgatggtccgcggcgttcatcaccacgggccactcggagtacaccatagagtctgaagctccgtaggctgaatccagaaacaccgaagcgaaactgaaacccagctcacagatgaccgcatcacttagcataagttggtccttctccaaactgctgagcttctgactcgtgtacccaaagtatttcttgtgaggcgccagcttcaccgattgctgactatcgtgcacgaattgcttcaaagctgcttcaatgagtaccttggtttccgaaaaacgtagtgcctgacaccacgaagtgtaaacataatagaacagggcttcgctcacagcaggcacatacagaccccgagactccacaaaggaattacgtttatctagagacacctcatcagaatcggcatctgcctgcagagagccaaagagcgttggagggtacagcggtacacgtacggcgtcacagtcattgagtcgagttggtacagcctcctcgaaacacgggattaactgccccgcatagagaaattccttaaggccgttacccaccaccacgtgaactaccacttcttggggatcacaaccggccgccgtacacagcgccgccagatcggtgggcgctcggccctcctcaggcacgtaggtctccaaagagtatttctgccgtgtttcgtcacataatcgctgcacctccccgtgcggctccgaaaaatgtattatttctcgcgtgttatggaagtacatgacgaaagggcagaaggacgtcaccttagtaagcaccccaccgtcataacacacaaccggtgttcgcaccgaagtgcaaaaatcttgatccaccgtgagccccatcaagagcggcgcaatcaccactggcgtcgaacggtcgcacagcgacaacgtcgctaacacttcattcatctccgggttggtttttgtgaaatacaggtaggcggccggccccacgggagcaatagcgctaagttcctcgttgctcatggtggtcatgtaacggtctgcactcctaccaagtgaactttatactcaggaggacttaagacgtcacggttgacgcattacgtagaccaccagcacggaaatgtgcaccgtgcgcctggcgcgccgcccccttcgacggttattcgaccgcttttcgacccaaacagactccgcgccaccctccgccaggccggcgaactgttattgataggcgccttcgaaaatagcgtgatggttcgcggccatccatgcgccacctggtgtccgcgaaaaacaacgtgtatgcatcggcgcacaagcagctgtcaatcatcatgattgacagatttcagacaaaacggcgttttattttgaaaacgacgttccggacgctgttttgtaagtaaagcaccgttgtgttcggtcgggcatctaaaaagcacgcgcgacagtttatgaatgtataacagcgtgaataaactcactccctcgcaacggtgttttgtgtgttctgttctggtttccacggcgtttacagtcacattccgcggcgcgcaccccagaatcaccgtcgaatctgcgcccgacggcacggtttatccgcgtgcgcatgtgtagtaaaaacagcgtggttggaatcaaccgaaagctgcgatcgacacgctgaaagtggctgtcgaaacggcgtttgtgtcacgtgatagcaaaaaacaacgtctcgcgcgcgcgttatgaataatgataatcagctatgatgcttacatttgaatatgtattagggggtgggctcgtaggtaccgtatatgcgcatgtagctgtactgatatgacggcatcatacagctgtatctaatcaagctgggtatatacggtaaatctgataacgggaaatacggtaaggctcattagaatgcgataccttataaggcttaattaatatccggtaattatattcgtatgtaaacatatgctaattaatattcggatatacggaataattacgtatactttccccgcccagtttcataagctttcaggtatcgggggtcaaaaagggggcgtatccggtagtagaaaatacacacccccttgatttacatgcatggtcacacccacattcaatatggcgatttgatgccacacacccttttatgatgacgtaggcacctacgtcatcgggaaaggttatgatctcagacctagtcaatgcagacgtttcatcgacagtgcatatataaaagataaaagattaaaaacctaataacgataatctagaacccctcaccccccaaacccccctctccccagtgtgggggggatccggttttgtgcgcatgtgcacaccgttttctgaagtcgtgtgaggcgggttccggaagatgggcaccgcacagtgcgcatgcggtgcccttacttcaatatagttaaatgggacgttgttttcgatgcccagcccccactctttgggttttcgtgggtctggggtccctttttccatcccccattgtaaggacccctgacccaattctagaagcggtctgcatgcccagcccccacctcgcatgctgtgctgtgggagtgcccctccccccaacggtctgggttatcggggctgcattggttccctatgatgggtgcccttcccccatcgctttcccagcatgcatcgctttacgttttgcaaaacgctcagaaaaacgctgacgctgcggtttttacaggaaaggggcggagtcagaactttccagaacttccgatttcgtctttaaaagccggcctgcccggagctcggtggcgcagtccgcggcgccgtccgggcaatcgccagtggcgacctgggcatagccgtggcttgcacactgcgcccacccccccgcccaccggggcctcgcagcctcggtgggggggcggagccggttcaaaagtagacctcgctcccccttcccccaccccttccccctacctcccccctggccgcctgggggatggggcggcgttccgctggcgctaccccctccccccggcataccctcccctgctcccctggtcggggggatgggacggcgtcctgcatgcgccgccccctccccctcgacaaccccaccccgccgcgggctggatcctgcggtatggggctcctgggccgcgcgcccccgcccttctgggcggccctctgggggcgtagccatgcgcgttctccagggagcggccgcgcagccctggcggggggcggagcgtgcgctcggctgggcggcacggaagcctggctgcgaccagggaaccgcgcccctgcaccccagctgggcctcgcgacgcccccacctgcgagctgtgcggtccccgggttggccgggtatgctccctgcggtgcgcggacggccgcgctgggtctgccgcggttccggctccacgtcgtccgggccgccctagcgctccgacgtcgggtaggcagccggcttgccccgacgagccctggacgcagtgctggatcgggacaggcggctgcactacacgacctggatgccgccgaaaacccccccgttcccggatgccggctccagcgatcgccgaagcgattgcggttcgcagccgcccgggacgaggaggccaccagcgccatagctactgccgtttctgctgctactgcttcagcagcagctgctcctgctaccacaatcgccgtcgttctcagcgctgctactgccaccaccgtggacgttggacggcgtttcggatttcgtccgtggtggcggccgatgtcgccgtcgcatagccggcggcctggaggcgacctggatgcgggtcgcggctccaggttagacgtcggtttagattttaaatcgcgtttcgggtgtcatatattttgtattgtgtaaaagcggaacctaagcgaaactgaagcaaaagtaacaaaagcaacaaaaccagcgccgttgttttccgttctacgttcgggacactaattaattatgattgactgcactgatttattggactcgtataaactgtttacactacacatctaggatagaagctttattaaaaacacgtcagagatctagcttacatcagaacgcgtacctacattatttgttcgacgattctgtcggactgtttgtctgtcctccatttggccggattgaatcggctccttatgaaagcgaaataataaaaaaacagacttgtagtttgtaaccgcccaaaaaagaaaaagaactggaactgtttaacgatatatttgtagcaatgtgtctgcaccagtgaaatgtctacgaacctttaaaagccctttcacaggaaggccggcttctcgggatgccaggagtgtctctctatattgtcttggtcctgggtgccagtctatttagcaaaaaacattcacttcatctagagaaaacatcacgactcaataattaaatgataaaagaaaataaagctaaacaaaagaattaataaaaagccgcgggtccgagcccgcacgtccatcatacagatattactacgatatgttagtttgctcgttgttcttgtgtattcttcgttagatcactgccacagccgtcgacgatcggtcgcggtgcgctctctcttgggcgtgaatcaggcgctaggttgcagacgccgtgtgtgactgtgggcgggccaacctagcgcctctttcacggcgcggagaaagagaaaaacgactatagctctctaccgcaatgatgcaatccccactagcatgtgctttaactgtgtgaacaaatcgtctgtcttacaaaaatatcgggccaaagccagtgagtatttttgatctttgtatacaagacatgatagtattttgtttctaaaatccgcatcgtcatggccaccaatcatgataatagcaatctatgataattgtacaaccaaccagtcgtctcgccatcgtgttgcccttttgtgcgatggcagcgctgcttcttagatgacatgttgaaatataagtgtgttgttgcctgtgttgtttccgccttttctctaaatggtcttggattatgtgcctcatctgccattcgagatcttcgaaacatttgagtcatttgtgtagtcattttcctgaatactatatttactcagatatattcaagtgtaagttcatcttcatccttgtgttatcgacctatttgtttagaagtgtgctgtgaaagaaactcactcgactctcgccccctgcctctctttccccccatgtgcgcagtcacctattttaacctgtcactcacacaacactcagtttctcactcatccagaatagcagtaacaagacaaaataaaaaccaagctcgttcacattccaatagtcgtctctgacgtctttttattctcgggctcacatacaagatacaacagcgccacttgcagcgacgctcctacaaatatccctcttcatcgtcgtcatcatcatcctcttcatcgctataacacatgtcctcgtactctggtgtctggcagcgcaacgcggccgagtctgcaaacagttcaatggccgttgtcgtcgctgctggcgccatctgtggttgttgatgctgctgcgcccccgaagggcaaggggaagaggagtcagacagagtgctcagggcggagatggccgcgacccagtcgggctctcctgagggttcaatgtgagcacacatcatgctgtcggcgccaccggtgtcaatcaccggagagttggtcgaaaagggcgtgggccacacaacgggttgctgcggaggctgctgttgcggcatttcctgggatggtgcaaagttaatctcatgtccagcacacatcaccgcgggtgccgcaggagccatgtccgtactcgtaccgagaattgcctgctgctgtggttgcggcgaagcagcctggggtgcggcagtcacaacagcctgaagatttccataattctcactgttattctcgaaaactgttcggtcccggttgagcggagacacacccgaggcggggcgaggaggggtggcggtatgggtagttgccacaacaacagggttgggaacaacgggttcctggtatgaggcaggagaaaaggcaacgactgccgtttcggtgtgctgcggtgtcgacactgccatcatcgaaggcatcggtgtatcctggggctcatcgtctttctgaaacaccgtgaggtcgaccaaacacttggtgtcaaacggacaataggccaacataaactggtaggcctgcagcgctttttgaatgcgcagttcacagagttcattctgacactggtgttggtgcagggcgttcaggatcagttcagccaccataccgcagcggtaggaacttatggcgccgttgtcgtcgtactgatccagaaagtgcggtgtgttctgaatctgtctgcttcgccgtcgcagcgccaggatggctcttgaaaaagaacacacatacgccaaggcgcggtggatggggttctcaaacacctcgggcggccgtttctggagctccagagcggtgtcgcgcgtgcactcgtcaatcatctggttgggtttcctgaccaaattcttgagcgtctggcagttgtccgaccattcttggccgttatccaggatgcaggccaagtccaggttgttgagtttgttaaacatgagctgccgcagcccggctacggtggccatgtacgggtcgtacgggttgacaggcaggccgtgtacaaagtggtatttcatgtagctcaaagtttcgtccaccatggccagcagcgcgtgcatgctgggagcgttgaagatggagaaggatttctcaatcaccagacggcgtagcagggacgcgggcaaccagtcaaactgctggcggatgtttagcagataatcagtgctcatgagttcctcgtgcgacatcagtagacgtcccggctgctccttgtcctgtgggaaagccgtgggttttttgagatcatcagggtagggagtaagatgcaagctctcggccgtgtacctttgcaagtcgtacactggcgaggtggtagagctgggttgcgaggcgtcgtctcctcttacctcgctgcccttcagtctctggcgctcctctttctttttctcaatcattcggctcagctgacgcagctggttctcgtccatgctatcaagctcctgattgatgagcgccagcatgtgtcggttgctgctcgtggccggcgacacggtcaccgcctcctcgccgctgtgacggtgtttctgatgatgatgctgccgaatgtaagcgcccctggagttactggaggcgggatgctggcggtggtgggagtggtggtgatgatggtgtcgcatcaccaccgtggtctgaggtcggcgtcccgagtctgggccgggcggtggggattcgggcgagtcgcgcaccggcggcgagttctgctgcggttgatgatggtgcggcgtgcacgccgcctcgtacctggatcgcttgatcgggggcgtgtgctcgctttcgtggtccaggcagaagcgccgtgcccgctgagcacggcgttctcggtcgctgagctgcgagagcgcgggcccaccgcggtatctcttgtgcagatccatgtcttgccagggatgactggcaacgtggtgtctgctcggggtttccgccacggtgtatatatgcgaaggagccggggccctgtgacgtgtgccttcggggtgcgtggctactggtcgttcgtgggcggtctgagtttcacggaaatgtgcacgttcttcgcgttcgaatgacattttttggtaaaacagcggctccaaaggctggcccacagcgcgtaactatgttcggtgcgtaggtcgatgaacacctgcacagtttcctgcgggttgcggtgggtatagttcaggcagcggaagtctttggtgcgtgagccttccagccgcttgacggaaacgcagtgggggctatggggcttgaatgttagcgtatgtggcgggacgaactgctcgctcaccttgggctcgtagtgttgagtcagattttccagtagcaagggccacacgcgcgtcactactagcctctggaggtcgttaaggtcacttgcaggatcggagtcggggcgtccagatacctcgccacgtaaatggtatccgatcacgtcagacagggtgcgcttttcgtaacgcgtcacatttactgaccgcgtttccataaagttaatatctggggaaggacacaacttgtcacgcacaccgagtataatgcgggtgcatgagaacgacatggaggggtggtcgtcaggggacaaagaggaggaagaagaatacgatactggtggtctcggtgaccccggtggataatgcggtgcgtgatggtgcaacaggttgcgaatgtctagctgagcacgcacgaatcccaagggatgttccctaaacccctcaggtacgataaaaatcgggaggagacggcggtacatgaagtaaccgtcctcctgatccatcttgtacataaacggcaggcggaccgagcgtccgtggtgataaatgcccgtatctaaactactttcagggtgagaaatcggatctaggtgctgatgtagcaaggtatctaggcatatggcatggttcagcacctgtgcaatggacctcaacaccgagggtcgaataactaaagtgcgctccggaaagggacaaatgatacgaagccccaacttctctgaacatttacaataatctgttcgggtttcgtaggaaggtggcgggttatcgtcgtcatagaagtcaggggtgaggtttttgcaggcacttttgaaaaagtacactgggtgatagtcgggattcatgttgccgaacagactttgccagaccgttacccacacacgacggaggccgcggcagatttcaaaaagaacctctttagataatccagtcaccccatcccgtagtcgcagatcaaaatctgcaataaagttatatgtaggcaggcgttcgttaaaaatttcatgtcgcgtgtagtaaaattgagtctcggcattagagctagccacatcatcgtcatggagccagatcatgtccgtcagggcttcgtcagtgaactccgtgtcggggacgtgtttcaggagatcgctaggaaacaggttctggtgccagttttcgcacgtaatggcacaaaatacatgatgatcattgggcaattgcacacgaaacagggggatgggaccgtcaaaacgagtttctttgggtatcagaaattggcgttgcgagtactgggcgagggagccggtggcgtaggtgttggcggttttcagggacgcgcacagacgtagcagtccggacagggatctttctagtacagggaacacggagtcggacatgctattgatagtgtccaatttgcgcatcacttgggacgaagtgccaaaaaatcctgtgagagcgggtccggtggtctggtggctgtagcccgagagtcggagatcgtagttatcggtagatagaatgcgtgtttcgatgtagtcctgcaagaagttgggcagggagaagtacttgtccatgacgctcaataaatcatccgcgagatggcggcccaggaacaatggtttttgtctgcattgttcttcgcgcgcgccctcgtcgtaagccaccacttcgcggtatttaatcaggcgggacctggaaagtgcagttctgtaggacagatagatgtaatgcacgcagaccgtgtcgggtaggcgggcctgttcgcgaaaggtgttaatctgcctgtcaacgtgcaccagctcttcgtagtctcgctggttgcgcgccatggcgtattgcacgaattgcgggatgcgggagcgaaagggggatccgagcagcatgcgggtgaattcggtcatggtggcgtgagtgggaatgatcacgcccagatctctggagaagctgcgtacgtattcctcgacggtgggaatggtgctgtactggcgctccagcagatagtaggacatggtcaatagcacttgcccttcggtgtgcccgaaaacgctgatgaaccatgatggggaagtgggacagagaaagatgaggttcaggtagcgcacgatggccgagtggtggaaatagaccaggtgtttgaattcgcgcacctcgccgccgtgttcgggcgagatgacagtacgaaataggtggttgtagatgggtttggtctcctcctcattgagactgtctaccagagccgacagcgggatgggctggtgagtgtgcaggtagtgcgcgaggttcaggacgtcgttattgaccacgaacaccggcgccacgcgctgagagtcagtgcacttttgggtctgtaaacagaagtaaactaggttggaggcgtggtgttttaccagtaaggggaacacacagtgctcagacacagattttgaaagcacgttagcgactatatgagcagaatcatactctgtcgcgaacagaaccagcgtcattgtccgtgaaggatggacctggcgcggcgcctttggggttttctcagctgtcagcggcgggcttcggttggggcagactatgtgctgcctacggcccagcgaagatgtgaacatgcaggagatgcagtccttttttgaggagaactttgggacgctggggatcacacctgaggatttgaaggcgtttgctaatgatcaggaagtgacgaagcacttactcaagcttattcctctgtatcggcactgtcaggtcaagtgtcgaatgctgcaggactacctcgcggatagttgtcagccgcatacgcggcctgccgccgaagtagagaatcaaaaatcgcagcgtatcatgcaggctttggacgtgatgatcttaaagttggtggtgggcgagttctccatgtcggaggacgacactctggaggtgttgctcaataagttctctacagatcaggtggcactctgtgaggttcagaaggttatgggcctggtggacatggattgtgatcagagtacctcaattttggatgcggctgccgccaacgcagaaaactgttctgtggtagctgaaggcggcatcgatgaaaacgttttggcaatgattccgcacccgcctcaggaagaactgcctgttgtggaagaggtgtgtctccctacaccaatgcctcctcccccaaaacctaagcgaaaaaaatctactgcagtgcatatgtctgtttgattaacagatgtgaatatgtcgcaatataaataaaaacacgatgaacataattgtgcgtttgtgtcatttattcgttttcgcacgcaaggagttgttgtaggatgtggtgttcgggcatgtgggtgaatccggtgtctggggttggtggcactaagagttggccaatggggtggttatggactaaaagatacacgaaacggcgggtggtgaagacaactttagcgacagatgtagtgcctgatatatagacggctgaactggaggtattgaccagtgtgattgtggctacggttcccggtaaccaaatgacgggtcgaatgataattcccaattgattcatctgacgggtgcccactatgagggcgcaagtactaggcgcgtggataaaagcagcgtccagatacaccgtctgggtgtgacccggttgaattataatgcgttgatgtagacgtaggccaaaaaaatagttttcgttagggggcgatatgttcatgacttgccaaggttctggacagaaacaagggaaaatacagagatcaccctcgatggtgccaggcgtgatggcttggaacgtgtagttcaagttaatcacgtccatgctgagattctggaggccgggttcgatgagttccggcatgcagacgaattgagagtccaggcatttgtagaatgtgattccaaagtagccggtaggaatgtagagattgatgcccagtggagtggatgtattgggctgttcggagagccagataatgtgtttgttgtaaaaggccaattgcatatgctgctgtcgaacgatgaagctggaaggaatccatttataaggaacgtttctgcgtggggaatagatgttggattccggatgtcgaaacacattttggaagttgaggttgctagcgaacagtagacagtagcggagatttacgctgtgttcgtcttgcggctcttgacgttcgtcattctttattaaagatgctcttctccacaagcgttggaagcgggatttgtgttgtttcacgaggctcagttgttgatctagcctgtccgagagcacgttgagcattgtgctctgggatagcgtggcggagcagtcatgcatcgcaagacgttgatgagactgtttttatgggcgtgcttgattgtaatatgtgtggccaacaataatacatctacagcgtcaccgacgagtaaacctactactgtgacaaccttaaaacctataaggaagcatgcggaagatgatttttatactgcgcattgtacttcgcatatgtatcaagtgtcgttgagatcatttgcttctatttggatctgtatgaacgtagtcattttgataatttcattttttgttgttttacgccattgttgttttcaaaattttactacaactacggtggcaggatactgagagacaaattggtaggtcgaaggcgtctttctatgctggtgttacgtttaatttcttctttaaaagctagactatcaatatggtcccataaaggatctataaataaactgctattaatttgggtagtgttgctatagggtggtgttatttcatacaaagtggtgagattcacggtaccgtgaatgctccagacagtatcgttatataatatttgtcgtgtatggttagcccaggctgattgacgctctctgtttctcgatttgtcacaaaatggttcttgattatatcttatggtagtgtacaaccaggttaccatgtcttggagttgtttaacaaaaattggcagtgtataattttctgatgtgtctacattttcctgactgttgttatacagtttagttgttactgtaggcgtattagttgtggtattgtttgcagatcttcgagatcttttttgtgtgttattcttttttggttttcgtcggcggtgtaaacgtctcattccttgttttagtttccaaagtgtaatatgagggaatttaaaaagattacggctcatggcgttagttaggtaaaaacttttggaacagttgtatctaagtaagtttcggaatataacttcactaagtcctaaaaagtagatggactgactatcgaggataacgatgttttttccaacatagattcttgtggtccatcgtggaacgttatataacattggattataggtggtattgacatcacatgcttgttctcctgtgtcattatgtaatgatatattaatcatttcagatagacaattcatggacggaatggaaccgcatgggggtggtactaggagcatagacgagttagtatggttgaacttgcacataatataattactgggttgacgatgctgaagagcgttgaaatcataccagaaatatgtaatactctggttgttaataggaccagcaagcattctgtatttgtctggaaattttggcattggaattgtgtatgcgtaactacgaagagtgggatttttaagtgcttgtatcatttctggactgtatgttgtggtttttgcttttttcttactgcaggtaagataactgcagctaataataactaaccagatacaccacatttttatttcagaacccatgacgtctctgacaactggtatactggtgtgttttgtctatgccttgctgttaacgacgcttctaatggttagttatcgctgcctcatcggttttcaagatgacatcgtgactcgatcctggatggtgtttaaagcgtgccgacaaggcctgtataatacgtctcgttgaataaataccagtacactacaatatacattgtcagtgtttttatttaattacattagttttacaatgcggtataaaaggtagagtccaacaatagctgccaaaatataaattacaatcagtacgatatgcgtgtccgtttggtcgaccactgcttccgtgacttcaaacactgtaccgtttttgaggaacatgaggtaatgagtttttggagattttgctataacatggttatcataattcagtgcaaatagcaggtcatctgtgtcgtagatgtacatggcatttactataccttcagaatcgtcatactccaccagtgtgctttggcagaattcacagtgttctaaagtgatgtttcgaatcattacaatgggtaatgtatcgtgtttgctggaactaggtgaacacgtgctattggcaggaatgtaagttatgattatgctgcgaccgactacggttgttagcactgggaaagaggttcctcttgcaatgtattcagtagatactaaatatgtcgttgcatgtgaaaccgtaaaggctgcaaaagatttagtagttgatacgcagctaatttctggaaaggttgccagtgtttgtggtcgaagagtttctagaacagataaagctgtttttatggttcgggagttggttgctctggggaacattttttgaagatgttccagggcgtggtctctgcggccgctgccagcacatggactgtaaagatcgcttacatgattgtgttcttcgctgccgattagttgtgaccaatgtgacaattcagctagagagcacagtcctgtttcaaatgcaaatatggctcttctttctgcagaatggtgtaacattgaatgaataataccgctggcgaggtagagttcttgtcgagcaaatcgggataagaacgacgatatatgcgttttgtgtaggagtagaatgaggttacggatttgttccatgtcgtgtttgctgacaaggtcttggtggtgttgtttaaccaaaatataaattaatcttgaaattgtcaggacgctagagatgtgtcccgtagttctcagagtggagttggctagttgtactgcgttaggatacatgagaagcgtggttcgtggttgtatttttgacatgcaactggagatgaagtcctcagccaggagaatagaagattgttgatctacggccagtgcgatggaagttggtgttgttggagacgtagatgctatgtaaagaaggattccgtagcctagaaccgtttccactgttgcctttgttgtgctacgacactgtccattttgaagcacgtttaccgcgtgcctgttccaaacggaaaggagaacatctaaatccatatagttttttgaaagtaaactatctgcaaaatctgttgtcttgatatatgtgtgataatgtatatgatcttttttaaccaaaacgattagttgatgacgtttcgtctgttttaaaataaagttttcccgtctgtagggggctttgaacattatccgtttagtgtctccaaagatgagaagcagtggtgtttctctgataaccacggttaagacgacaaagtattctgttaatgctattgtcatatagtcgtgttcagtgacgtaaaaagattggtataagcatgattctcgagtggtgaaaagcagttcatggtctttaaagaggtaacatgtcccattgaaggctggtgcatgtattttggatgcatttacagtagttggtttagcatatgaggttgtagtttggaggcggaggttttccggaggaggtactgtggatgcttgttcttttagattattctggtaactcaggttttgtccataatatttgtactgaatattgtcttgagaaactgtagcgtatgtgtttagagtactggcatattgttgaaatgtttttgatagatctacttggttcagtaggttgtcggcaaattcaccagtgaaaagacatctaggtaattgaaatactgtataatggtttgcactttcatagaaattgaacgtaatggcattttctctaatcaaagtaaggtttcgtcttgtgccgttattgttgcattttgtgctgttgtgtcgcaaaaactgaatgggtctgccggtgagttccagtgtcagatgtgagtaaggttcggatgaggtctcggcgtggcatgccagcagccacactgccaggacacacagtgccaggcctcggcgcatcgcgggtctcggcgttcgatggacaaataaaaccaggacgggtcttaaagtcgcgacctggcctatttaatacgacgtaatttgcgggcacgtcgcgtcgacgagctcttgtcctgcaatgaaagacgcgtcatgtcgttaggaagcggggcgatcacctctctgggtgacttacccaactttcgcaagcgaaacggacagaaaaagcatttagatatttatcgccgcatcgtgcgggcctttccgtcctttgtggcgtttaaccggcttctgggggggcttttccccacttactgcaaaaactatcgtcggtggctttttttcgaggtccgcttaacgcagcggattccagactgtgtggtgctctttgtgtcaccagaggctcccagacgggtcttatgctacgtcatcgagtttaagaccacttgctcggacgctgatgggcagtccgtgcggcagcacgtcacgcataacttgcagtatgtgcagggcctcaagcagctcaagggtgctctgacggactttgaggctctcaaggtgcctcgaggggattcctggtccgtcatccccaccatcatctttttccagcagcaagccacgcagccctctctcgctcgggctttccgatctgcaccctttactctccgaacagattcggtcattgactacctcaaacggcggcaggatgagtctgttgcaaccctactatcggctacccatcgttctgttcgagcctcatgccgaaaacattctcaggtgtcctcctcacgtgctacaaaggctagtggacgactccgtcgcggggctgcgcaaggaggaagtggtggccaaccaggtaagaaagcgttacctgcgcgaagagctcagcgatctcaaccaaagaatccagacgtactgcgaagacctggaaagtcgcgtgtccgaggcggaggcgctgctcaaacaacagtgcgaagtcgatccgccgccgtgtcaggacgtcgccgccgcggcaaccgccgcaaaggagatttatagttctggcggtgggcccgaagcgccgcctcagaaggtcacgcgttcggaccgcggtcaagctgcaacctgggtggcgcaatgctctgaccaagaaaaagaggttctattttttggaatcactaaaaacgacccctttatccggtttcatactgattttcggggggagctcattaacaccatgttcgaaaacgcatctacctggacatttactttcggagtctggtactatcgcttgaagcgcagtctgtacacacaaccgcggtggaaaaaagcattccgcctggtgcagatggaaaacttctccatctcacaggagttgctggtgggggcggtgaacgctttggaaaacgtaaccgtgtatcccatctacgattgcgtgctctccgatctcgaggccgcgatgtgtcttttagccgcttatggacagaatcactgggacggacgtgatcttccgacctctatccaaggggtccttacggaactacctcacttgttgaataaactctcggatgaggtgggtcgtgagatcaccacttgggacggtacggccaccgcgaattactatgcctatcaagacccccctgatctcaagtactacatgcctctgagtagcgggcgtcattattccccgggaacattcgatcgtcatgtgttggtacgcgtgtttcaccggagacaggtcatccagagcctgccaggatatggggcgcaaactgcggcagtggtgcaagaacgcatgtcgggacaggtgcgggatgacggtctttccgtgtggtgtaggcgcctactggcgggcaaggtgggtcgtgatgtacctattttcgtgcacgaacaacaataccttcgttctgggttgacgtgcatcagcgctctgctgctcatctggaaggttgtcaactctgagagcgtctttgcgcctcgggccggcaagtttacgctcgctgatatcttgggtaacgacgccctcccgcggacgagctcggaggatgacagctacagttacgggcatagggtcaggaactttgagttcctccttgagcattacatcgtgccgtggtatactcgggatcccactgtcacgatttctcaattatttcccggaatcatgcttttggccatcaccgagagcgtgcgcagtggctgggatcctgcgcgacgcaatgatggacaggccggtgacggcagcgggaccgtgctaatgcaaatcagtaaggtcaatccggtggccgatttcatgtttgcacaaagttccaagcagtacggggaactgaagcgtttggaactgcacgacgcattgctgtttcattgtgaacacggtttgggacgtcttctgtcggtggctttgcctcgtcatcgtgtttttgcactgggatcgtcattattcaacgtcaacgatatttacgaatgcatatactttagtgtcttaggttttcttccggctgttgtagtgatgtaagtacttgtggtttctgggcagcataaaggaccgttgtcctgcatgtgcgggctagaaaccacatcagaacaccttctggacgggtcgttgtgaggtgctgccgctgcttcacattcatctgaaaccatgattacggagcgcgtcctcgcaggcatcctcgcgggcatgacggccgcggggagtttggtcattctcctcgcggttgttatgtggttgaacatgttagatcgcgctggcatgccaatggccgttgggcattacacagggaacctggtgttgactcaggtcatctgtatcttctccatgctggcgtctaaaattgttggcatgacgagtgcggccaacatgggcttctgcggcatcgtggtttttctggaagacactggcctctatgtcacctcgctgctcttcatgtttatgatcctggatcgcatggcggcttttcttaacgggcgtcttttctggaggcagcagacgacgaagcagaatctgagtacaagcgtgtacattattctgttttgctgggtgttgggaatggccgcggctgttcccagcgcggctgtggctgcacccaattccaggtgggaacgctgcgaaattccagtgtcatatgccgcaatcgacatgattgtgaagctctggtttgtgctgttggcacccgtcgtgctgattatggctgtgatcattcaatcttcctatcatcgtgatcgggagaggatctggtactatgccagacgtgtgttcatgttctacacggcctgctttgtcatgatggtgccttattacttcgtcagagtcatgctgagcgactttgctttggttgatataaaaacaaaaacggcgaacagcgacggttgtgattcgacatttcttgattatctgaacatgttcactcacgtgatttacagttttaagttggtggtgtttgctttgttcattgtcctgttttgctccataaacccgatggaaacgctggaagaatgcttggagagggccgatgctgagaggcaaagtcggtcagaagcatcccagggtgaaaggaggctgccaatcaacacatgctgtataaagttgattgaattgataaagcagtatgtaagcactctctctaaagccacgagggacaattctggcgaaagggccaatttgccagagaatgctgaagatattggaacaactggcagtgatcagctaccgactgaggtcaccgtgaccccaaattcatcggctgtgtttagcactggaggaacggtgtctccagtctaacgtgctcttgtgctgcgtgtgtaactgacgggtcaggtggatgatttatgactctgtatatcggacggcgaatgtgtgcatgtatatcggtgtggttacatgtcaccacatgccgtgggtgtgtgcagggctttggctgaggccacggcctcgggattcagtgtcattcgcggggtcaatgataatgtacccgcaaaagctttgtaatcttcaataataaaagtgaaaatgcccatctcgtgtcgactcctttgaatttcgaacgcctcgctgctgattgtcattttgcctgtactgatcaaataaaagtaccacattttctgacagatgatgcggatcaggggctcatacgtggctgtaccccagtgacgggtaaaaaaagcggccaggcggaacaatctgtgcccgtacagtgtgcccagagagaacagcagattgccgttgcgggccagatcttcgggaaaggaaatgagcagtcccgtgtggcgctgcacgaagcggcttagtaacgccgtactcagttgcggctggctcagtttctggctcagctgggcggcctgttcctcatggaaaataacgtggaagtcgaactgagggaatgtgcgtcgcagttcttggtacaagttgggccagtacgaggtcggtgtttttcggctcagaacggcgttatcggacacgcctaggttgttggtggtttcgcggagtagcaacgtctccaggccgcggttaaacagtaacacgcagataagcctcagaatcttgagttcctctagtcgcagagtgttcagcggctggccccgtgacatcttttcgctaatctgtaatattagatgattggcacacgtaaaagagaatttgccagttcgcactcgggcctcatccgtcgggctggacatggcagctcccgtctatgtgggaggttttttggtgcgctacgacgaggctcccgaggaggccgagctggttttgccttccgacgtggttgacagatggctgcgcgagtcacgcggcccgctgccgctaaatgtcaatcatgatgagtcggctaccgtgggtcatgtggccggactcaagaatgtgcgagctggtttgttctgtttgggtcgcgtcacgtcacctaaattcctggatattgtccaaaaggcctccgagaagtctgagttggtgtcgcgcggacctccatcccagtcctctctacagcccgacggcgtgctagagtttctcagtggcagttattccgggctgtcactctccagccgccgggatataaacgctgcagatagcgcctcgggcgatgcaaaaacagcgtctttcaagcatgtggccctttgcagcgtggggcggagacggggcacgttggctgtttatggccgcgagccagattgggtcatggaacgcttcccggatctcacggaggccgatagggaagcgttgcgggctcagctgacggcaacagccgcggccgcggggggagaggaggaggacgacgttgtaaggaaaaagaacaacaacaataagtcccaggggcccgacgcggatccatttcagtccgattcgtacggcctgttgggcaacagcgtcgatgcgctctacattcaggagcgccttcccaagctgcgctacgacaagcgcttggtaggggttaccgctcgggagtcgtacgtgaaagccagtgtttcacctgccgagcaggaggcgtgcgatattaaagtggagaaggagcggccgaacgagtcacagcacagccgagcacccagcgagtccatgtctcaccccatgagctctgtggccactccagcggcctcgagcgtcgcgccctctcaagcgtccttggcactggcccatgacggcgtttatttacctaaagacgcttttttctcgctcatcggggccagtcggcacgcgaccgactcggcgggagcgcgttccgtgtatccggctgcacctccgcatcatgcgtatccggtgatgaattatgaggacccctctcgtggttttgactacactgcctggttgcggagggcggggtacgacgcgggacatccccaataccctcctgttccctttcatcatctgccgccgtatcgtcgacgggatttttccatgatggatgacagtgatcgcatggcttgggagcgcgggtacgcgcatccttccaactacgactcttatggcaataatagtggtaattcgtggtcgcgcggccgaaacggtggtactggctcgcacaacaacggcaacaagaggcggagggaccgagatttatcttcctctgacgaggaggacatgagttttccaggggaagccgagcacggtaaagctcggaagcggttgaaggctcaccatacgcgaggtggaggaggagatcactcctccgacgccaagggtgaccaccgctacgatgaaatcagagaagctttgcaagaacttagacgcgagatgatggctgtgcggcagattgcgccgccggcgcttctcgggcctgctcaactgacggtcccaacgtcgtcacccacaacgacgtctcacccgtctgatgtggtggtgactagtgaaccgcctcaaacatcgtcgtcgccaccgtcggctcacagtagcaagtccgctgatcgcggggtggtgaacgcatcgtgcggtgtgtctgtacaaccacaagatggcggtccaacgccgcccgtgaaggacattgtggacttgaaccgccgtttgtttgtggccgctttgaataagatggaataaatcacacatacacagtgatgtttctttgttcataaagctctttttttattatgtacaacaaaatattattacatggtacgcaatttattgtctattttcgttatttgtttatttaaattcgaggtcgttgtggtcggccgctgggggagcgacggccggggacttgtgctagggcttgaagggtggttttgaggtcggcggcggtgcaaatatctccgtccagttcacttcggagatacgaagtatttttcaccgcctcctcggctattcgggcagtcaggggcattagcagatctgggtgaatatacatattccatgaaggtacaactagcagcatggccgttttgggtaatctctcacgatgagtcaccggcgccgcggtgccttctcgtttggctttgtgggcttctcttcggagtctgtccatggtggtctgcggctcatcgtcttcatccgaggagtcttcggattgaaaggggtcaaagatggcctccgtgataataggaggagtaattggaggaccttcttcctcctcgtcttcgctggaagacgaattgttgggttgctgggcgaattcggagatgccgcgtaaaatggagtccctgggaaacaagccggctcgaagacggatctgagagcatctcggggtttcggtcttgttgggcaacacgccgaccgagcctcggcgaaataagtggataaatccaagcatttgcatgtgggccaaggttatcgcgttagctgtcagattctgcacgttaatggtaattttcatgcggttgggcaggggacccgcgtccatgctaatccccgggagctccaggggaaagaatacggcgtaacaggtgtcctgagtttccagcgcgttgttaaattgcaccacatacgtctgatgagcgggaatagtgacgtgcagggggcatttcacgagaaagccgttttctgagtgtctctcgaagaaggggttagggttatggcgccacatcacctcagcgcggtgagcgtatacagataattgcaaaaacacctctgtaggtgggtggagagagaaatggatgagcgacactaagatcaaattctcttcgcctatggtctcgactttctgaacatacgtgtcaccgttggaacaggccagttggtcgatggcgtctactaaggtgagaggtatgaggccagtgaggaacgtgaagtcggtcgcaaacgtgtaaccgccttcaacgtactggtctcgtttacgagtccacgtgatagcgctcacgttcaccttcacagtccaggtatactgggctcgacggatggtggtgcgggcgttggctctcggcggccgattctggctgtttcctcggccgcggaacaggtggatgcctgtcacgggaacgcgtactatagggagcgcgaaaaccagcatagccgatgtctgcgagccgggtgagaggcgccggttggcgtagttgcacgcgtccgtgcgcagcgagtctcggaacgtagaactgcaatgtcccttgagatttaggtcagtaagctgcaacgcgtcgcgagaggacttcatttcttgaaaagcgcagatgacggcccgattggccacctccacggaggtgtgccagttcatcgtctgcacggcatcgacgtccagcgggctgtgttgcgtgcagacgaggcgcaggatttggcaggtgaggcgttcgaaggtgacggccggggcgagggctcgagaggtagacggcctgggctcttcttcttcctcgggagggcgatccatgatgcggagaatgtgagagctggtgggaggccggtgtcaatgacgtgatccgcaaatacagcacccactgcttacctaagaaataagtgtgcggtctcgggggattggggtttttatataggtatgggtctattcacagggccttttgctaaccgactcgccactggtagacggtagctgctcggaaggtgagtagtggcgacgtttgggggcttgatacatgtgccaagaacccgagaggcctgagaagatccggaggtcgtcgtcgccttcccaggagaattcttggtgaggtagttgatcgccgcacacgctggctatcatgggagttaattctgtagcgcggacgccaaattgccatattccccagtacaaagtggggaaaaagtcgtcattttcgtcgtcggagctgcttttctttgccgcgtcgtcctcggtaaaacgtttgcgctggacgagcggtttgtaaagtttctcgcgctttttagatgcggaggatgatgttccggcgtgtggtgtggtggatgcgacctcgaagacgtccatatcctccgattcggaggatgagctggaatcatcttcgctggagtcttggacaataggaacgcctttgccctgatggtattcaaaactggtcgtgatgcggtattgatctctaaaaatggaatgatcggtttttttatacgtaaaaaacaagttacgatcgaaaaagtgaagcgaggctatggcctggaacggctcgatatacacactgtcgtgcaggcttctgatttccataaagatacactgtgtggacataatcgggttgcatgatatactgcatccgggaacgcttttggggcaaataaagccaatatacttgtctgactcaaagtatgtatcgatcatgacgttggcgtgttctctgggtttcaagtggagtcttttgggatttagaatagtgtagccgttcctttgttgcggcgtaaggaagggcttggggttgcggttcatagtgataataccgctgctttgttcccaggcgagatgaataaacactttgtcgtctggggtttcttcttggaaagattccaagaagattcgtaccagtcctttcactttatcgacaagttggatttttctaacgtgtgtactgcgcagggagcacaccagttcatttgcgacgtttatgctccacagcggcatggggcttgtattgacataaaatgatgcggtgtggtgcacgccgtgtggcatccagcggttgtatctttgggtccattggaggtgatacgcgttgaaacgggtatgatacccttgggcaaacgcctggacagcggcatcgtaagtgggtaactcgggattatacgtaccgcctggatggagtgttaggtcggcgggtacgaggtgtctgagcggcagggcatagagaaaaaaggacatcggttcgtccgcgggcgtaatgggtttgtcagtaggattgtgtacatgcaaataaacatctttcaattcttggtcctcaaacgtcatgtgtttaatttgaagagtattgtgttcgtagcgaggatctggtttcagatttcgagcgaactgtgtgagaaagatgatggacggccgatggacctggacacgaaggcctgttttgacaatcttggtttcgtgcggtttgacaggttcacgggcttcatcaaacacgctttggatgactttgccggcgatgggccccaattcggatacataatcgagccggtaacgttgcgatagatccatgtggactgttgtcgagtgcttttgcgactgacagctgcctgcagggtccacatgacgtcattcacaacctaactacggtgctttttaggaaccgaaaccgtgcacgactctggaatgggttcaaggcgcgtgtggcgacggcgtctttgtgtttgatagggctggagatcgatttctatacccgaaaaagtgcgatagtcatcgccttctccccaggggaaatcttggtagggtagtctgtcgccgtgggcgctagccacaatgggaaccaagctcgtggatttgatgccgcattgccagtttggccacgagaaaacgagtgtttcgcggtcgtcatcgtcttcttctgactcgtcgctcgtttcggccttggtgacgcgatgtttgctgcgcgtcgtcatggtggacgatgccgccgaggacgatggttttctgctgctgctggctggcggctgagatggtcgtcgcgcagaactaccactgggcggatggcggaaaacctccatgtcggagtctgaggcggaggagccgctttcatcgtcggcctggtcgccgtacacgtgatggtattccagtttggccattaggcgatgctggtcgaccaaacgcgcctgggcaggttctgtggcggtacccttggtgagaatcattttgcgatcgaaaaagtacaaccagccaagttcttcgtactgttcgatgtacaggctctcgtgaacggctttaatctccataaacaagttttgtagcggcaatagtgggttacacgacatgctgattcccgggatggttctgggacagatgatggcgacatacttgtcagactcgaaacaaacgtcgaacatgaggtgtgaggttttccccggcttcaaatgaagcgtctgcggacacagaatggtaaatccgtttctgtcatgtgccctcagatacggtttggggttgcgattcatcacgatgtcatgattgccgttctcccaagcgagatgaacgaagcattttgtttcgggagtatcttcctgaaggcattccagataaaccttaacttcatccttgcttattttccgaatgttcgtcacgtgtgtgtgcggtatcgagcaaacgagctcgctggctgtattcatagagcccagcggcatctgttgactattgaaaataaacgatgtagtgtgataaacgctgttggctgtgtatcgactctgatttcggctccacaccagacgggaggcagtgagtcgggtgtgccattttttgtcatcaatctgttgtaccacggcgtcggcgaccgtggtgcggcgcttgtgactttctccctggcgtaggatgagctcgggaggggtgacaggatctagcggcaaggcatacacgtacatagacagcggttcggcggtggttggaatgggtcggtcggttgggttgtgtacatgtacgacaagcggttccaaacttcggggctcgaaggccgtatgtttgatctgaaggtttgtgtcatagcgctgacaaggctgcgattcgggcgtaaactgtgtggctagaatgactgatggctgattgactctgacattgagatgtgtgtccgcgatgtaggtggtgtgcggattcaagtgttctttgttggcattgaaaatgagtttgacaaggtggcccgacgtcgggccgagatcggttaccaaatcgggaaaccgatgcggtcgcgaggccatgttgtctgactttggcgacaccgccgactgagctgcgcaacttggctcatagagctatttagatgttatggcgccagaaaaaaataaggatatacaacgtcattatgtaaaaacggttttattacgggggagaggcggaattttgtggctgttgctgctgtggttgtcgctgattacaaaccatggcgatagtgaccggtttgttgttgttggtcggtgattgttgttgttgtgccgtttctggactggggttagagacgcgcatgggggctaggtcctgtaggctgaatgaggcgcctaagagggaaacttggtgcggcgtgccgtgcagtgacgacttgacctggttggccaaggcggaaagccggccgcgattgaggctgtgtttggaggagataaagtacagttgccctagtacggtgtttttggggatgtgtgtgttgtcgccgatgacgctgatttctaaccaagtccgtgggagccagatggtgactggcatgttcagttcttggcggttgtgtggaatgaagagtcccaggaacggtccgtaaaagcggcggtagatgcggatcaggtgggacgttttgagggaaaggtcgtacggcaggcagacgtcgagacctccgccgggctgctttctggggagaaagtagggtagcggcgtgtcggagaagaaggggcgcgtcacggtctgctgtcggaggcgcagtttgaacgagacgatggggtttgatggcagttggtgctgcgcgctgcggaaggtcacgttgaatcgcaaaatgttatcctgatacaggatcagtgatgaaagaatcaggtccggacagtcggtgtctgtgtacagctgtccgaaagtggcggggcccatgttttggatggtggcgtccgacagtcggacggagatgcggctggcgaggccccgcggtcccgaaatgcctccctctgcggtgtgccagcagagggcggacttgaccggtatcgtcagctcggaggtgttgctaatcttgtcgttgacaaaggttaaatccggcaggtgtagcgacacgcagtcgtgcagcgcattgtgctgagtgactttccgccgcagcggcagctggtgcctcaggggcggcatggttttcagggcgaaaatgttgagcgacagtctcacgatagacatttgggtcagttgttcttcgataatggctcgaatgatattgcaactcccggcctgagcgggaaacgggctgaggatagggaagatgtctgagtcggggttggcgacggcgcatagcaagccttgctcttcggggtcgcggtgcgggctgagcggctcgagctgcagcagagtcgaaagcaggatctggaacgggtgctggaggtcgctgggctgaaagtccacgtgcagctgaatgagacgatatgtgccctggcgcggcagcggtcgcttcacatggtgctgatctgtcaaggtcaggatcgtctcgtccagcagcagggaaggtggggtctttcgagggcggccccgaggcccattccgtagtgttttgtcggcgcgcggcatggtttgagactgatggcagctgtgggacggctcagcctttaaatatgcaggtagcggatttgttatcgggtgacacgtcacagaccgtgaacatgacctgttcgtggatgatatcatcgagttgtctcagcatgacaaagagtgccgagagtcgagaaatctcctcgtcgggcgagacatggctcggccgccctcggaggagtctgttgctattgttgccgccggtaccgtcgtcgtcgcggttcagtcgcattaagagttcttggcacttggtcagcagcatagagctgtcctccagggctagcttgcggacgtagttcacggtgagatcggaagcgaggttggcgaccatggacatagacagacaagcggttttcatgtccagtagtaggtggttttcaatgacggggtcgggaatggtgaaggtcgcgtcacgaaacgtcacgtgttgcagttgattaacggcggctttgacctcttcgtacgagcggtccagcgagtagagcgccataattaggatcctttggttgatttccacggcgagcggggctggcagcagccacggaaggacgagattccagttacccacggagaccgggtgctcgcgcacgagcgggcccgaaaagagcgggggtagttggcagagcgcatcgcccttttcccagagcacaggcccggtattaagaacggtataaagatgtccgtgggtgggcacttgcatggccagttggttgccctcgattcgccgtaagatggtcggcgtcatgtttcgtagcagactgcgaaggcgcgcatagccgcgggtgctgtcgatgtactggtgcaagcccagatgatggtgtttgatgaggtgatgtcgctgcgggatggggataatggctccggtgagctttgcgagtttgcccacgtccgtgaggctaagtttttgttcgaaggtgcagaaaatggtgctgtccatggcgccggtggttcgtccggccccgactagcgtgctctgtcaaatagtcggatgcgatctttacgagttaaataacatgtgttggtgcagtgggatggtttcgcctatgatgtagtttccaaagtgggtttccgacgtcgcaagtgagcccgacgggttcttgagcttactctccatgagagcctgcgtggtcgtggagagaatgggcagcgcctcctgcatcatccggcaggggcactctatcagctgttctgtgccctccacgcagatgtattgagtgtcagtgtccccccggatacagtctttggctcggaggaggtactcgtcgatggtcttaaacaacgtcttgttggcgttgattatctcttctgtattgaagaactgtgcgcacgggctgtagaactgcgagttgtagcctaaacgctcgcggtttttaatgttgtacatgatgtcggcgagcgagccgcggttggacgcccaagggttgtgggtggaggcaaatgtctgcgcgtcgggctctgtgtggtcgtacagagttttgatggccgcgtcagtatcgtacggatccacacccagcatgcaggaggtgcgaccgcgcgggttgtttgggattttgaagtagttaatgtccgtgctgacgggtgtaatgatgagttcacacgctgccttttgtccgtgtagattggccgccgagtttttctcagacatgctgccaaaagtcaacatggagatggtctcggtgtcgaggaattgcggcctatccacgccggctgcgtggcggacccaacgatccacttcgtcgtgtcgatgtacgtgcatgggaaagacgcggtataggttctgtacgcgcacgcccatgtcgctgcgcgaacggttgagatacgccacgcaagtagccgaggtgtatccgaggcccatgtctacggtgttgatgttttgagtgacatggtaggtcgtgttgatgtctcgctcttctttggtcacttgcgggttgttgataatgagtgacgtgcatgacttaccgctgtagagcagcatgtcgacctcaaacgtgtcagtccgcacggctgtcagcgcgaaacctggatgaacgccagatttggccatcagggcgatagacacgggggaaatcttgtagagcatacaggccagggtaaggacggattgcaaggtgttgggacaaccggccgtgtaacgcgagaagggcgaccgcagccagttccagtactcgtgtgcgaaggcggtagccagcggaaaaccgccatcgtgccggtggtagtgcggaaagtcagtcacgaaacgcttgatatcgtcgttgagtgcagcgcagatcgtaggatctgagtagaaacggtggaaagggacgacgatacagtactcggcaagaatcttgggtgctgtgatggcgcagcagccgttgtacaggacgtgctgcaaggatgtgaaatcggtcgccccgtggcgttgggccgggtccagctgagcgcgtacttccaaaatcttggcgtgctcgggcacgaactgcagaaccaagaagagctctcggcaggcttcaaataggttgacgtcctcgttggtggcgatctcgtcgaccagctgggttaacatttctccaactgactctggttcggtgggcatagtgaaggcggggcgatagaaaagatcgaccattagagttttcaggttcagtccgatgccgcaggcccggttgttggtcatggcgggaagaaggcacaggtagaaaatcttctgcagcgtccactcgtcgtcggtggcctgatagtcgtcgacgaacaggggttcgtcggcgtccatggccgccatgcggggcacgtccgaaactccatgatggcgagactcgatgttggcggtgttgagcggctgccggtcggcgatgatctgcacgccttcgcggttccgaggcaggtgacacacgaatggcggccagagacgatggtcgtggagcgcgttggcgtaggctgacaggggttcttcgactaactggccgttgttgaggcctggtagggaagacacgcgggtgacgagccgcaggatagccataatagtacggtagtgggtatggatctgggaggagaggaggccgtcgccaagatgttcgacgatcatagcgatcatagtgtagctgtgggcgaaagccagcatttggcggttctggaacgcgctgacgatacatctggcgatgaacggtcggataactaagaaggcgtcgacgttgccgtgcaccagcaagtcgactaggtagaagagttcgggatagttggggcatgtcacggtgcttttgaacaactgcaaggtggcctcgtagtcgggaggcggtctgagtcggaccatttcggctatgtgcgaggcacgtagttcttgaaaggcgctgggcgccaatccgtccgggatgttgccggtcacgattcggggggtgcacagggtggcggtctcgccattctcctgatggtgcgcaaagtcaaaaaaggggtggagttcggtataaagggacaagtttcctatcttgtaaaagtcagaaggtgtgtagtcctgcttcacttcgttaggagtgcgcggcacttctcggcgcacgcggtaaaagtgtgtgaggcgtctggctatcccggccatgctctcctgttgaaagcggcattcggtgagtctggccacagccgggtcggtcggcacgcctcgctccgtgaaaacctgcagacagggcgtcgcttcgtgaacgaccgggtggcacaggcattgcagcgcgtccacaaagtcgagccgctcgagcccgcggtcgcggttgagaagatacacggaggtgggcagcgcattgtctttggtctctgtgagtttgattttgttttccaccgtggtgtaagccctgctctcggggatgtagagccctaccgggaagaagaaagtaagatcgatgttgcgttctagggggtttttggtgtcggtgtttttgtacacgtgcctgtggtgttccagggctacggcgtgctctcccagctgcagaatgtccatgggcagcgacgtttggctgttctggccagctttttctagcgaggagccggtaagatcggggttgccggaggtaaggtgagcggtgtaggagttgaaatcggccaggatagagtggtgggcgatggcggtaacggcgttttcgggactgaggacaaagttaccgtacgtggccggggcagagacgccttgtttactgatgttgcttttcaggagcgtcatgagagtttggatcacctgagcggtgctgaccatgacacctcgcagctgctgcccggaggccgtgacatacgtggcggggttttcgaggatactgttggtggtagattccaccattttggtcaacagtttgaggatgtagtcgcggtccgacgtgcgattcagcagaaagatagtgctgatcatctttgttttgaaactctgtaggatgttgctgcgctggatgcggttcaaggcctgtcgacagagcgtggcgttctccaccagcgtctgcaccacgaagtaaggaggcgctttgcgcagcagcacctggatgaagcagtggatgaggccacgctccatggcgtcggcggtgtttttgaggacccgcagtacggtgtgaatagcctcgatattgaggattttgtcgaggatggtgttttcaaaggtttctcgcaggtgcgtgaggcacgccgcgctcagctcgaaggggatggtgatggggcttttttcactgtatttagtgaccataatggtggtttggcgtgaggtgggcattccggcgccgctggccacgcgcggcacctggatgtgaaagagcatcttccccgtggttagtttgttcaggtcgtcgaacttgatggcgtgcgcagccgaggccagggccgtctgaaggaagtacacccattccagacggttgcagaaggtgccgaagatggcctcgaagtggatgttgtagcgttccgggtcgtccccgaagtaaatgcgcaggctgtcgaacatttcttccccggcgctggttttgacgtgcgtgaggaagtcggcggggatcccaaccttgggaagaagctcgacggccgaccagttttccatgacggcgtgtgaggatggcttcgtcgccaaccgtctttcagtgtcgcgcggctcaggacgctctaatagtggagtcgaccgcggaaccccaggtcgtcaatgtccccgtacacgtgaattcgtacaatctcacccaggagttgtcgtccgttgaggacgctcgcttctgccagacgcagccggtggacgcggagcgcgttcgcggcgtctttggcgcgctctaccgcgctgcggccccgcacctgcgagaggagagtgaccgcatcaaactgatcctgggacgcctgttactggggcccgtcgccgtgccctgctactgcgacgagtgggaagcgaatgagtatatggtcgatgcgcctcagttttgcggaggccctctgctgtatgtgcaccgtcgctgtcactgtccgattgtggggcgcgcgctggctttcaccgtcatggaaggccacatcgccacgcacgtatttcgaggattgttgtcgctcagcgagtggaaccaacatttgccggacatgttttgtccgtgcggttcattggacagacgggatcgctacagcatggcctgtttgccgcgggacctcacgttgtacattaatgattacccctatttcatgatggagatagggcgcgtgctcactgtcagtgaggtggacgactacgtgagtttaatgattaactacctgggcgaggccgtaacacctcgcctgcaagtacattacaagctgttgttcggagtcaacgtgaggcccgtggcgccattagccctgatttcgacgtgtgagttttttgtgctggaactacaaaagatgtggctcggggtggaatatcacaacgaagtaacggcggatttttttggccgcgtgttttcgcagctacaccgtgatcggggacgcgtcatgatggccctacggctgcccgagcagactgtgtgccacctcagccattttacccttggccgctttaagcgccaagtgttgtactttaagctgtcaatcacgtacggcaagtacaaagcgggggtagcgaaaaacgtgttgtgctacaggcgtctaagcctggcgttcggtgaacacgataccgtgtggagaaatcttttttacgtatattacgaaatcggtcggctcggaacagtgaactctgaatcccgttcatcacccccaccaccgtcgtctgcccgacctgtcaatcattcacagccgcctcctgctcgctggtcatcggcgtcgtctcgcggcccagctacaacggccggcgtgacgacccaccgagattcgagcggtgaccgcttaaaacgctacgtgtgcattatctctcggctcatgtttgtacggtacggacaaacataccgcagggagaaacacgatcacgtgtttgattttactggtcgcaccctacgagaagccgcgcagcaacagcgcagacaaaaacagttggcggcgcagcggcacgccactagtcggcgaaagttcatcgggggtatggagttttcagagattacgggtgtcagtctcgatcgaatcgccgtcaacgcatttaacaccaatagggtgattaacatgaaagccgccttgtcgggacgtgtaggttgtcgtgtcaatcgcttgccaaaaaatatgactcatagtttcgtgatgtacaaacacactttcaaagaacccgcctgcactgtcagtacttttgtgtcgaacgatgctgtgtacactaactctctaaacgtcaatattcgcggctcctaccccgaattcctttattcgctgggcgtgtaccgtctacatgtcaatatcgatcatttctttctccctgcggtggtttgcaacagcaattcgtctttggacgtgcacggtcttgaagaccagactgtcattcgctcagaacgcagcaaagtgtactggacgacaaactttccatgcatgatttcacacactaacaatgtgaatgtgggatggttcaaggccgctacggccattgtgcctcgagtgtcgggctgtgacctggaagcgatcttgctccaggagctgtcgtgcattaaaaacatgcgagacgtgtgtatcgattatgggttgcatcgtgtgtttaccaagatggaattgcgaaactcctatcagattccctttttgtctaaacaactgattctttttattcgcgcatgcttgctaaaattacacggtcgcgataaaaggctgtacttggatcgactagtatttgaggctgtgcaacggggtgtgttcgattatagtaagaacattacggcgcacacgaaaatcaaacacacttgtgctttaattggcagtcgtttggccaacaacgttccgaaaattttgacgaggaacaaaaagattaagttggatcatttggggcggaatgctaatgtcgtgactgtgtgtcgtcatttggaagccaacaaaatatcccgtgcccgtctcaaagtgttggtggacgtgttggccactcttcagggtttgagcgagacgacccatacacaaaacgtgatccgtcagactctgttgcgtctctgtggcgcggtcccgtcctccgcatcttcctcctcttctgtttaataaaaatttgtcatggataacgataaaaacaaagccggtgtctccgtctcttccgacgaggaattacccggacctgggtggcgtgatgccgccctgatcatgcataatggaatggttcgcgaacatatgttttaccaccccgatgtggcagagatagtacggagaatgattcctccgccgcccgatgcggaagagggatgtgtgttcgcttcggagctcgctttctacaccagtggtcgttgcaatcgcgcttcgtcggtcttttccatatattggcagaacaacagtgagatagtgtacgcgatgactggcatcactcattgtatcaaaatcgtggttgagtgcggccaggtcggctcggactccgtcgaaagacagttttacgatagccctggaatttatctgatccgtgtttcggacggcacggtagtgccacgaaacgtggtgtggccaggaaccagcgttcgatggtcgaaagaagtgggtattcgggtcgtccagcggcgcgtcaccgtggctcgggcatttgtcagtttgttcaggaactatcttttttggacaaagcaaccgttttccgaggacctgtgcccttgcccgccagatgtggaagatcggctgtttcctctactaaatctgtcgcgtggcgacattgaggtgtttgacaaaaaagtgtgctgtgcctataaacggttgcagaagaacgaccttccgcgagcgggacggcgtttattagatcattgtgtgactctggctgcctcaaaaaagattttattactagatctacctcgattggaaaacttttttttagcacaggtgtgtttgtatgaactggatgaggacgaggtgggcgaggaactgctgggaatgctgtgcggaaaatctaccgaatcggactccacgtttttgttacataggaaaaccatgaaggtggcagcgtgtgtagcctttattctgaactgtttttacaaacatcaggaacgcttgccagaggtcaataatcgagtggatgaatgtgacttagcggtgattgccctgcgacgctattaccggcatcacgccggtatacagacgcgcgctatagctatggcgcaaaaatttttgactgattattctgaatcgttttctccgttcaaaagcttttctcgcatggaggtccaggtgcctctggacgcggccgtcactcgaaaacagctcgtagccgtgttacgatcctaactggccttgaatcgagcggtgtatatgtcatcacacaggtatgtggccatgataactgcaaccaccaggtcatccgagtacttgtggtgccttttggcactgtaagtggtattgccctctgccagggtaatgcgatgtaaattctggatttgttctaagagatattctatggggtcatgattaagctttattgtatatgaaacaatttcttgtgaagctttaatgtaccctgagttaaatcgggaaataaactgttcaacggctaggcgtttgtcgcgccccatgaggtagaaaggctgttcgatgttgttctgatcgggcgtgtggtaaaacaacacggggatcagactgttgcattgcacattttgacggatcagacaagcgatacgcacggcggcggcctggttggagttgccttccaccgctatgcgcagctcgttgatgtaagggtggaggttgatgaccgacgtcagcatgtgtgctgcgcattcggctatagcggtctctgagctttctgacaagtcacgcagaaagtagtgttcgagaccgtaaatgatgaattggtggcgatacagacccaccgcggcaatccccgtaccagaagccttgcggttggtggtaaaggccgggtcgaggtacacgtagattgtttttccaaaatgttcctgcgcattcacattcagggtgctgtagcgcagaatgtcaaactcgtcacggctctggtccgtgatcagcacgttactttcggtgatcttgttggtgccgcctatgatttcgtccatgaacgaacctggcataaacatattggcggtcttcctcacctgagagttgaggctgataaaggtgggtttatgcaggcgatagcaggggcacgccgtggcgtcgcccttctccgtaaaggtgtgcaggtgttcctcgcacacgtaagaaaccacgttgagcatgtcgaacggggcattgttgaggcgggtgaggaagcaggtggcgtcgctagttgtgttggtcgacgagatgaagatgattttggtggtgttttgcgccaggaagcccaggatggtgttaaaggcctccttcttgatgaagtgcgcctcgtcgaccagcaggaggtggaaattctgtccgcgaatgctctgagggatagagaaataaaaaacaaggcgtggttagcaggggtggaaccgaggcctatgacgctcggcaacgcccgcgtcaggtgtctacataaaaggtgaggtggcttccgcctggcacgagaacgcggtcatgaacgcgctgttggcggaactaaatcggctgggcgtgtcgcatgtaaccacggaagatgtgtttacttttgccgaaaacgtgtttcacaatttcggttttcttttccagaccgaagagtcgggccctcggaagattgatttagtgtcgtcgctttttgagcacctcacggtggagtgtgtgaacgatatcctcgatgcatgcagtcatgaatcatcacccgacgggaacgggacctccgcggcatcaccgcatgcacaaaaagagcaaggcggcggcggcgggcgcactggacatgtgtgatgtgtctgggacttgtgacatgaggcacgtgcagaacgtgtttacggaggagattcagctccactccctgtacgtgtgtacacggtgtttcaggactcacctgtgcgacctcgggagcgggtgtgctctcgtgtctaccctcgaggggtcggtgtgcgtgaaaactgggctggtgtatgaagctctgtacccggtggctcgggagcacttgctcgagcccatcgaagagacgtcgctggacgacgtcaatgtcattggagctgtgctggctgaggtgtatcggtatctcatgagccacgcggctcgctatgccgatgtcattcaggaggtggtggaacgggatcggctcaaaaagcaggtggaggagaatatctatttcactttcaataaagtcttccgttctatgcagaacgtgaaccggatctctgtgcctgtcattagtcaattgtttacccagcttattatcggtatctattccaagcagaccaagtacgattcctgtgtcatcaaagtgagtcgcaaaaagcgggaggacgcgctgctcaagcagatgcgttccgaatatggaaacgcacctgttttcggacttggcgtttgagcaggtctttgaggaggacccgcagttacccctgcatgtggttttggaccctgtagacctctcctttgcagaggcagagaccgtgcggtacgtgtactaccgcagcgacccggaccccgtagggagatggcggcgcgccacgtttcgcgtcttcttgcggccgttcgagctgctcacctatctgcgcgacgccggcctgacggtcgcgccgacctttcgggtggtttgccatcacgctttattcaccaccctggggatccgttgtgcggaacagaggctatcgggggctcagatgctatacctgcgtctggtctggaacgaggagcgttttcgcgattgggagtttttggtacgcgatctgctacgagaagagatgagcgtgtgtcagtcgaccgagccggcggatcggcccgatccctcgttgctcatgacggatgcgatgcttgagctggccaaaagcagctcaacaaccgctccgttttttgagatgccgtcttctggcacagggaacaacaacgcatcatcagcctccgctgctgacgagagcagccaggtagagcgtcgcgtgatacagtttctccgcggtgattccgagttaacttatcatgcgggacctttggaaccgccttcgaaaatccgagggcatgaaattgtgcaacctcgcatagaagtgaaccctgatgttatctacgcatcgggcccgcacgaagacgaccgcacgtctaaaacggacgagtggcagaagggtggtgtgctgcgactcggctccgtctgggatgtgcggcaacgtctgcgccttcacgtcctctggtacgcacaatctttttggaggtcgcgtggcctcaagtacgaagaccgcgaggaggatttgcggctgactctggactcgtatttcgatcgactctctgttgagtaccaactacttcgcgaggtgtatcgcgaaatcaaagcggtgctcaggtcggatcgcatggtggctcagaaattctcctgtcatctgtctatagaaacttcctggcttttaatttgggaactgtttgaccgggcgttagaactttggagggatcaggcggatgtcaacagctgcattattaaggcactagctcataagctgcgcagtaaagcacaatcgagccacgggaacagtgtttcggcaggtaaaacgaacccttcagagacctggtacgccgatgtggtgcgctgtgtgcgagcggaggtgaaccttggcgtagaagtgcatgtggagacgtgcagtcagagcggcttgtggctcgttcgcggtcgcgatggacacttgagaaagtggatcactcagccgcagacgtacgtgctgtacgccactccgggcctggtttttcactgggttctgcctggtggctttgccatttcctctcgagtgtgcctagatggcgtcgggagggatcacttcgaacgattccagatgtctgcgccagttcttacaaaaagaatgttgctggagacaggttggacgagggcagaagcatcgagagttccaagctgtggcctgtagatcggctattttttccccacccgggggcgatgccagttgcttggcgtgtcagctgttattgttcaaacgaggaggagaaaatctgatctgtttttcttgtaatggcaattacatggggacattttgctgtcctcgaatacagagagtgcgacaagatctcgtaggtttacacacaacgtacaaattagtgtttttgggacagctagggccggcacgtgttgattttgtaccggccttttcttctatgacgagcgtggtgccgcgatgttctattactccctccctcatgtacgaggtgtgtactctggtgcctccagaagaagctgagaagattcgagtgaaaggatgctcgggttcctacgaacctggagttgaaaaggccatcaatctcggtggagccggggcttggctggtgagcaatagcagcgggtacacgttgtatttttacatactgtgttttgatcttttcactgtatgcggcaatgatcaggaaatgccctctatggccagattgatggccttagcgaccgcttgcggacaagtgggttgcacctactgtaaggatcatggaggacacgtggatcctaccggttgttacataggccctgtgccagacaaggggaattgcttgtgttacacgttgtgtaattctcctactatgaacccaatcactaatgagaatcctgtagcattcttctgcgatgtggagagagcgagctatctgtgcgccgtgggctcaaaaaccaagagcaaagttacgctggcagatagcctggactatcatatcggtgccaagaatgaaaccggagactggctgccgctaaatgaaagtgcctggcagttggtgagggtggaagaacccgtttctcgaatgattgtgtgtgcctgcccggtactgaagaacttagtgcattaagaaaacaatacatgtttgattgacggggacatacttacgttggtgttataacagctggcgaagagcgccgtgctcttggcgcccttgtgatcgatgctgatgacaaagtctttgttttccacgacgtagtccttagcgaacgtgtggcggcagcgaaattccacctctttgagcacaaactgggacacgtgcttctggtgcgccacgtagccgatgctgatgccaatcatgtgcttgagcaagaagcagatgatggggatgatgaaccaggtcttgccgtgccgtcggggcacgagaaacaccgtggccttctgcttgaacacttccacggaagtctgtgacaggaagtcgatctcgaaggcgtggaccaaatattgcagtacgcgattggccagtacgggaatcttggtcaccgctataaaaaagataacgtgaatcaataaattcttttgaaatggctcgagtcgaatgggtttcgcgtcgccttccatggtggcaaagccgccatctagccacctcttgaagtccgtcataaagttgtttatctgtacaaactgggggtcgcgatacagctcggtcagggcgtcgagcttctgatacgactgcctctgatcttcgggacaggggagaaagttcaggttatccaaggccgtcttgaggttttcgtggaacaggagcgttcgcctgtcctcttccgagtggtagtcgcgatagcgaccgcaaaacgtcatcagggggaggaacgcctcgttacagcagtgtgccagtcccagttcggggtgcatcatttggtagcgcttacgacagagggcggccacattggtgaacgaggtagagatgcaagagctggggtgatttttgcgctttaggagctcttggtagcgctcctggatccgcgaagcggattccccgcgcagcatggccacgtatgtttctcccccctcggcggctgccgcctctccttctcctgctacaactactgcaactcctctttctttctcttcttcccctgtgtctgtagtaccggatggtgttccgccgcggtcggtgggattgacaactgcagccggtattgccgcttccacagcagtctccacgtcgttatgtgcggtggagcggatggtggaactttccacccagacaccagcagattttgaggtgcaggagacgctacgcttcgatgaggccgtaaatatggcgctagtggcctgcgaggctgtgtctccgtacgatcggtttcgtttaatcgaaactcccgatgagaatttcttattagtaaccaatgttatcccacgggaacccgccgaaatgcctgcagtcggggcagaggcggagcgtacgttctctacacgtcatcatgatgtgctggatggattttccaatctgtccgtgcctctaccaccaccttgtggagtgcgagattatgcattgcacaatgttgataggctgacctacgaaggcgaattggtctacgggagttatgtattgtaccgcaaaaatcacgtcgagctgtccctgtctagtaacaaggctcagtatgtggaggcggtattgaggaacgcctacacacctgggcttcttgatcatcacaacgtatgcgatatcgaggggttgctgtacctgttgtactgtggaccccgcagcttttgctcgcgggacacgtgtttcggtcgggaaaaacacgggtgtccctttccggccttgttgcccaagctcttttacgaacctgttcgcgattatatgacgtatatgaatctggcagaactttacgtgtatgtttggtatcgcggctatgattttccatcggcttcagattcgtcgtcgggaggtgatgacgacgaactgcgcttgcctttaaaggccgtctcgctcgatcgcctcaaagaggtgctgaaggctgtgcgtggacgcttcgtggggcgcgaggtccctacgtggcccgcctcgtcgcggacctgcctgctgtgcgcgctctatagtcagaaccgtctttgtttggatttggctagggacgaggccaaaacagtgcactatagcccgatcgtgatccaagactgtcccgcggccgtgaccgacgtcacacttagtcacattctgccgggacagaccgcggttaccctcttcccggtgtatcacgttgggaagctgttggacgcgctcacagaaacagaagctggggtcgtgtctctaaatctatgacgtcggccaataaaaacctcttgaaggaggcgatgcgcctgagtctcgagaaacaacagaatcagtttttgagacgcgtttacggagctcggcatcgcgtcacctctcatcactccttgcaactcatgcgagtggcggcacgtgagcaaactcggtatagtcaggcggtagttggacaggtaactgataacgtagttagggatcgcgaggatctcaaaagggagctccagcgtgctagggttttgcagaaggctgccgacgtcgacaacgctttggactctttaattgaattgaaggacacggtggaggacgtgcgtgacagctttgtagattccgtggctagcacctgtgaggtggatctgctggaggacgacgataccgagtaagaaatttgtgtctgtctatcatctttgtccgtttgtcctcacggctaaatttccatcatgtctacacggtccaaggccaaatcccggcctcggtcggcgtctgcagaatctggtcgcccgtggcagcctgcgcccctcagacgttccaaaacgtcgcagcgacgagcctggatgcgtcaggcggctatggctgcggcggtgcgagaaagtcaagcggcggcagcagcagcagcagcggctcctgctgcatcatcgacacgaaatgtcatgacagttcgcaagcgcaccactccgccttcccccgctgctatgctgccgcctcagtcgtcgtccagaggacgtaccacttcccggcaatctagtattgacggtcctgttttatacgcagcagacccacagttgcagtgctgtgaagattcgcactggtcttttgagtacgacgaggacgctccgacgcaaaatacaggaattgttcagccccgagcgcctttgcgctccataacctcttcggtacacgtaaatgatgagtatgacgcggcatcgagccaagtgtctcaggtgtcagtggacgaagaacacgaggatgtccattgtacctgctctaatgaacatgttattgctacctccatcaagggtttggtgtgtgatgcctctttgttttcacgaatgactcagccggaactgtgtgagatggcagtcacttatctcctagtgtatgtcccaaaggatgaaaacttttgcaaacgtgtgtgctattctgtagacatgactgatgccagtcgacgcatagggtgtggctcttttggagaaatctggccgatagatcgcaggcgcgtggttaagatagccagaaagcacactgaaaccattttgagtgcctacatgtcgggtctgatccgcactaaagcggggcctgaggccgaggagatgcctggtgtgtatcacggactgctgacagccacaggctgttgtctcatgcacaacctgacggtgtatcagcgtttccacagcgacctgtttcattttgagaactgggatctgacctcggttccgagctatcggcgcgccttccaccacttggctaatgctattaaatttctcaaccacacctgtaaagtgtgtcactttgacatttcacccatgaatgtgctgatcaatgtcaacccgcactaccacagcgagattctccatgtagcgctctgcgactacagcctcagtgagccttatcccgtgtgcaacgaccgttgcgtggtggtgtttcaagaaaccggtacggctcggcgcatccccaactgtacgcatcggttgcgcgagtgctatcaccctgcctttcgacccctccctctgcaaaaactgatgatctgcaatccccatgcacgttttcccgttagcaatagtccgcggcgcttttgtatgatcgaactggccgctctggggaacgtgttggccttttgcttggtacgactgttggatcgccggggaatagagggtgttcacaatggccctgagtcgctgctgttcaaacacgccgcgactgcctgtcacgcgttggaaaacaaccgcctgacggcttgctccgacgcctgtttactcattatggccgcgcagctgtcttatcacgccggcctgttgggcgacgacggccttgccgtcgtgagccagacggttggctttgtggaagccaagatgtcgtcctgtcgggtcagggctttcagacgttactatcacgagtgtctaggtgctttgccttttgattacgtcagaaataatctggaacggctactggccatggcggacggtgtgtatttatacaattcgttccgactggcggcgaacattagtaccgaggaggatttggacggcgattgtcggcagctctttagcgactaggtttgcggaggaggaacgctcggaaagcgggcctttccccaaccgcaagtatgtgggacgagacgggggatgagaacgaggacctggtacgattactatccctgcgggacgatgagcccttgagcatgtttatcatgaacactttcttgttgaaacaggagagttttcgcaatctatctttttccatcctgcgcctggcgtacgcctaccgcttgtttaccaaggcggctcggacctatgggctggcggtggccgaggagtttgtctccgcggtcgcggctctggcccaggacgagctgcttcgtgatattctcacgaatcggtacgtggagtctcgggaagagattcaccgttcgcttcagagggtggcccagtgccaagagcgagaggagctggtggacgaggtctctgacgactacgtgtggctgagcaaactgctagacttggctcccaattaccgtcagttggagctgtatcagattttagagagggagtcgcgaggccagtctcggaacatggtgtggcacctgttgcgtctggattcggtgtcggccaccaagttttacgaggcctttgtatttggatgcatgccaaatgcgctggcgcaacgctctcgagcgggggcgtcgcccggtatccagtttggtttacagcacgagggtgtggtcaagaccctggttgagttccacgtcatgcacggccgggaaccggtacgcgatggtcttggcctgctgattgaccctacctctggcctgatcggcgcctctatcgacctgtgctttggggtgtgcaagtctgatagcggagacgcgcggacgagcctgcacatatcgccctgcgccagtgtgtacgaaatcaagtgtcggtacaagtatcttcgcaagaagacggacccctttgtgcaaaacgtgctgcagcatgctgacgccgcgtcggtggccaagttcctactctcacatcccattcctggtgtggaatttcgtcacgatgccgatattccctcagggcgggaatttctgctgtcctacgacccccttttcaaggccaccctgaaacgcggacgcccgattaagcctccggaggctttgcgtgattacattcacgatttgctctacctgaacaaaacagaacgctcggaagtaattgttttcgacgccaaaaatctggatgagactattaacgctccgcattcccctgcggggcctgtggcggacgacgccgtggaaaccgagggcggctcgcagcgcagctttcacgatgaagacacccccgatctgctgggacagttgaccctttacgaggtttcgcgcttttccctgcccgtgtttgtcaatcctcgtcaccaatattactttcagctgcttatccagcagtatgtactgagccaatactatataaagaagcatccggatcctgagaggatcgattttcgagatttgcctaacgcacatttggtttcggctatcttccgcgagcgggacgagagcgaagtggggcgtccgctctatctgggcggtcgggtgttcagttgcgaccacattcctctgttgatcattgtcacacctgtggttctggatcccaaatttaccaggcatgtggtttctaccgttgtagatcgctggagtcgtgatctgtcgcggaaaacgaacctaccggtatgggtggccaatgctgcaaacgaatatgttgtttcttcggtgcctcgtccggcaagcccttaagagacaccatgggtagaccggtgtgccttcggtcttttgccgatatagataacacgtcgtcagaggaagatgaggcagatttgattagtataaactctgatcgactatcactagcttcgcaagactctatggcgccggctcccaaaccaaaaaagaaaaagaaaaaaacacaatcggcgcaacatactacccagaaagcacaactaactctggccttaatggaagatggggatggctaccattctcctcctcgtgtaacacggacatataatcgtccttcccctccttcgaaggcgaaaacacctcgcgctgaaaagatcgccatgcgtccccccacgccaaaaaaccagaggcgatcatcaagccgcggctcatatgagtctgtatattaagcgtccctgttttccccccagtacataataacatacaaaagcaaactttgggaactttttttctttggtttttgcatatcatctttaataaaatctttatgatacaattttacatgacttgagtccgagcagtctttgtaatgtcaagtttgctcctcagcggagactaagccatctcctccgcgtcggaggtggccatggaagcttctttgagagaagcaagttcgtctgtagcgggcaaatgcttatactttacactatgatgattgcggaaatagcgggtgcagcgacaggccgtaaaaccggcccagatgagaaaattaatggcgaaggccacagctacagatgaagtgtactcaggtgtgtaggctaactcatatttgataatgggatagattaaaccgcagagaccgcagaacgtaccgacatgaaacccaaactgcactttgacgtagcgataaaacactacttcgaggagcaggaagtaaatgattgagataaatgcaaacacgaaaaatacagccatgaccatgtgtccggtctggacgaaaaaattattaccgaatccgagacacagagacatggagattactgctatgttgaatcctagtagcatctgcactaagttaacaatgagagtgcggtactgaatggtgccttttagtttaggatgaattctttgcaaattaaacaaattctgcttaaagttttggtaattggtcactaggttaacattgtagatagttatacaaaaaaagtgtagacaggccataaacgcaatgacgctgggaaggcggaagctcatggcgagggtgaacaattcgaaggtatccatcaccatgatgaagatgaaggtggacaggctgtctcccatgtaggcgatgtctcgtgttcgctggttgagattcaaaccctcctctttgcggtagctgattttcatccagcagcagatatagtagataacaacacacaggaacacgatcatactaaaggcaacgtacatgataatctggatggtgtccaaaaacaacatgggagtagttaggtgcatcacgttgtagttgctcatgttcatctcagagtaatccaccacgttaaagtacgcacagggatagcccactcctgggatgttcatcatgacaacgtgtccatcgaggttgataaatgtaaaaactaccattaggacggagacgccccagatgcggctgttcatccagtccaccttggaggtcgccatggtgccgccgcggtggtggacgtcgaggcggtgccaggcgagtgcgtctcgatgacgaaaaaccggcgagtcgttaaatacttatggtgcgtgatgctccttgagtctgtggtcggcgaagtttccgcgcggcgaaactgcactactcctgcggatttcagccccgagggtacaacaccgcgtccgagatgtcagccggcacaaccttcacgggtgtcagctgtcatctcagctggtacgggatcattgaagacgcagtgccagtagttcagtgtttatttatacacattggccgcaacaatagcgagccgaagcttcagacgtttattctacgagctgatcccttgctggcagcggatctgcgagtcgtgcatcgaggcggttatgcaaacctggcggccacagctgacggtgaagagcgccagcagagtctggaccggcgtagctccgtgctggcacgcgtgctgctggaaggcagcgctcttattcgggtgttggctcacccgttcagtccggtgcaaattcgcaccgatcagcacgagctagagatcctggaagccgcgccggcgctagatatcgaggccgccgctgtgtcaaacgcactcagcctgttccatgtagctaaaatggtcattataggatcctaccctgagttgaccgaaccccgttcagttaccgtgggcgaggagcgtgtgagtgaggaatatgggacgcatgctaataaaaaaatgcgcagaggctactatgccttcgatgtcgccatgtcctttcgggttggcgctcataaatatgttttagaacgtgacgacgaggctctagtctcgcgtctgtttgagattcgagaagtttctttcctccgcacttgtttgcggattgtcacccccattggttttatagcggtagcggtgacagacgaacagtgttgtcttttattaaaatctgcctggacacgattatacgaagtactgtttcggggctttgcgggacaggctcccctatgcgactatctagggcctgacctttttgaagctgggggaagtcgctcttttttctttcctggctttccgcccgtccccgtgtaccccgttaacggtttagggtgcttattgcgggaaacggctctcgatgccgcgggcgaagtgatatcttggtgtggccttcctgatattgtggggtcgctgggaaaactggaaattcagcctagcacgctctcgctcggggttcccgaggatgagtggcgcgtgttcggcggagaggacaccgatcctctgcgcatcaacggaactgcgtttcgacaagccagcgagacgctctttagccatctatctacacgtgctggagagggagaattcctttcagctactgtgcatgctaaagattcgacccttcatcacctagtcatcgtaaacttggtggagtctgtagtggctaagtgtatcctagctcgagactttaataccgctctgcgctttaataatcgactccacaccaagaatgtttgcaaacagtttattgacaacctgcgatatcgatcaggtcgtgccttttggcagattcaaagtttactgggttacatatctcaacatgtaacgtctgcgtgcacttccgcgggtctgttctgggtcttatcgcgagggttttgtgaattttatgtttatgatggaaccatgcctcatggaccggtttctgccgagacgtgtgtgcggaccgtggtcgagtgttattggagaaagttgtttggagacgtgccaggtcctgtgtgtcggttgcaagccagtgctcctggcattatactgctttggggcggtatgcgtcttgtgagtcctttcggggttgacgagcaggacgactggtggtcggtggtgggtcaggtgttgggacgtttacccacattgtttcgaaagcggccaactgcacaggagttggagtctgtttaccgcgaagtgttgtttcgcttcgtgtctcgtcgcaacgatgtggatttctggctgctacgatgtgatccaggggaacacgaggtacgaccgcacgttggagtgattgactgcgctccgttctacggcgtttggtctgagcagagtgaaattattgtacaatctcgagattcggcgctggcggctgaagtaggttacacagtgtacctgaagagagcgtttgtgatgctaaccgcgtgcattgaagctatgagcgtatgtaacgtggcgctcgtagtgcctgcaacgaattcttcattgtcttcggcggtttggcctgggcctttggaggagcgggaagaatggctcagggcgctgagtggagaggcgcggcaggcggcggaacgcgtgattgccgaagggtcgcggtttttccggctcaatgtgtaattaacaagcacaaacagctgttcacaacatatttgggtcacatagaggtaggcttggaaagttggagttgagcacctcgattagagccacttcgactaacttgccgtttagggtttgacgttccattagtttcatagtaactttgtaagattcatcctggcgcgtgatgcggaaccaaaaccgcaagatggtgtggagaaatgactggcggctctcgtaaaacaaaataaacacttttggaacctgttctacgatttctgttgtcttatcgtcaaaaaacaggtacagggtactacagatgagtttttgacagctaatgcgtaacagtgtgctaaattggtctcggatgttaacgacctttaagtaccccagtaagtctagcagacactttctggtaagggttaagttctccacgcaagagagaatagtgcaaagcgtaaagtgcatcaggttactagtcctcacgatgccgcaacggtgtttcaaccgcatcgaggttagtttcacgtttttcattacgtcctcattttccaaaagaaaaatggtagagtagcccacgaatgaagatttgaggctcatttcgccgcggtactcggagatggagcacagcatgccatggtcggtgtgaacccacaatcgatcgttactcacggtgatgtccacgatttgtggggtggtcacgataacgttgcgactcgtttcatcagtatggacttccaataccccgcgcaccatcaggatgtccatgccgggaggatctgaaggggccgcctgcatcttgttgttggctcggacgttcagcgtctgaggaaggccgatggacaactggctgcctggtcatttggcggcgccttgccttttcgcggttgcagatgagttccacgtactgtcggaacttactgtcgtcataggcggccgcaacgatttctccaaaagacaagtggagatactcttcaggaatgggttcgagggtggacagggacagaacactgaacagatagggaatcaccacgcgctcgacagtgtagttggagtaaactatggcttcttcggcaccttgagcggtgactaggcgtttcattcggaaagtgcgaaagtattcgttttcccacagctcggtgagaaggttttcgagtttttccgtgttcggaataaattgcgaaaaaaagctgttggccaccacacggttgtcttctatcgctagcgggttgaaggccacttcttgcgccttgcgaaccgcttcggtgattgataggtggtgaagttttggctcacgttcaaacgtctgcgcggaccgctggcgcgcataccgagagaggagatcgcgcaattcccgcacccggctctcccacgcttgattcaagctttttaggtcttggatctcgtccacctgggcttgaatctgctcttccaagcattttatcatctgcttcttaaacagatcacgaatatcacggtcttgtgtggcgtttgttacgggaggtgcgctggcggacggtccgccgcctggggtacgggagggcatcaggcgactttggtccaccagggaaggggtcaggtcttggaggaaggattctacactgtcctcgatgccgatacgcgacttgctgtctgagacgttcaataaaaatttcataattgactttttggcgtcgctgccgcggtcgtgtttctccatcatgtccacgattctcttacagttcatctcatggcggcttgtggtcacggctttgacgggatacgtattgaggagctgacagatcttctgatggcggcacaggctgtcgtagcgcaggatttcttcgtgaaggtgggagattggagtggtaaagaacagctgatttcgctcgtacgccaagggttctgtcacaatgtatctgttgatggtccgttctttcagctgcgcttcgatcttctcggatttgatgcgcttgaatatgcgtaattcaggtgagttgacaatgcggacaccacacaggtgtgtgactacctgctgcaggagatgcagattgctgttgagtagatcttgggccagagggtgggtctccgtggacttgtggatggccgcacgaatgaaggccgcgcgttgcgcaatctcggcaggcttggacttgacatccatcagcgggatgatgcccaccgtgacgtaccagtccacgtagaggccgtagtcatcgttgtccgcgaattgatataaaatgtcacggagcgttccgaggactccggtctgcacgctctgtcgcacagaggcgctccacaccaagagatagttttccaagtcctcgtcgtctagagcttggtacggaaacagggtcgagtgaatcttccattcgtccgctacctgtcgcacggtaatagtatcaaagatcgttttacacagtccgtacagcagctgttttctcaatacacacggatcccggagaacctggtgaatgctcttgccgcggcacgtgccgataaagccgtgcaagagacgaatatagctcagtgtctgggcggtgggaaagatgtcgatgaccgtgtcgtcgtcgcgccccgttaagtacgaagatgctttgattctcaacctctcgtccgcggctaagatcgagcggatcgtcgacaaggtcaagtccctctccgatgttcgcttcgaaccggaggatttctcgtaccaatggttcaaatccatgagtcgtgtggaacggtccgcggatcaggacgttcgcgtgccctgcacagatcagtggcctttcttcccctttcggacgcttctggtgaccggcacggccggtgccggcaagacgtccagtattcaggtgctggccgcgaacctaaattgcgtcataaccgggaccaccgtaatcgccgcccagaacctcagcgcgattctcaaccgcacgcgctcggcgcaggtgaagacaatctatcgcgtatttggtttcaacagcaaacatgtgcctctggccgagggcggtaacgatattctgaagcagtaccggatctgcgagtcgcgcgacgaaaataccattcaacgtctgcaagtgaacgatctcttgacttactggccggtcattgccgacattatggaaaaatacttaaatatgttggaacgaaaggcgtctctggaagatgtttcggagatgtgcgagagtaatgtcattatcattgacgagtgcggcctgttgctcaggcacatgttgcaggtggtggtgtttttttactacttttacaacgccgtctgcaataccacgctctaccgcgagcggcgtgtgccctgcatcatttgtgtgggctctcccactcagacggaggctttagagagtcgctacgatcacatcactcagaacaaaaacattcgcaagggcattgacgtgctctcggccctcattcagaacaaagtgcttatggagtattgcgacatcgcaaataactgggtcatgttcatcaataacaagcgttgcacagatctagatttcagtgacctgctcaagtacatggagtttggcattcctctcaccgaggaacacataacatatgtagatcggttcgtaaaaccccctagttccattcggaacccgtcttacgcctctgacatgaccagattgtttctttcacatgtagaggtgcaggcatatttcaaaagattacacgaacagattcgtcagagcgaacggcatcgcttgtttgacctcccggtttattgcgtggttaacaaccgggcctatcaggagctctgcgatctgagtgacccgcttagcggttcgcctcagccggtggacatttggttccgccagaatttgacgcgcattatcaattactcccagtttgtagatcacaatctttctaacgaaatactcaaagagactttacgagcagaggacacggaggaagctttagaaactttattgacattgcgaatcacatacattcagggaagttcagtgggggtgaattcaaaggttcgggcatgtgttgtggggtaccacggcacttttgaacgttttgtagaaattttgcagaaggacacctttatcgagcgaacgccttgcgagcaggctgggtatgcgtactcactggtctcaggcctgctcttttctgccatgtatctcttctactcctcaccgtacacgaacgaggaggtattgcgagaattgggccggatcgatttaccgatcatttcttctctctgtgtggatgagaaaggtgtcagtgaggcgggcgtatcgtcgggaacgcatacccaaacacgggtagcggtaagcgggggcggtggggacgatgatgaagcaatggtgctggggatggatgaggatacttacgatattccttgtatgaacgaggaggtgtccgattccgatctcttggcgcagactagtctgtatgaggatccattctttggcaagtatgtcaaacctccgtctatcagtctcttgtcgttcgaagagacggtgcagatttacacgacctttcgcgacatctttcttaagcggtatcatattttgcaacgtgccaccggaggccggttcgccgccttgccgatggttacttacaatcgccgaaacgtggtggttaagtctaactgtcagatcgtctcgcagacgggctctttcgtaggtatgttgtcacacgtgtccccggcacagacgtatacgctcgagggttacacgaccgataacattttgagcttgcccggtggtcaccgcattcaccaagaggtggcacagcgaggactgtcacggctggtgctcaaggatgcgttaggctttctgtttgtgttggatgttaacgtgtcccgattcgtggagtccacacaaggtaagagtttgcatgtgtgtaccacggtggactacggcatcacgtcccgcacggcgatgaccatcgccaagagtcagggactttccctggaaaaggtggcggtggattttggcgatcatcccaaaaacctgaagatgagccacatctacgtggccatgtctcgggtgacggatccggagtatctggtgatgaacgtgaacccgctgcgcctgccgtacgagaagaacacgaccatcacgccgtacatctgccgcgcgctgaaggaccgaaggaccatgttgattttctagagaatgggcagggagacaaagaaaaaaaaaagacgcggagagggagccaccctgtctggcttgcattggttgtttagtggaagaggcaaaagcccggagggtggctccgatgggtctcattctgctccataatagttatttcagtatgcactggtaataaagatctgtgatcccgtgtggaagagagagaggataataaaacatgtattgaaaacttgccaacggctatgtgatctttctcacgtagcagaacagggagagacctttgtactaattttattgtttttgtgtttttttttttcaaagaatgagatgctctcttaagagctgagctgttaacggatgtggtgatacattaataagtatttccttaacagaaaaaaaatgtttcataaatgagaggagagaagtatgaggtgtttttctttaacgcaataaatcacagttaggaagcgtagcgtttggcgtgcatcctttgtcttttatgcaactgaaactatccgataggcagagacgaagcgagtctagaaagctcgttcagatcgttcgtggcctgaggttttttatttttgcggcggcgcgccagcagcggcgcctcttctgaagcgattcgtgtatatagcgtgcggtctgctaatcatatagaccaattgacatggatatccagcttttgatacgggttattatcgtttgttatggaagcttttgaacttcatgattaaggataaaggggcctagcaaaaaaagtttttctcctaagagcaatttttcttaagagctatatatcatggtaaattcagaatcctatggtgtctttttttatctccaagagaaaaaaatcaacattatggtctaacttacgatgatcctttggtcactgctgaccaacacctacagttctttttttgtacgaatcctaaagtacaatattgttcgttctcaagtaactaacttatctgctatgttttgtttttctttttttttccgtatacgtgaggattattacccgcctgcaaggcgcaagcaactctgggctagatgacacagagaactcacatgagcttggcttgcatgacaaagacatctccctcgatggggatggcgcaacttactttaaatgggcttatggttacaatacaaaaagagagaaaaggaaacttaactgagacgactctataatttgtaccttattgtgactatatactacgtgattacttgtatataacaataatgatatatgaaaaaagtagcaacaagagacaagaaacagcttaatcaccctgaccagacagaccatcaggaaattatatatatcttgagacggccaagaaggacttgagtaacggcggccaaaaatgaactcatcattcagggctgcggcctaaacgtttgtgatgatgatagtcgatatacattgttaaatcattcatggttgtgttgactagatgatacagatgaatgtacacagctaggtgagacttacagctatccatccatttttcgttgtgattagctgagagattagacgtttatttatcactatggtatgtgcactatggagtagccctataggaattggggagcagggtgtttatcgctatggctcttttatcactacggttgtcactaatgatttcctagggagcggagacacaagaacttaaactatttatatacctaaatgatagcttagctgttaactctaaaattgtcactataccttattgtcctatggtcactatgagaatatcaacaaaaaaaggtaaaactttataacacgcaaacaacaaaagaaagattagcttattgttaaacaactatacggcctatacatacataacaacaaatatatagctatgatgatggttatatcacgcaggcttgtctatcgcttggcggttactgggatggaaacgaaaacaagagagaagcaagttcatcgcggaccggccgcgaggcgcataaaaaagcgtagcggttgcaaactctgtgcattggttcttgttgtgggttgagatgcccagcagcacggccagactcctcgatcgcgaaccggcgctcaccggggagttcggtcgggggaccctgtagttgttgttcgttttgatgcttgattagatatcctgttggtgaggggaggtggcaggctgagttttttgcaaggttagccttcttctaccccctacacatgcgtacttgtttcttgagttaagtgtttgttttttttttcttaatagttatcgttacaagtctggcttgattgttcagggggggttgcatctttttagtgagtgtgataccacgacgtagggtgtggtaaccgtaacaataatatctgttggttaggagaacttaaatgtgtattaggtattattctcttatgctgctaacagaattgcttctccgtaactattatcgtcttacagatagattgcgtttgtttttttttttcaagttccccagcaaaaacagggagtctgtggctttttggttcgtgtacatccgtgttcgcgtatcgaatttgatcttcctgcgatgatgtagggtccttgatgtaggatttcgaatatcggtattttttcttttagcaaagtgagggttcgtgtaagtttctatacaaacttatgtgaagtttatgacgttcgtttgttatctcgagagcggctcgaaccttcttctgtagagctttatttagtgcaactttacggggtgtagaagctaaatgaatctctgaaggtgctactcatttacacttcgaagaaacatccagttcgtgaaaaaaacaagtgtcttcgaaatcatgtttccactatttttgcaattacatctgtgaaagtaggcagtagataccagattcttttttatttttgtttgtctcttatacaatggactacgatgtttctcgagagtatgtcgtaagcttgtccgtggtgtagatcgagttgctattgttatttccttttgcacacacagttgtttcaattagatgtttgaccgtgattttgcccacccggcccgggagacaaggcaaggagatttgttttttgcgtttgccatttatcatcgttatttactattagtggtgacaatgacctgtcagattgttgattattttttgggctacagactataaatcttcaaggatcgaggaaaagcaaacaaataggaaaggaaaaaagggaccaccttacctgtggcgtctcattctctgttgcagcggcggtcggtgctgttgtttagcctggagaaggagacgagaacgacgaatcggcggttacaatgcggaggaggaggaggtctttcggcatcatcgtcgccggcgctatcggaacactactcatgatggcggtggtcgtgctttcagcccatgaccatgaacacaaagaagtaccaccggcctgtgaccccgttcacggtaacttggcaggcatcttcaaggagttgcgggcgacctacgcttccattagagaaggtttggtatgttaggcaacgcagttctcggatgtcagtccggatcggaggagtcacagtctgtcatgtgatgatatattgcttaatttttgttttgcagcaaaagaaggacacggtgtactacacatcgctgttcaatgaccgcgtgctccatgaaatgctgagtcctatgggctgtcgcgtgaccaatgaactcatggaacattatttagatggtgttctgcctcgagcaagtcatttagactacgataatagcactctgaatggcttacatgtgtttgcttcatccatgcaggcgctgtatcagcacatgttaaagtgtgtaagtgtttcaggttcgataaccccgcgatatgacacgtaaatagcgatatcgtggcaccagacgtcagtcacagtcttccccggtcgagacgcatcttatatcgcgatatatcgcggattatcgcagtatgtagcgatatatcgtgtcaaagcactccgaacgacattctgatgacggctatcgccttatgtcgcggtatatcgcggaatatcgcagtatatcgcggttatgtcgcgacataaccgtcatgtcgcgactatcgccgcatatcgccactatcgcgacttggcaccgtgccaacgatagtcgaccttagggtggtcgtgtggtggtggggggctgcttgcggtttgcaaaccggagaggtagcacacgctgattgtcggtttggaagcgttgtttacacatgtctttgtcttggcagcccgcgttggcatgtactggcaaaacgccagcttggatgtacttcttggaggtggaacacaaggtcagttaaggttgccaggtaggttaaaacgcagaaaccattgttctaccggtttcctaaaacgccgttcaacgtgttttgcagctcaacccctggaggggcacggcaaaagccgcggccgaggctgaccttttgctgaactacttggaaacgttcctgctgcagttctgagccagctgtcaatcaaggcagccaaaagcagcgttctccggtttacaattctcggatcgtttcgctagttaagctctaataaacgtactgtttaaccacgttgcgtcgtgacgttgtttatgagtgtcacggggtgggagtgtatcatgttgtataaatagcgagagcgactcgcggcagctctctcaagctgcctacgcgcgtataactgcttgccgagcggccctggatagcctgcaaccatggaagaaaccacgtcaacgcgcacttattggactttcaggggcgtttctcgcgtgcttcatcagtctgtgaatacgggtttcgatgtgcggcagtcttcttttgagagtgccacgctcgtccggtgcctggacggtgagggcaccacgactgcgctcggcaaagggtggctgtgttgtaccgtggtgcaacacggagatggaaatgctcctaaaggacagccgcaacagggatttatgtctttggacgttactgtggaggacattttggataatttgtttgtgcgtggcatggtggtgaataacaagaacgtttcttctgtggtgggccaaggaaaaagtggtgacagttcgttgttaactgtgatatctgaaccagacacgctccaagtgacttttatcagacatcatactaaattttcggactccattgcacaagcatcatcttctggtgcttcattgtcctccggcattccatcttcctcatcctccgtttctgcctctgttccatcaacggccgctttggaggagagacgggcccgtgccgagcggcatgaacgcaaaaagcaccaacatcagcaacaacagcagcagcaggctaactctgtgcaggatggcgctggacagatgcgggtgtctgggggaggtgaccgtgatccgcgcgtcttgaatcggcccaaagaccgccggtccgagacggacggtaagtcgggccgttccgcgtccgcggatggtgctggcggtgcggagtctcatagcagtgggggtgtgtggcactatacaggcgggtcacatcattaatttcgttttcgtgcggtgttcgtctaggctctcctttagacaaaaggccaaagacgcaccacgagccgaagactgcggcggaacataccccgcgtcatatgcctatggaacataaccccacatctgaccctgttggtttcttaaattattcttcgcacgctccattgacggaccatcccggtagcgacggtgcgttattacaaaatgagacagctgggtttggcgacgccgaggagcgccctgaggagcttggctccagggcgccttctcccgcacgtgggaatagcgggaccgaggcgggagctgatgctggggtcagggcgtccactagtgctaccgatgatggtggtgatgatgagcatgtaacgccctctacttcttcgggactgtctaaccgccatcttcctccgaattcgcaggcctcatccgcgccactctcacctcatcctcgcagcccccattttgaggacattatacaatcgctcaccaggttaattaatgagtgtggtaagggagatcgggttgatactcctgctccctccagacgcacgcccgagtgcagtgactctcatgccagtcctgctgccaccagtactgctgctaccgccgctgccgccacaaccgtccctgtgtgtgaggctccccgacccgtatgcgagattcgaccctatatggtaaacaccgctgctgcccctcagcctccgccagagcctcagcagccggccgctaacagacggactcgaggaggggctcggccccgcaacggttcccgtggaggaggcggcgggcgacgaggggcttccacctcgggtcgtaggcgacggcgcaatcaggatgatgaatctgaggacgagattttgccgggccccagccggaggagaagcgtaccgccttccttcgcggaagatggacttgaaattattgatctcgctgaggaggcagctttggcggctgcttccatcgcgtccttttttgactgactttttaaatgaccagatattgaaataacacactgaacgcgtgtatatatgtatataataaagtatattattgttgtattttatacagttattgtttgtaataaagaatatggttataaacgccagtcaattgttttctcgtgatgtttgcgaagatattcgttagctaagacaaagtgttcgttgccgaggaaagacttggtgttcttgggtgaagggtgccaggctttaaggatgaggtgacggcttttattgatcaggcattctagggtctgggcttcagcgccccagagcatgaacaccaagtgctcacggcactctgacagtctggagatcactcgctcgctcaacacttgccagcccaagtggcggtgcgagcctggctggccgcgaaccaccgtgaacactgtgttgagcagcagcacgcctcggcggcaccagtcgtctatgcatccgccgatgggtctctggaagccggccacggtgcgacacagttcgcggtacacattttgcagcgagggcggcgcgacctgcccgggcagggtgccgaacgccaccccgctggcgctcccgtcacagtagggatcctgacccacaatcaccacgtacacattatcaggcgcacacaagtaactccagcggtgcacgtgctcgggcggcgggtacacagtatcgctctgacgagcgcgcgcaacagcatccaccgtatctcgtagcaagtctaagtcatgggatggtatattcagaaagactagccattccttactaacagacaagaggcgagtctgctcgtcatggttaagcatacaagctttattatcaggaatgttttccaacatccactgctttaaggccattatgtagtaaagcggggttgtttgttagcggctgtttccactcgtctgggatatcaaggtagtatttatccaagcggtcgatcaaggcggtatcaaggtcgtgacgtacgagaagctctctcacgaggttatacagagcatagaacagctgaagtccattacgatccgctcgagtggccacgggaatgcggacagggcgatgcatttttatgtcttcatgacgcacgacaacgagagcggcaaattgtcctttgtgaccaaagtcaaacccgagtacattctcggtaaagatgctgttgctatatgtgagatatcgaaggtcgtacgcgcggcacacattatctacacacgtgtagatagacccggtgtctccacactcactgtagccttgcataatcttcatccaagtcggtgcaccatcggatttcagaagggttaacagagttcgcagctgagcggggttattgtgtagcagagccacaaagtccatgaaggtgtcgtccaagggtattgtggacgcagcatgtttagtgaggggagtgtagcgaagaagttgcgagaggttgccatcgggatgatttacttttattaaaggcttggcccagctatcatcctcgggtgaaaacgtttccccagtaaagcatcgacgggtcagttcgagacaagtgaggttctggggtaaggtctcggcaaacacgagcgtaaccaaaacagcagcactcaccagtagtctccacatcggttgtctcttactcagtagtataccagtctcgatactctatctgtccttgcaggattatagggtgatagcgccctagttgatttaggaagtccgagttaacgtctggtaaccctaaaagtttatatattgcgtctaccaggttggaggtagccgatgcactaactaccaagctgtcgttaccaattttgatgatggctaacggcttatgacagggagtcaacgttggaggaaagaatgaaacgctggtcactgttgaccaggagttaactgacttgttagtatagtcacatgaggttatattctggtatgtgtcattgcggtcgcaagtggcctgaaagtaaatggtgtcttcagtatcgtatgtcagagtataacccggtgattgagggaaatatgtatcttcttctgaattggtttcaggttcctcattactatattcactagactcattaatatcgtcttcctctccggggtctttgaatacaatggaaatagtctcattgcacaagtccacaatctgcagaggttcatacggacttggggtggtaatgttaattgtaacgttttcatatccagtggagttgtaaggttctgtggtagttacattcatgtcagctgtggtgtttggtaaactagttgtgtttgttttaggagttgtagagttagtaccattaacagtggatgtagtactagtagtggtagacgtgttactagcaggactgctaaccgtagggctgctaacattagtgggtttagtacttgtgctggtagtgttggcgggacttgaggtgaccgatgtgctgctcttgggtgtggttgctgatgcggtgccagtggttgttattgttgtgttggtgctggaagtggacgatttgggtgatgggctcgatgtagtggtattcgtggtagctgggctggaagctggtgagggggttgacatattggtggtagaggcggttgttacggtgctggtgatcgtggaagcggtgggggtgctggtattgcctgcggtggtgctgctggccttggcgctcgtggcgacgatcaacagcagccacctcattgccagccatcgcatgcctgtggctggaactctgtgaaataattgtataacggcaggtgcggtgccgcgatcgacggatatgacagggcacaaatattgatattaaatatgtctggctgcttttcggccaccgccgcgcagagcgtcgccgcattaatcagatcctttttcgtggcgcctgacacgtacagctggtgtactccggtttcgtggtacgacacggctctggggattaccgatcgtacggtatcaagcacgttgtcggagctgttgtggcaatacttgaaggcggccacggcctgcggggtgtgcgggactgtttgtgtaatgatctgggatccggacaggacggtgatgttgtgcaatttcaacagcgtggtcttaaggttctgaaaggcgttgccacacgcggcgctgacttggatttggatggcggtggaatcatacacacggctgactcgagacagttcctcaaaaatgtatctgtactttattacacagctaggggcaaagcggtaatcgttgggtagcaggtaaggcgtggcattcaggtcggtggtttcgcgatcggtctccagcaggacgcggtggttcattaggtctatagttggtatggaggtggtttcactcgacgcggtagaggttgaaggggagggctcgggtgaagacgatggtgacaaggacaaggacaggtcgtcaatgtacatgtcatcgttgctactgttgttggccacagacacatcacgttgaaaagtgtccgccaagaagtcgtctatgacatcttgatccatcttcttgccggacccgctggacgcgtgactatcctcggctgcgggcgaagtcgtgttaaagacgatgagccgcttgcgctgctttacatctctggcatacctgcgaatcagtgaagtgccgtacgggtagagactctttgtgagcttaggtggtgttggtggctggcgcgcatcgtacgagggtgggggatggatgatcctaacatggttcacgtcttggttgtccggagggatccgcagaaagcgctgctgtggcaccactacaatggttcggtgtgtctttctcttattagcaggagcgagggacttggagacgcgttgggaggtgtacacgatgttaatgttggagaacatcgcggacggccttttgagtctggattaccactgcttaaagtaaggcacggggtagggcttttcttcgtccagccgtctgtacgcccatggatttcgttggcgcatgagaacgtaagtgatgtacagaagggcaaatagcatgaagaggaggaaggccaagacgatatagcccagtgttccgatgattggccattcatctggatcgcgttttatgaacacgtgcgtagatacactgtagcggtctcccaaaagaattttcatgtgagccgtattggggagatcatgattggtaaagtgaaagatgtactcccacaaactctggttgtgtctggtgatgttttggactttatgtgaggagtggttcgtgtttccaaagtacacaaaagccttgctgctggaatacacggtttcatttgtgcatgggtgatcattcacaagtacacggagctggatcatgctgtcgtttgttggagaggcgaatacagctttgattggcatgactaggaattcccagctcttattaagagtttgtcccgttgcaatgaatctgcaactgtactgtgtggtcacgttaggtgcctgtctgtacatggtaaaagtttgcgtggtgatgttgtataacattccatgagctgtaataacgatgaattgattaatcacacatcttaaaaatatacatataacaaatagatatagaatgtttctacttacatgtgttgctggtggttactgatccaatgctggtaaggttgccatcgcatccaacttgttcaaagcactctatagatatcaggtctcttgatacattctgagcatgtgacatgttgtgaatttgacatgtagtctgcagtactaggtagttgtagctgtaggcactttcacatgtaacatagatatcaggtactcgaggtttgtttgctgtggtgctggttgcagctgtgctggtgtcgctggtggtatcagcggtggtagtgacggtgctattctcagtagtagaattatcggaggcattgctggaggttgttgctgactctgtcgttgctggggctgttgttgtgttgctactggtggtttgagtaccggtatcagttgaactgttgctagtagatgttttctgagtactagtagcggttgatgttgcggtacccgatgtgctgctagatgctgcattggaactggtcacagatgatgctgctgcactagaactggttagagacgtggtaaccgaggtagctgaactggtcacagtcgaagtagatggagcggttgtagtagatgtggtattcgcagctgttgtggtactggtgccaccgatcacttgctgagcgatgagcacggcggccgcgagggccagaacgtgcccggtgccaagcattgttgtctgacaatagactttgacagctctatatgtacatccaccacgtcagttgtgacgcttgaacttacagctccatataaggcatgcgttaataataaagactacgaatactagttgcgctaacagaacaatcatcacaactcggttctgctgacttcgaggccaccagttcagagctgcatctggagtttctaccaaatctgtatcgttgaccagtactattgcatccttattagaagtattagtaatttttgtaaccataaaagagcggaccccataagtaccattggacccccaacaagttactgtactattcagatagaatccataaggtgcagtatccaacacctttacaaattgtaaataaaagggttttgggtgtctggtatactcataatatccacctttaaggaaagtagtgttgtggttggttgttatcataatcccacccgctaggaacctagagtatctggctgaggtgttacaataaatagttaagttactagcattataataaatataagccaccttcacatggggggcaaaaggatcacctgaataaaagggaaggctatataccaccgtcataataatcaccatgcacactatacccagataaatagcgtggtaaaaacgtaacatcttaccacctcttcaccgctggttcaaagtaccgtgtgcgccttgacagccatgatttatagtcagtcaagtgacgtgtagtatcatagtctaacttcaagatgcctgcaatcattacacccactgtcagcagcacgcacacacagtaccacagggacaggtctgaatcccacccgcagggattcaggtatctcttcttgggtacaaccccaacgcacaatacaccttcacggtcctcatccatcttcagcaacagacctacagttgtcatgggataagggggcatcctcaggatcacagcagactccgaagaccacaaggacccacggacctccactcggtatggtactgataatggcgtctgactatcataatcaaaagcccataccctcttggtgtcgttcataaaccaataaagtctggtatcaagttgcctcaataaacacttgactttcatgtggttcctatcccaacacatgtctggggtctgcacaccacagacactgaccaccacacttgttaaaagaacaatagctaaacctagcaacatgatgatcacaccaggacacaggtatacaaatgagcacaattttattgcatacaatcttatttatatacatctgaacactgattaggtaatgctaatgagatgatatggagaatactgatatggatatgtaatgtaacactgcagggtatgctatcatctatgtacaaggtcaggggcacgtcctccaagtccattagtcacagtccactgtttattaactgttcagtgcaatgttaagtccactgtgcagttcactgggatgattcctggttcatgtcctcgatggctttctcaatggccatgctcaggttggccaagtcttcatccttggtttcctcgaactggcccactgcatacatcttagctgcctgatcataaatgggcagcatgaaggaattggagttttcattagtgaagatcctgatggccacctgcttggggaatctctgcacaaggggcaccaagacttgcaaggatcccaagaagtccacgggggtagctgcgtgaacaatcatgttgcggtagtctgaagaccgagggcacatatcgtgtggctgcacggctttcagatcccaggcctgcttgattccactggcacaagcctctgcagtcttgcggaccacttctgcaggatacacgttaggcatggtgtgttccaccaggaagggggtagagatgctcaggttggggatcttcccaagtctcactctagccacatccactgcttccttcacctcatgggttcgggtgtaggtcaccatgatacccctgtggttcacctgcatggtcttgcatgcattcacagcttcagccatcagctgatgtacattagtagtcaggaaggggaggttcttgtactccagtgacctggtggtcgctctgaacatacgggacacttcatctgcccttactctcccacgcttggtctccacggtggggttcttgaagacagttccagccttctccttcatagcacttctcaccctctcacagtccaggggggtgagcctcttggtgctcttggttctgggagccttgggggtcttgcccttggaagtgctaggtatcatgggggctggtggaggtgtgtggatgggggatactggggatgtgatggtactggcagaggagaagtggtcacctgcacactcatcacagcactcagagtcactgcttgaggaagaggaactatccataggtatttgaccagatgccccggacatcttagtggttattttcagttgtacaccttgctgttcacttgtggcacgtgcagacaccccaggctcagtgtcttcctcctcttcactgtctgagatcacaatacatccagaggtgggttggatgtcttggcccttgtacctgatgaaagactcaccctcctgcttaatctctgatggctttagcatgcacgtgggaggtgagggtggtttaataatgaccttcatggggtgttgggtcttacgtgatttctttcgctgactcatactgtcagtgggtttgcaaacagctggcttggtgctactggtgctgccgctggtggtggtggaggaagatggtgctggggctgctattgctgctgagggtggtgctgggatcttgggcttggacttgggtttgggggtgccctgaagactggcagtgatttgcataccaggaacttggatggcagtggtggtgggagcaatggtgggagcagtggtggtgatcatacttgatgggatgggggcagtcactcctgctgagctagagtcaatccctgcttgactgacagcttgggccaagatgtcaagaggtgttggaggtggtggacctaagttaaagaatacacaggacacacttagtgcttttgtaaacagggacacatttattgatccacaacacaagtacactacaacatcttcccaacttgggttcttctcttactggggtctcccacctaagttcccacacttggttcccacaataatgaggcatacaccaagtatatagtgttatatctggagtatatattgtataacatagagtataatataaagtataacatagagtataacatggtttcaataatacaattagtacagtcagttaatccagttatatgccagggggttacagtacagttagtacatcattgggggcctgactacctggggacttacaatatcagagtacaatatcaggcataaatgcagttatagggaccagcccatataactgtacagagtttaactctttacttgtcagtcttgcttctggtctgcatatggtgcttgctcttagaagagggtccagcaccttcctcttccttaatatgaggcttggcatacttaatgacagtcatctgcaagtcctctgactcctcatctccttcctcagtctcctgaggagtctcaacttcagtctctccctcagtctgctctatctgagtctcactctctgccttaggctgtgcctcagaccctatctgagtctcactctcagtgccctcaatgtctgtatcatctgtcccttcatctgtctcctcagcctgagtctctgttccctcatctcctgtctcagtctcctgttcctcatcatctgcctcactctcttgttcttcctctgtgtcagagtgaattatcacagaggccagtgggatgtcagtaccaggcacattctctgggagcacaccagaaacaactgggaacctatcctcattgatcttatcattaacaatctctctaagctcattaaggctgtagaacttcatcttatctatgcccatcatcagggtggcatggaactcattaataacaattctaactttgggcttcagaccatctataagttcatcattgctctggttagagttggtatggatagcatggacaatttcatcaatcagatacagtattagcactctaacctggtctgatagcatggtaatgggagtgtgcatacccagcatagcttcatcatttttctgatgaccttccttatataaggccatacccaaagtagttaccagatgggtaaaattgttcacatggaaagcaacctctttctgttccttatccagtttcttaatcagttccaagccatcatgatttgcatctgtcaggtcatcataattagatagttgtttcaaaaatagtttggcatgctcctcattattgatggctttagggccaccagtaccctgcatggccatgagaaggtacttcatgcaggtgtatgtaactctgtctttgatatcatctttctttgttttaatctttaacataacgaatttctccagtttgctggatgagttaactgcatactgaactatctgtttgaggcacaccatgaatttttccttatactgaggaggcacaggagtgtcattaaactgttcattagcaacctcaaataagcatctcatgtcttggaagggggttttaagtttatccagaagcaaataactgttctgtattccctgttctagcttttcaaatttgtctgagaacacttttctaatatcagtaagttgttctctgatgatctcatctgcaagtcttctgtttctttggactctgagcttaatctgtgtcactgttaaaaaaataaaatagtgataagtatatgtagtgtgaatgtggtgcaagacaaataaagacacaggacacagactacatacttaccaacgagctgatgagctccaactacatcatccccttcttggatgatttcttcaagggtttttattggatcatcattagctgattcaaacagagggtcccccaggttgaattcagtcagcttcttttcttcatctgcaagcatcttctccagcaggtcaacagcgtgctgcagagccatgtccttcctggtaacacaacaaagtaaatggacatgagacttgggtttatgtagggaaaaactttattaagtattgtatgtgcatggagaatcaagtgttcagcataatatacctacttggcctgctttggtggagaaggcccagtagaaggtcctccagaagtcccctcctctggatcaccagcttccccagtatgggtctcatcctcaggctttctcttcctggaatccatggttacaggtgtctattggaatatgagagagagactaagtatctactgcatttgcctctacctggtggcccaagctacatttatattatcatcagcctcccccaccgggacttcattatcatcaacaacaaaggggagtgggactgaaccccttacctcctctgctacaaagctgattactgctcaacctgggtctgctgttgctgttgtattggctgcccaatacaaggctgaatctgcatcatcatcatcggtgatactacccacggtgctggccgccagtggcatggtggtgcttgtgatactgttgattggacttaacctgagctcaaccttctggagccaacaggtggatgaagagagcgagctggaagagggccccagccgtctacatacggacaccacctttataagtgcttctacagtggatttatgtgcttaaacagtgttagaataaagacctgcagacaaaataaggtgttgtatgcctttattaacaatttggcatggagccaaaatttcagatctggcggacagccagttggctcagatccaatatttggaaacatgccaaagaacaccgtcaccatttggcaaagggccaggaatagcgtcaccacctggcaaggagccatgcactgcgtcatcaattggcatagggccatggtgggcatagggccaatagcaccgtcaccatagggcatagggccaagatatagataagcaccgtcaccaataagggggcagggccaatagcaagcaccgtcaccaataggggcgttcccattaatcaatagcaccgccccttatgggggttgggctataggaccctcctcccatatatagcatgcattatataggctccaccccctttatatagacgcctataggccatatatggcgttggcttattgccatatgacgtaatggcgccattacgtcatatatagcctatagattctataggccccatttacttacattacttggcacggtgtatccgcgttccaatgcacccttcccggctatggaggctggatcggtcccggtaccttctatggtgctcctccgacgtccccaggcagaatggcggttccctaaacgtgcattgcttatatagaccgcccaatagggcacgcctaccgcccattaacgtcataggaccgccccattgacgtcaatgggcatgtacttggcagccattgcgggccatttaccgccattgacgtcaatgggagtactgccaatgtaccttggtgtactgccaagtacccatttacttgccaagttactattaataggtattgatgtactgccaagtgggccatttaccgtcattgacgtcaatagggggcgtgggaatgggcaatgggccaccccattgacgtcaatgggaggtgggcctattgacgtcaatggggtggtcctatacacgtcaatgggcggtattaatgacgtatattaatccctcccattgacgtcaatggaggcgtatccatattacgtcaatgggcggtccatatgacgtatataggaaggcccatatatggtattggtaatggacataagccaatatggctataggccaatatggacatatgccaatatggattattgcctatatattggctataatcaatactggcccattgccatgttggccaatggccatattggcttatggccattctattgaacctggctattagccatattggatattggctatatggatcaataacattggacacatgccaatccaatatgtcggacttggcaccatgccaagaccccaccccaaacttggcacggtgccaagtcgaccacccctcaattggcatggtgccaagtttttttggctcaatgccaggtccgccatattgaattggatggatgccagaacctccattttttattggcttgatgcccaggtctgccatattgttttggctgggtgcccaggcagccatattgaattggcatgagtccatagacgccatattgttttggagctattccaattcaatatggcgtttatggacgcatgccaattcaacatggccgatctggacaccggccaaaacaatatggctgacctggcacacagccaagaccgccatttgcaattggcaccgagccaaaatttcttggcaccgtgccaggtcggacattttgatttggcgccgtgccaagaaattttggcaagttgccaagtttcgattttacttggcatggtgccaaaatcccgattttgctttttcggattccccgacgctcggggaacacattgcgcgacatttggaggtcctccgatcgatggtttttcagataacccgggggtatgtttttgaaaagtctggcaaaatgccaagttttcagatattgaaaatgcgtcttttgcgccttctctcgatccaattttttctacttttttgatccgttgaacggccaaaatcacatcattttccaagcaattgcgcctgtctctcagaccaattttgcccgagttttcaagccaatttgacccgtctctcagactaattagacccgtctctcagactaatttgacccgtctctcagactaatttgacccgtctctcagactaatttgacccgtctctcagactaatttgacccgtctctcagactaatttgacccgtctctcagactaatttgacccgtctctcagactaatttgacccgtctctcagactaatttgacccgtctctcagactaatttgacccgtctctcagactaatttgacccgtctctcagactaatttgacccgtctctcagactaatttgacccgtctctcagactaatttgacccgtctctcagactaatttgacccgtctctcagactaatttgacccgtctctcagaccaatttgacccgtctctcagaccaatttgactcgacttttcaagccaattttacccgtctctcagaccaattttgcccaacttttcaagccaattttactcgtctcttagaccaaatctacccgtctctcagaccaattttacccgacttttcaagccaattctacccgtctctcaagccaattccacccatctctcagaccaattttatccgactctcaggccaatttttgcctgtctttcatgccaatttttcaacaaaaacacacgaaaaatatactggttttataaattacttttttgttgtaactaaattagttgtgttgtctttcttctacttatagcaatgcgcgtactctcaaacgaaatgaatacttttcgtgttactattgctacaatgctactcatatgccttatactatcagagttttcaggttcacagggttcggaattacgttgcagttgtgttaaatattattctggtataccatggacagcaacatgtgtttatctaaagcctaaaagtattgaatgcaataattatgaactaatagtatatgatggatcaccacataaaacttgtgtgcgtgttcgtaacccgtcggtgtttgatagattggataagcaaacatggtttacagtaaccaaaaaacccaacagacacataagtttgaagccgcagcgtacttcgtgtgctgtaccgaaatcatgaaactgcaagattacagagtgtaaaagacggcatgttatctacggtacgatatgacatttggtggtacatttatgataatgaagtgtttcgttttacaactacattcacttagtattatattgtatatacttttattaaaatgtataataattcatagcggtactaaaacagaattttgtgaatgtgctaacgtcacattgtttacatccatccccaatggcaccctttatctacaaccactaccccctaacgaaaattgcaccaaacaagaagtgattgctgtgctcccaaacaacactcgaacctgcttgaatccccatgctctggtagttagagttttctttaacagacttttcttacgaatcagtaagaacgaagaagggctctatgaagtagttgacactcagcttgaactacccgcctggaacataaccagaaaatactataagcgatatttgcaaaaaaaggttaattccgaaaacgcaaagatcctaagccgcatgatattatgaagaccactatgctttactttatttgtttactttccatgtcccacgcctcagacgtctgtcaagctggcccttcagactcctcgtccgtgacgacatcatgcactacttctataaactcaagcggctgtctggcatatgtagtcttctgccttatggtcgtttggttgtttctcacctattgcttggtactctagcttcagtaagatggcctacaacagcttccttctcagctgccttaccatcgcacttttactgcacggtcttccaacatcaactagcgctaaagacatggcaggctacgtacacgttcatatgcttaacgcacctgaagacgccgcttctacgtctgcgccagttatccaactagccaacggctttattacctgcagaaaatttacagagctcggttgggcactgtgtactagctgggatgatatggagtgttttccgttttggcgaaggactttctcggaaactaaaaatatcactgtgctttcagacgatccatactatgccggcgttgtgttgacagtacggacgcttcttggtgactccctagagcttacatcttatctcggggtcaggccttcgattgccaatgtgggctactatgtaatgtacctgtcatatgctaaggcgctcccggcaaaatttacccacaacgatgtggactatgtgaggtttgccatataccttcacaccgaaattgatgcgcagcaaactcctgacaacaacttcgtctttacgttcgccacacccgggacatttgaaaccccagacctcatgagtagttttgtgattggaaccgatgatggacaaaatagcaccttgaatttcaccactgttggcggagaaaaacaccgctacaacaacgtggagctcagctcagaaatgaagggcaattgtgtgtatcactcggctattatccggaacgtcgccagctcgcaatcttgggtgtcgtttgacttctccctatattggcgacgtaccaaaattgcatatagttacgtgcagtattatttcccgaaaccactccattcacctgaacccataggtcctgcctggcagagaatctaccattactttagcctcctgacgcagcttcgctacggaacagtagcgatcaccgtggtgctcattttccttataggtgcacttctaaaacgcagtcgtgaagctcattaataccgacgcgggttcacagtaccaccacgtgattgtgtgtttataaactatctcagggaagctctatgaccaacatgactgctaacaataccaccactgccaacagcactgctacggtgacgacaaccgtcgccacctcgaatatcacgagcgtgagcactaacgtcaccaccgttcttactgcgacaaccaccgccgaaccaggaagtgtattaacagaactcttgggtatcatcatctactgtgcttctaccgtcgccctcctctgtttattactagttttagtggccgcgctatatagcacttgtcatactcgcaacaaggttaaaaccaaatactcagaacaggagggcgccaaactaatcaagaacagccggcgaagttcgcccagcagcaaaaagaatcgacccaacaagggtgactaccaacagctgtggcaatcgcagtcggaaactgactccaccagcgacgatgacgcggataataacgttttgtactttgataaaaaaggaaacctcacgtccttcgtcaatcctcaatacggacatcgctcgtccatgatgatcgagtctcaggccgatgacgacgagaacatccactattacatgtccatctacgatgaactcgctgccgaagccatggccgatccatccgaatcgtgggaaatgcctaagatgttgcaagtcagcactcgagaagtgacgttgaaagagcccgaatatgacaattagctataaataacgtgctgtcaataaagagtttttagaacacaacatgggtgcatgtcgtgtgtttatcactgtcgtcaccgtgtgtatgttgttttgtgcgttcactgttcagggatcaatctgtactaaagaatttgggaattggaatccgaactacaggccggacggttactgggatatttgttcacgacagattgatgcaccactccgaaatcaattgttggaaaaaataattaatgcgtcagtctcgtatcattacgctaccagtcataatcatgacgacgttagtttactaaaacggtaagttatccatcgctcgttaaacataacagcggtgttcacaacagctgtgctttactaattgtgtgtatatatattctagcatcaacgtcacagaagtggcacttgtggtgaacagcgttcaggtgagacctggcgagattgatgaatgcctgtaccgccagcagcctgaagaagagataaaaaaaaacacaaaacaaccccatcttactcgtaggattggattaattaaagattatatttcagcaaagaaactcatcacatttgccgctagcggatctcacacatcccaatctagaatactcactgttgctattcgcctgccgttaattggaaagcgatgaaaaactataatcaacaactctatacctttgttttgctgatgctattgcgttatggcttcggtgatacttcttctatcaaggatcttaaactcggcaatttttgtcccatgtatccatctcctcgacaaaattttgggttgtttacatcttacaaaactcatccaacgggaccggaatgtggaaacaccagcctttacgtttttcacaataggtataatcaataccttattgaaagaccatccgcgtggtcaaacaaactggcgttctacctcaggtgagttttgtatcataacgtataatattcataatacagattataccaatacttttgggtgaacatatatttttataaatcattgtagtgcactacactcgcccgtgttccaaaagttttcgaaaatggctattggttacaattgcgtacatattcacgagttccattaacagtcttctttacacagtagattccgttaccatttggaatggtgctatttacaatttgaaagtccaagcacaggggtaatcgtggtttcccatttttgttcatgactgtctgcgggaaatgtgctattgcctcgttaccacagggtgagccgtactggtgaagccagagacagtctgattttggaggaataaatcctagcttcgttttacctttgcatgggcattccttctctctggcggtgccttgtaccgtaccacaaaggaacataattacaacacacaatactaacgaccgcatggcgatcaaataaataaacgtaagatacacactggtccgcgcagccgccgcggtgatgttgatggatgatgttgatgacaagctttctggatgatccgacatgatggtaattgtttcctgaacccaaacccttgcagcacgcgggatggaacacgaccacgctttccagcacgcatcttactcgccctagagtccgctaacggcatcagaggtaggaaaagtttccgaagcaatccaggcacccggtatccagtccgactcttcaagttttttcaggatcttggagggaatgagccgcagggtcactgcggtaatggcgctgtgcctccgaaggacgagggagcgtttctgtgaggtagccatcagtactgtgcaggccccatggtcgtcggcgcaggaggcatggtgcgtcaagcgctcccatcgtccaggtccgtcgcgagatcgagcggacagtagctgcacggcgttgtggtactgataaaagaccatatggatgttcgagggggactttccacagattcagaccgacttataaagcgtgttagacggaaatactccgtcaccctttccgcggattcggctgacgcggcgtcacatgttctgcgagttctatacaaaagtgctgttcagaaaggttgcgcaggtaggtacgccacgataaaataaagacacatgagactcacaacatcgtgactgagactgttttttattgtgcattgtggttatgcaatgtcatcctgcatttatatatacacatttatctgagatatctcatttctttttgtatacaatgaaagaggagtatgaacaaaattaaaatggacagtcgtcggtttcttggctttctgcatatcagtgctttggacgggagtcggtgaaaacggagaactctgggcgaggaggcggttaggaaatcttttcgtacatgtaggccgtgagcatcttgccatatgtagtgttcactaagatcagtcggcagcctagcgccaggaggattatagaaaatagaaagattacgaatatcagcaagaaccaccagtctcgggctgcatcatcctctgggagcacggagtggttgccggcctgctggtgttggcccgagtccacgtgcgcagaagcagtggacgagttggctagccggcagcgcacgttgtgggtggtgttgcatctattcaccgctatcgaggagctattgcaagtgtcacattgggtacagatggtttcgcgcttgtcgttgtaggacccagccgggcacggctcgcacaccgtcccggtggtttcgctgcagttcgtctttaccctatatcctttgccgcactttgggcagcactccgagcccaccgcgtactcatcttgcttacacgcgggtgcggcggaccgacttgccaggacagcggcccagatgaccgacagtagcagcatgtccctccggggtggctcatggtgtctcgcaagtcgcgtcacccttccgtgcccccgactgaccccacggtgatcacgggccagcggtttgccatccgaacaccgtcacgtaaatacacaagcccgtgccgccatcttgctttttacaccactcggcgcacatgcacacgcaacacacaccatagatcaaattatgtatttactacaagcgtctctttattttgctgtacagaggcggtacggcaacttcatcatacacattctcatccaccaagtcgttgtacgactcgctgcggtcttccttctcaaaatacccactatcactctcatcatccacgaccgagtacagctcttcgtagccaggcggacgcatgaaatgcgtagacataggtcgataggcgttcatctttttctggaagcgttctcggttcctgcacatctcaccgcacgcacaccgaaccactagcaccagccctaggcacacgccgccaatcaccatcatggtcaaccccagagaaacccattgccagtctataacaaaaatagggacaggagttttttctgtgggcagcgggggttcccgacgaaagttctggctacggaaacagtcaccatccaaaacatactgttgcagcacgggccaacatcgatcgggctcggacggagggcaaggcggcttggtgttggactgattactagctgccaagtaatagtacagtctgtcgaaaccgtaaaaggttccgcactggtggcgctgccactcattgtactctgcgctccagatttttttaccatcggcatggaatcccaacttaggcgcacagtctggatcaccgggtcggtgcagagtctctatctgcgttactatggtgaacctagtcatgagaaaaccgtgagtggcattgcgaagcacacaatcgaacatgccagtagtgttatcactaatgttcatagtcagggtaacataatgagatatggccaaatcgtgaaacttccagctggcattaatcaggcggtaagtcaaatcatcgtccacgaccgtcccgttagtggcattgatcttcagctcataaccaccatattctgattgacagaaccgcgcgcggatagacaccatcggccaagagtgaggcagaaaggcacagggcacggtcacctgggacccaatcggcataatcagaggtgccggcgaattgtgctcgtagcactcgtcccacattgtgtggtctatgctgcctcccctcaccctcggcgtcaggctcaccattacgatggtgatcgccaccatagcgcgtctcacccacatagcggctcgcggcgccgataccggcgtgcaggctttgactcggagcggcccgtcatgaatagttcgttttgaagccgattctgcgtccgcggagtccgcaccttcctgcccctccgccaaaagctgcacggtttcggcctcctcgctcacccggccgaagccttttcgaaaccgcacggtatacgacatgataccggcagtttcgacgtgcagtgaccaacaatcccgcgaccgtggctcgtgctcaccgccgaatgtgagcgcggcctttatgacgagatcggttgagcggtcctggaactcaagatcatcatagtgtcgccgcttgtggggtcccaggtcagagaggactcgtccgcctgttttttgcgatacactatagccggcaaggtgaagtatcgcagccgtttccaaggcttagtgcaacagatagaaataatgatgagcataaaaatgagaaaagacagaatggtagctacaacgattggaatttccatggcgcacgaaactcagagtccatcagacaacgacagtgcacaaagtagttagatatagaatttatttactggcttcacaagctgcgtcacaccggcccatcccacgtccgctctatcaggtgtatcaacccaaccgatcgatcgatcgatcacccagtctctacaccataggtgtatggttctcaatgtccaccacagtctctgcggcacgatcaccgctgctgttactggtgatttccacacggggcagttcatggggttgctgttcatgggattcgtaagtcggtggcgagtaatactgcacggggtcaggcgggccctttggtccataccaccactcctcacatattcttactatgatctccagtgccgtctccggctcgtcattctccaaaaccctcaggctgcgaaagtccttacagttgcagccgtatcggtaccagctcagaaaacaggagcaagtgaacacgtattgcagggttgcacaggcgtgtcgcggatagtagcacaggtatatactggccaagacgttaaagatgagaagaaccacaaagatggcagtcaacagctgtgcctgtattatcgggtccatggtgatagggaagaggtcttttaacagttaatttttgtttacgctcattctaatgttgcagatgagatggcaacttccaagcattcttgtatttcctcgtgagtctgcgcgggtgtctgtggcgcggcggcctgggtaagcagtggttgtttgctgacaactcgagttactggttggtttccttcaatggtcaccaccgtgtccacgggctgcacattctgtacttcaggtactaacccctcgttatctccttcgcggggcggagagtagtactgcacaggatcagtcggcggagcattcccgtgccaccaccgtctgaatcggtctgtaatccatccgcctatcgtgaacaattctccgctgttcagagatgtaagggttctgaacttttggcaatcgcagccgtagcggtaacaactcacgacacatgcacaggtgagcatgtccatgatggcagccttggcttccctcggatagtagcagatgtacacgatccccaatatggtgaggatagtgcatatcacgataacagccagcagagcatacaattctgtgtcctcagaactcatgacggcggcgagaacgctgacaagcagtcagttagccagtcagtcaagcacaaaagcagctgctgcgagccgtccaggtaaagccgacggtgttttttatctgccattcttgctcgcgtcagtccatgcgtcattgctggctgctgtcgctcacgggctgtgtgctaaccacggtttgcatagcgacgggagcctcggagcccaggatgggtgccgcatctgacgacacttcgaagacatcctcgtcaagcgcatcggtttgttcctcctgaatggaggacatgggctcctgcgttccatctgctgacctggatctggggggcttgctgatgcggggcttttttgttttgagctctttgagatagtcaatttccattaacacaccctctgcctggcgtctgatctcttcacccttcaggtaacttttcagcaggccgatctccaaatcgggatcggaattcttagaacggcatctttttcggcaaccgcccagaatgatgccgagccacggacatgtgaacacaccttggcagacagccatcatgtgcatcggatacaccaaggttagaatcaataatccagtacccatgatgccgacgcctatggcacacaggatgaccacaaccatctccatctccgctgtggatggtaaacggcggatcgaggctcacctggttcgactcgtccggcgccgcaccgagtcccgcgcgtatctttcactctggcacctggccctctggcatccagccctttggcgagcgcatcgcaggagcctctttttgtagatgtacaaaatgtgcaaggtcattgtgctgctgatgcgctggaacatgactggagattacacttatgatgcgcgaacatgcgcaagtccatacgcacttctcctatttttcagaggacacctgcggttgcatcttcatcaacatctgcagagtgctgcgcacagcggtttcgatgacggcagccatctccggtgtcacattggggatttgcatcatatccgtagcaaagatagtagcatacggacttgaagagggagggtcaggagtggtattgggaacctcagtaataacagcatactcgccgtccatcatcagggtaacttttttacagttgctgtagattctttccgtctcggtgtcggaatggctgagagaacggttagtgggtattgtaggcaaagcagcggtgacaatcttttcactttgcgtattcactgcttcatccatctctatgctcactccgttcgtgggaattttcttacccgacgccggtggacacatgatgagcactcgtttgtagtcctgagcgaatcttttaaggttctcacgcaagtacacgtttcggtactcgctgtcaaacttttcacctcggattctggtggcgagtgatcggaaacagtagcatgtaaaaatgtccttgcatacactgccaacgcgtctcacatggaagatgagaagatacagaaaaagaaggatggcaacaattgctatggaaagaactagtcccacaatgatcttgtcctcctggttagtcagcatattcgcgggttgtggtggttagttgtcttcagggcagctcgtgagcagagcgatgttggcacggagccttctggtacgtagctttgtctcaacatgcttttatgtagaatgacaacgcttgctgtgaatctgacatggacggcttgcgcagtacatgtcaatcatatgcttctgaaacttgttcggtgttccccttgcatgccgcggcaagccgtcgtatgcaatctgcacagcatcccctgttatcttctgaaatctgttagccatggtactggaaaaattatcagtatctatgacacctgtcataataatcgggtagctgaaacatatgacttccacatagatggccgttttcagggttccggtaagcatgacaccgtccagaacatttctgagtcccgcgtcaatcagcgatgtgagtcggtccttgagctgctgcaaatccactgcaccggctttttcagatggtatgcgggacacatctacatgtacttcgatgtgtgtatgtttcgcagcgggagttgagtaggtgagctccgtttgcaccgctctggataccattatgggttttgcgggacacggttcgtgctcgcggccgcgtgtgcctcgcaaacatttcttcaacttccagaaagctacacgaacggacgccagcaatctcatcttgatggatcaaactgtggttagtgtaaatgctgtcgtgaggatgttgattggagtttgatatatatagtatattcagtctaggctatatcagtgatgtatctctacctccctctgtctttcctctgaggcattaagcacattccaaaacgtgctcgaaggcggcctggaacttgctattcattatttcggaaaagccttcatcatccatgatttcggccagggcggcggggcagttgctgacaagtaccttagcctctgccgaagactggtacggattaattgcctgtacactgaagagaacgctttgtaccttctccgcaagcagcgtggttagttcctccgaaaatgtacatgactgcaacgtgtatgtgttttcggtgaggaaagcacacaggtccacctccatatcaatcatggtgtgtcccgaggcagaagtagagtagctcagtgcggttttcaccatggagtttatagtggcagtgttttgagtacattggctctgcttgcgtttgcggcgaaatatgctgagaaacctgtgcatccatcccttcaaggttctgcaaaccgtcgatagcatcctcacgatggcgcagcggtgctcgttgcgtggatgtggttctagatgctgcagatctagagtggagcaagcggtgtcttggcactggttcatattatcatgaattgtgacacatgtcatggtttagcttttcggtgcgtttagaagcgcggctttcacggcggcctcgacggcagattgaatgagcagcgccacttctggcgttacgccagccgccgcaggtatatcagcattgggttccggggtcggtgcaggagcgggacagggttcgggatctgagtcgggttctggaacggaatctggaacagaatccggcgtgggtgtgcgcgtcgcttcctcctcggtatcaggcgtctcactcacgctatgtttggatggaggtttgtgaatgagtgcctgggtttcggcgttgtctgcctctgcgacatcggtatgtgtttgcgcgcgaggagactcgtctagagttggcagttcgcactcaaaaccttctaggtccacggtcacaaactctacctcagtttgtttcttgtccttgggttgccctcggcggctctgaggaggctcggtgggatacagcttggcactgagccagtgacagcaagtaaagcagcacggaaagtagaattccaaattttctttagttagcttgtttctagctgaaatctgcgagcaacatcttccagtaaaagctacgcatctggaaacgcactgacaaaaacctgcccatagagaagcgcaccacaaagaacaaacgcacatggtttcgtcctcatccccggtggacgcgtcgcgcttcgtttcctcatcaggcttcttcagtgaacagttaaagcgcgtacacagtctactgaagaaattccaaatgtagggacatacacgatctcggtagagaatgatcagtatatcaaagattatggctgctggtattccaatagaaagcaaaacaattgtcgcagtatccatctttatcctaagaaccgaccaccccgacaccaaaagaaagccacagacacggatcactggaaaagcaaatgccaagcggcctttttattactaagagtcatgtggaatggcgcagcctcatagaatagggataaagtgcaagtgattaaagcaaataacagcgagttacaccaacagttttcaacatcaccatctgttttacagctccgaaaccaataccgcacaatatttatgaacttgaggcgtatacacagcactgctagtcagttcggtttccacaaacaccttttcggtagttgcgcagacaggaccacacaatacagtaggcttcggaggagcgacctgcacttcagtcttatcatcctgattgttgttagcactcggatcccaggtgtttaccacctcccactccactctctggttcgcttcatcttcttggtgtcttcggctccaatgcgatcgccgccgtacttcgtaacgatctttttgacaacagtgactgcagtcgtgtcggcacctgcaccatggtccgcagtcacagcacacctcgtaacacagtccgcaggtaaacggccagtcgtaaatcaggtagatgaggcctactagcgatgtcattccgccggctccacataccaacacgccaagaggccacatgtctaaaacactcccagcagaattgttggtactcggcgatgtagcgttcatgttgcggtagctgctcgtcatcatccctatatttcggcagtaactcacttttcgggttatgttggttttgaaaaactaggatgagatgtacatttgctcgtaaccagttgttaacctttttctctctggacggtatcgaacaacgagctgttctgtgtcgtctgagtggcgttgacggtagtattttattcgtttcatctttccctgtccaaacattaacactacaacaacggtaattacaagtgccaaagcccacacggcatgcgtagctggggctgcaacatcctggagataaacatcaacagcagagctagatgttggtggtgtggaactagtaaacctacagaattcaggtgtaatgttggaatagctagttccatttccagcaataactgtgagctcaaaagcttgaggctttgtattgcaactagtctctggtttaaagacgtatctgcggctatcattgtgcgtaacgttataaagcattaaagtaattttgctgcaattataacataagctgaaccagtgatgtttcgtttgatgagaactcgaggttttacataattcatgctcagttgttttattctgagtattgttataaagcagtagccacgtagtttgatgatgggcagcatcgctacaattcgctgtaaaattaacggtttgtcctaccgttgcattaacaaatgttattgtgaagcccatggtagcatttgcagtcgttgaagtacgtgttgttgtaacactcgcaaagctggtcacgtttgttgctgtattagttgtgtgtgttgatatactaacattagtagttaatgtgctaatgctaatattatttgtggttgtactagatgtataagtagtaccaactgtagtgttagcagatataggactagtagatgtatttggataacttgtgttgttgggagtacttgttattgctgtgctaaaggttgtattacttttgctagttgatgtatttgtactagtagcagcttgtgttgaggtgcttatactttggggtgatgtcacaacgcttgtttgaattgtgtttgtggtagatggagatgatattgttgaagtaattgttgcattggtggtagtaggtactgttgatgtattgtttgaagcagcatagcgagaaagtatagcgatgaaaatgtagatggtacgatctgttacgaggtagcttattttgaaatgcatattggaatttacgtgctgtatagtcttgtagtttaacagtcgttatacctaagtgaccgtacctctgtctggaatacctttataggttgttcgtatgctggtgtgcgtcattgttgcgttgacgtttccacttaactactcttcaagtacgaagttgtttagaatatcaaaaatttcgagtttctagggaacaaacagtaattagataatgtcatagctaaaaataataaaaacatgtagtgaaacggattacctacgtaatttagatgtatatgaaaattattgcagaaactgcgcgttgtaccaatccgcgtattaaacacttagaacgatgctgctggaatcataatagttatgttcacaacactaaatggagcgtagtcctacagtttaaaaatgtcatgattataactaaattatataaaacataaaaagaacgtactgtagtaatgtttataaacatttcaggtgctaagttcggattcattagtagttacctatattactaaaatatagatatatacagttaatatcagcaaaacatttttatataaggtgtattaagttatattgtatactaaccacctgtatttggtgaggacaatgaaaacagtaaagatagacaattagatttcaaaatgatcctggaatgattaaaaaaattagatattaacagaaacatgaaattacttagattgttgggccatcataatacacacacacacacacacacacagcgaggctcatgctaaatcagtttcctaaatgttataaattatcgcactctttcatttgtcccagtataagtatgtacatagcgtatacaacaatgtgcatcataatttgcctaaagattataataccaataaccatgcaattatatgtgtacttcctaattcatactatgtgtcatttctaacaggaagtttcgttaccgtattggtccaaactacggtacctactgtactcactgaattgcataccatctgcaacacatatacacacatacacacaatatatagcaacacatgtgaatttcaaaatagatctcatggttatacaaattaaagtcataaatcatgtcataactttatttatttacatgcataggaaatctttgtatatgcaacacgttaggttcttccgttatcatagatgtacagataattctaactttttttacatatttgtataaacattgtgtttccgttgcagtgatgcaacgcacttcctaaacatctgcacaacgacttgtggcagccggagccagcaagccacagcggcgcatatgatcaacactacaagtatccaaagaccatgcagttctcgggaagcgtattgagcttcatagacgacgagcgaaacattgtatgtaaacgatgtggatgctgatatcgataacgatgtgagttgtgttgtcgacactgatggtgttgtaacggggcgcgctgtggtccaccatggatgagagtaggtactacagttatggagaatcggaatgggtggacctggtgtactggtagtattactccacaaacgggagtaaccagataataaacaattggtagccttgttagtacattgaaatgtaggcgtacctccagacgtcaatactagatagttccagtataagtcctgtccacagagtttgacagtctcattatgaattaccgtggcgttcacagcaccttgaacaatcaacgtgaccgttcctgggaaggtgctgttgaaactgcaggatacattgtacacactctggttagtggaatgtttagaagcataggtaatacccatgggagtcacctgggttctttgagtaatgttcataatgttagtaacgttgtcatatgagaaacagtcatatgtcccgggtgcatggggagatacaggccatcgcattgtgaagccatttgtattactcgcactagtcttagactcgtcatttggaaatattggtgcatggtttttatacatgtaaacttgtgtggtagcattttgatcacatgctgtaaaataaatgcccctagtacattctccagagacaaatatacacgttaccgtgtatggacctgacagtgtttcgttttttgttggaccactaacaaccttggtcatgtttataggaagctgatacttcatatctgtattactggtataatctttcgaagcacagcgtaacgcttctccagaggtgccggagggccacatcatgagcagtattaaggcatgcgcatgtttgtgagacaccggctgcatcatggccgtgctcttgaccttcaagtaagtacccagcccataatttaaaataacagacggaaactgtaactgttaaaatcaataaatacttttattataaaagctgtaacaatcctattgagttctgtgttgtctgttgcggcggaggtcgaaccacgggtttcttcctcacgatgccccatatgcaaaacccaaacaggcacagtaaagtgacggccattacggagatagttacaatgtccacggtactaagggtcatctgtattcgtacagttgtgctgacagggttcgcagaagtaatgttcacgcgcgggccatacagcctaggaaccggcgattaacagcgcatatctgagtcttgtagactccagaaccgctccccgagcatatttatccaacacaaccctcacgcacatgacgaaacacataggccgacactactttcgcacatgtccgtcccagatggcctgtttgacacttcggtagctaaaccgtcgccaccttggtttccgcaggggcttccgaggcgaatatagttcgaaaccgcgaatacagcatgaaaacagacgatcgcaccgccgtggctgtgcgaaccgcaataggcgttgcagtagccatcgggcttgtgagtctactcatagccctcatgtggtggctgctggccaagtaacgatccacaccatgaattgtcgcactagatgtttattgttttgggagatgatgggggtgagcgtagtgttggcgggcgtactgggtttgacggcgacggtcctgcttcacatgcagcacgtgttggccgccaacagcacgtgcgctgcgggaaacaacacgagcaataccacaaacgttacgggctgttcgacgtcgtcgtagccgtgcgacgcgggggaatgcggcgcggtggcggaggacgaggaggacgcgggggtagagagggcctagcagtactgagagctaggacctggctaccttcggttcctcccttctgttggcaacagttattggcgcccgcagccggtgtcttgacgcccgatgactgtttgcgacaacgaaagctcaataagcgtttggaaagagaaggcttcttggtggcctctttgttgtgtctctttaacagcgtggcgagatccgtgcactgtcgattggcgtgacagacgcgtgttgttggtttctgggtatcatcacactgaacggcaggcgatgagggaggcgacggaggtgatgcagacgacatagcggagacacccgaggcggcctgagcaacagcggcgtcggcgtcgctcggacaggggttcttagctgtcaatctctgcaggcggcgcggccacagcgacttgcggttgcggtgacggcggagaggcagccaaatacagcacttggtcgacagaaacagaaggaaggccatgaaaagtcctaggagaaacacaacgcaaagagcaatctgaaaaaagcgactagtaaagtccattatccataacacggtgtccatactggcgagtttgttcgtataaaagtgtcggatgaatgtgcggcgccaacacgcagaccttataacgccttaggaggcgagcgggcagggcggggagaggaatcatgatagtcggagcggtggcgcgaagcgagtttgcggcgtgcacccgtgccactgagcgcgctgtcgttgttgtcgtggtgccgaggcggacgcggagggcgggagaggcggctgccctgggcggcggcggtagcatgatgcaggagcacggaatggaaagtggacgatgaggaggaagagtccgcagttgtgtatgaagtgtgcgtatgaacagggtgatggcatgcgcttctgggtgaaagcgagcgtgtgcgaagagctcgattgggaccttccgtaaaggctgtatgattatcatttgcatgcagctgtgcgcttggcgtagggttgtccgatacggcagagaaggacgagattaaggcgtacacaggcacagagacggcgcgaaacacgcgtttgcacagcctgtacgttgcggacataggaagcaaacgctgcacggcaaggtagcgagtgcgctggcggagcgagaagccgcagcaacggcagaactcgttggtgagagctaagagaaaagccacgaagagagtggtgactgtaaaagcgaaagtaaagcgaaagaaggtgcacatgacatacatataggacagcatggtggcgcgagggctagctgcaggattgaggagaaagccctggcttgtcagtatgcgagcaaaatgctcgccggagcgaagtttatgagcacaggcgggcatgggcgggaagaggcgtgcgatgactagtcatcagtcaggccgagggagcgaagcagaaagtgtgtcctagcgaagcaggtaaacacaggcgctgacaggcagcaagtgtatgcatgtactggcaggtgaaggtgagctgcgcaggtaatcctgacgcacctggacctgggcgggccggttacccggccgtctctcaatgacggtgtttttgaggcgaacatgttcggcccgaacccgctgggcatacgcagcggactgtgtaacatgcagttacaatacaatcacacagcacacacgagcagtcacagagagtgcagcaagcccgagctaaacctgatcgacaggttggctgcctgccaagtctcccgggggaaaaaagacaaccgcgtgacacggcgaccggcggcgaggcataacaaacatgtccccgctcccgcgaaccccccgggtgccccccgagaccccatgctgtgcccggcctccctcctgtgcgaccacccgctgcgctcgctgtcaatcataggcctcctgctgggcgctgtcaatcaatgcgctccattgttctatctgttggctttgtgaccattgttattttttattggcgcgatgcccgtaacgtatgttttcaatcagtattcacatacatgtttactgatcacgtatgtgcaatctcatctggccgcacgccaatgtctcctaccaaccctcacggccacttgccattttcagccccccgcccaaaacaccccccacccccttcgcctcgctgccactacccggagcccccgccgaggcctcattcgccatacaggggaggaaatgtgctggcgttctgccactttgcacgctttgccagcgtcccatgctataaagctcgccgcttctctccctcgcctcacgttctgagctgaacgcctccacttcttgagaccctctacccaactctcaaacagccacctctccaaccatggcagactcgaccaccggccccgactttcgccaccccgaggacgaccagctagtgccgcaggtacttgtctctactttgtaccgctttctcgtctgctcgccattgctacgcatctctttatccctttctttgtcgctttttagggccgtccgtcctcgcccttatgtcccgacgttgccgtggttccactttcgcctgaaatgcctaagttgaccaaacagcccgaaatgccttcgactattccaatctgcacttcacctgaagctcctccgaaaccgccgcgcctgcacaaacaacggatacaatcgaccgattgtcaacgcccatctaaagccggctccgacaaagaagaaagccccagcaatccgcactctacatccaacccaacaccaaagccaccatcgaaaccactatcgcaccccgcaccggagcccacgcagaatccgcagcgcaaacgccagaagaccgtgttaaagcgtcctagccacccccctccaccgcctcctacccagtccgccgtcattcccaccgtgtgtgttagtccccctccctcagctcccccttccaagcctccccccgttcctcccaaaagacgacccgagttacacctgcccctcaaaggtccccgcatggtttccattgagctcccttgcctcacgggtagcggctcacctacctatgactatcctgttaattcggctcgtaccctgttataatacaatccatccgtagtaatcacgccgaagaaggctgtgtcgtctctttctccgcagcccgttgcctgcgccgctgcaaccaccgctcccaccagcctcgcatgcggaaccgacccttaactctcttccaccacgacgcttcgtcggctgctcctggatactccaagatggcagcggggcaggacgccactgagacatacgaacaggtggacgaccgcgacgaacgtgacgagtcggagtccagagtcaacgagcgactccgtaaggcatgcccccgccagtccccgcactgacaccacacgtcatgcgcccccttgatttgcagtctccactgcgcctccacctgcgccggccaactctccggccgtgggagaatgtcctccgcgagcggcaccacgtattcaatgtgcgccttccagtccatgcaggcacaccacaaatcgtgggagtcgtcagcgactcggcgccatgccaactcccgcataggcatgtgtcccacaagcccgcaagaaacgacaggttccatgttaactgtgcggactgtaactcgaagtgtgtctaaagttgtatgttatcgtgataactgtgtagtgcgattgtctaactcatccctgataacccgtgttgtcattgaattgcatgctgtcgtctgcattactcatgtacgttctctcctaaatgaaacaggcctagatctataaagaaatcgcaaagacattctggtttctgttttgtttcatttattcgtgtcgttattaaaacataaacgcaggaaaatatatctttagcgtatcttcaggaaacacatgccagataatggacaatgcgcaaatcattaaatgtagtgtgcacactgtcgtacaccaacatacatgccaccagtcgcgaaaccaaatagccctgcagaatgtccataaatagttatgtgtcagaaagtccggcttaacgtgaggctcacacgtaacccatatgatgtcggacatgttcaacgaaaatcgcatttccactttagtggtagtccaatctatttcgtaatatcttaaatcgtattccagtttatctgaactgagtttcatgtctttttcaaaaaattggagatcctcaattcctttgtcgcggtataccacaacctgcacaaagtaagagtctatgtttccagtgatgtatcccgtcatgaacagcttgccgccctccaggtaacatgctgtctgttgaacggtgtataacgcgcgtcgtgcagctagctcttcttcggtaagcactggcatcgggaaatcccagccgaatgtcagtccgagctgcagcgcaacgccgccaagcaccaatattgctagagaaaccgccatctcgaacgtttggagccgtagcagctaacattgtgcacggtgtttctgatttataacaaaaagcgctgcacgtaagatgttacgtgtatatcgaatgagagccaactccaacccactaggcttagtgcccgattgcctaagcaactaactatagagtcgcataaaaacacagcactcgttattctttatggataaaaacactttattgcacatattttgatgaacatgttactgtaacactatcacggtgtcacagccatgttgtccgttatgaggtagttgcggttaattgtccacatgagcaccacaagccttgtctcttctatgacccggcaattccaaacatggtgtcacattgagtgacagatcatcagtctgcgatgcttcgtatactgtcagccgctccatctgtaacacatataaaactcgttatggttttgttccaatgtatgtgagatattacccatcagctatccgcattgtaaaaacactataacatgatacacggcaaacagtttacctgctcacaccttgttgttaatggacacctcgccgaacatacgaacatggacgctgaactttgctgcgatgaatgttacgattgcgcatccgacggcaacgtaaaatgccaatctcgcaagcaggatccagtcattgtggcgagatactctctcggcataccaaaagatactggtatgatcaatttcaacttggacctcattcacatagcagacaaacgttttagccaatccatgatcgtgatacatgcgcaagtcaacgcggtatatggtaggagagacagcttcgtgcacttcccatgttctggtattaagcgtagaatgtgtctgtttctcatgtgaccgacgaatgttatcccggtcatgagtaactatctccacgctttggagtttcgcaaaatcagaccgaacagtaaacgtagctgtcatctttccacccttaacatgacaacgtgaatgaagcaactcatacgacgatgacaatggtaagggacttgcatcgatggccaacaaaagcgataacagtcccaatgtaacaagaatcttcatttcgatgttagacagtgtatcccagaatataggggtgaaagtccgcaactgtcctacagaaagagcggtatggagtgaacggtgtttgcagatatatacactagcaaacacgcccaggaaagccacgtcagaatcattgacgtagactccatagtgtcattctgtatactaaccgaatatggacacggaacattcgtcgttaagcggttttaggtacgtcattagttaaagttacatgtgcatgtaaccacacccgttatagggacgttgacgattgtccatccgtcacgatgatttccaggttgccgatcatttcgcgtttcactctcccaaaggcttggtgctatagactttggagtaagtatctatggcgcctggcctctggggaagtggtacgcgcaattcgggacgcccgttcatggaaaaacgacagggagggatcatgatacacagattttttaagatccatgccctttgattttatcgactggatcttggcctaggtcgttactctcagctaagtgcaaagatcctgccgacgaaatcataggattcatagttgtgttcaaggataaccaattattcgacctagctacgtatcatttacatatgcattatctagaccatatgagcatgctgctgggttacatctgatgaatttacagacgcacaccggaatgcataagcaaccaaacgggatataaaggaaaacagggcgggagagaacaagtatataatggtgcatggtattatgagcaatgcgtgttatcgctgactgtcctgtcgctaatcgggcgtgcgacgacctggacgtgcaaatggttgtatggtacatatgccttatgaataacaaccccttgcacatccatgccgaaacatgttcgaaacacatcacaaaacacacaaattagtatggtttatctttttaatacaaagaatgaataaaaatatataacagcataatctgagtttattaatgactgccacaacgtctgagacaacgaacacgatccaagtcctcaataacatacagcattaatgctgtaagcataagtgacagcaggatcataaggagatacagcattagcgtagctcctccataccgctccagcaagaacacgatgccttttggtgttgtttttggacacccaaacagtccgcggatgttgagtgcatgtccatggtgaaagcgaagctcaggatcacagcccaagatgcggatggctcgttcgtagcgcctcatgaacgcatcacatgcgggaccctggtccgtaaacgggcaatggcggcctgcttccttctgatgaagaccgttgtctggctgaggcacacggtcgcaggttttctccatgttgccgtcttgtttctggagcgtatttgagtcattcctccaagcggaggcgacaccagataagaccagcaaacatagcaggctgccaatcaccacgttctcattagaaccgcatgagccgcagagaggcttcataatgcgtcgatggctcacggacaatctgacaggtcacgttagacggtgatttatatccatgttgatgtcacgtgcaggaagactgaggcgcgcaaaccatggactgcactcaacgaccgtacgctgtgactccgtttgctaagcagtcatttcacagggccgatggaggttttcgccacaccgatttcgtaagttgatatcaaactttatgatcggtgcgacgaaatcttgatcgagacctttttttccaccagcagcagcaataaagttcatcgtgtctggggccggtcaaacttgaacatggttgtataaaaaattaatagttaatttgacaacagcaacataaacaatacccatacaaatccaatacaatttaccacgatacgagttatgaaattcttgatattcacgtaggtagaaatttacaatttgagttaattcatgttcaggcacacattttataaataaaggtttgtaataatgatccacttgtataaccacttctttaaacatataagacaccggtaaatggaactggtaacgtaatctgctggcatgttccagacgcgcatgatgaatgatatcgtgatccctgatgtatgttttagcttcttccagaagttgcataggatgaattgaatgtctatacatagtatcattcataatcactaatggatgatctaaatttgtagaaaaggcaaacattaattttccatcataatagtttctcaagtacacatgaagccacgtaggatccggaaagtcgccaagaacaattccgtttacatgaagccggccatcttcaatcttgcattcgggatccaattctgtatagccatatatacgtctatcaggtattcctgatcttggcttatatgtacgtctctcttgacatattttattacaacgttcggctggaacgatgagtaaaaggcaggtgaaaagaagcgctcgaggcaggtggtagcagtacatcttaggagaccgcggcattttggcatagacgtcgcaatcttctgtgagagtgctaacgtagccgtcctaaatatattcaaaagaagaagtaaacacaggataagcgtagctacatttgcattgacgtgcgctgcttcgttgggtactgcgtagaaccacacgcaattgacgaataattaaccgttaagatgaatttgcaatcgtatacgtcaatgcaatgtgtttccatgagttacaagttctgcaaaaacacccctgtcaatcctcttttgatgacagagggcggtacggtatacgtggcacgaagcacttccagtagcattccccaattgcacaacctatggcaatcacaacaagtaagatggccgttcccaacatgatatccatgcaccatagccatgcaatggtcgcatatcttccttcatacaccagcctttggaaatccccattgaataagaaatcccaggaggctattgtttcggggtaacacgggatggcgcacgcgcattctcgacattctttcaaaaggatacgacccaggtctgccggcgcaggtgtccgtgttgtaagacagatggtgtcattactggaaaatgtagtattcggcataggcaggcatcgtttgcgttgagaattttcccggctctcgtagtacggaaaaacagtggtttcatttggaagcgcttttcccatcatacaccaggtaacgtccaatatccctcccgtaatcgtgcaggtagcattggcatcttcgatatccgactcatctgctaatgccctatcctgaatccaaaagtaggcaagcaagaacacaacgagcaagcgcatattgaaaagagggttattgctcgctttgctcttgagtggctgaccgtgtgagataaatggtaatttgtgtctacttatatgccctgtgagaatattcccacccagtttcatttgtatcacgcgcacccattctcccaaataatgacataatactttaattataattaaacagaggatatactttttatttcacacaacagttttgtaatcaggctgagcacgatgactcggtctcataactctcagaactctgagagctctggtcgtcggcgtatgggcagggatatcgtgggaaagaccaggcagctccgttcagcttgtcgtaggtatagaacatccatctggtggccagccatcggtagcactcggtgctgttgggtctgtccatagcatcaagctcatcatagaaacgaagcttcattttcaggtaccaccgatcaagctcgcgttcatactgagccttttccgctgcactgaggttctggtacgctctaattgaattaatggcatcttccatatagaaagtgtcggcaacaatgacgatagggagcacggccaacaggccaagcacaatcagcctcatcgtttcaacgatagatcagcagtcccgctgtctagttagctgtgtatgcctgtgacagctccgtcaaccactttcttctgaagcaaatgtttgccagggcagtttaaactggcgtgtcgaagtgccaacttggcacggcttatatgtatcctagatggatacgtcagtcaaagtccctacgtaaaacatgtccaacctgcgttttacctgacgcacagaccattgcttcatgtcccggtgttttaacacggaaatccgcctttctcacgggtaacagtccggttcctcattcccatatgccgtaaaaccagtaggagcgcccggtaaggctccagtgcatctgaatcagcatgcaaagcataaaactccatcgaataaacatcagaaacagtccccagtaagcatgcaggagtcgaccttcaaatatgagccgatccagttgatcgatagaagcccaaaaggggaaccatgagatcctcagcttaggctcacatgtaatgagatgtgcatcacagtatgcacaaggatggacgtacagatttatagccgttacatgttttgtaagttgaatgtttttcaaaatatatcgttgttcatattctgtagacacattttgaggctcaggcaatttttctgaagaaaactttgtgattacgtcggcactaagatacagatcaggagcggtagcattgccagagtatgtccacatcgcatccaggtagttatcattaatcagatgacattgacttcgagggttttccaagtggtagtccgacactagtttcgttgcagacaatgacggtaaaggaacattcttcatcaaaaaagaatcagacactttgccgtcagtgttcatattgttaggatctatctcaaacatcggtgggtgaggcggtggcgacacactcaaaattagtgtgtcgatccatgccacatacattatgaaccccgataacacgaacaagtttagcagtttcatggttgcgatagcttggtcctggtgctgtttgcggcaacagcaccaggacgaagcattcttatgtaatttagtgacgtgacaatgaccgggttggtgcctgcacgcctccttgtcatagatccaaaaaatgtgtacttttaaaaatcgcgccatttccaacggtcgtgacggtcaacggtacggtgtgtatcgtaagtgaccggccgtatgaccttgaacgaccttgagtgatggtaacctgtcatttatgatttatgggattcatgtgaagggctttacggagacgcaagtaaaaaaaaccacaaacactgaggcttatgattaatagcttatttcgctgtttttattaggagcactcagacaacaggttgttcagggaaagtggacgaaaagtactcgggataccatttgtcagcagtgagaggcacaatagccatcatcagcaccaacacctgatccacgtagagcaggagcgcagcccgaatagcgtggcggtcaaacaacgaccgagggttataacacagcaccatcaagatgtcgtggagcagagctagtgtaatcaggtccacaatgacagcagtgagcaccgctatccatttctgagcgggcgtccatgactgatagtacacgatcgcgcagaaaagtggcagggcgagaaccaggcaggcaacaacaagccgtccgcgtgggcgggtggaggccagaacacaggcaaacacggtgcagctgagttccaacaccagggaaaacacataagcctgccacagtacggtgcgttccaaacacatactccaaatcaccaacgcccatgtgttcaaggcagtgtagaccacagcagcgggccatacgctgaggcggtaggttgtctttctacgaaggttgaaacgcagaacagtgggaacgatcatcatccagataggcagtgtgtcttttaggtaaggtgtctggattcgccaagaactcatgatgcacaaaagacatagtcccatggtgatggccagctggatggccatggccgtgtacactctgaccagccacacgaaacgccgcatccatcgcatgacttcttccacatcgtcgttgtcctgatggcgagcggtcgtctgatagcccatgctccccgagcttctgaggcacatcgcatgtgcgagccgggtcttatagactagcttcagtttttacatctttttagtgttctaggttttaacctgggcattattccagctaaaagaactgaaaacgcgattgaaaggtacatgccaaatattagggattagcatgagaaacgtgacctggaataacgcgtagtatgacacatacaaagtcagtgacccctgtattatctgcttctcccacaagtgtttgcgatgtcgttgcgtcatccagaaaaacagtatcatgaaaagatccagaaacacagtgtaagtgctcaacatgatgtgtgtgaccgtggtcgggttggaggccgcaatcgcaagcaatgccactaaactggatgctcctaaggtcagaatcatagcgtagcgacgaacaggtcgatcgtatctgttctcatcaaagttgtcaaaaaacgcggcagtggttgtcagtgtgaagagtgctacggagatgacgtgagcggccaaggctttagagacttcgccgcagaacccgaagacagtgatgctgagcgtaacccagacaacatatacggtcatggtaaacaggtcgctgggttgtctttcccatcggatgattaagcaggccagacagatgactggcagtagtatggccagaatgggagccgggtcgttttgacacgtgttatgccactgagggtagctgaaccagatgtagagagtgaaaacagcagtgacagtgaactcgaagatgaaatagctatacacctgcacgaggatcttaaaccgctgtatccaggcggtgctttcgttaaaccgaacttggaatcgaaaggattccatgatcctcagatctgaagtcgtctatcccccacaggtacatgagagttcagagaataagatggaaagacagtctgaagcgatgttaaacagataatagtctgattttcgtgaatcatccataaacagaagagggcgagcaaaatgtcctgttgaaactgccattccaaagttggctcacacccgttaacattttgtgaggatctagagtccacaggctcggtgtcagaagatacacgtacatatagtacatgacaataagtatgtccacatacactatgcaggcggagaccacgtgtttcatggttagattgaactttgtgatatagatgttttcccagatgataattcccatgctgccatgtagaatgattgacagcccattccgcatgaccgagtggcttagctgtccgaagtaaaacaggagcaacagaaaagtgctcacgagggtcgcaacgtatcgacattttgaaggtaatggtcgcgaagaccatagagctaagccgctgcaggttaggaaaaaggttgccgtgaacagcagactcagaccggctgtgattccatcggtgcaaaagctgatgagggtggatcctatacaggcaaatacaacgatgtacaataacccattgcccatatgaatcatgtcgtcttgtcgatggtcaaacatattccacacaaacatcagcagcacggggacgataatcaggataaacgccggctccattctgcaaatttcggtattaaaaaccatgcagtggaattgcgatttgaaggctccgtaggaacagatacagacggctatcacgaaaagcaagcacaggtagacgctggcgagtggaaggtgttgccgcagccagctaagcgatgatcgctcgtctagatcgagctggatcataggagcgggtgggcgatggaccgtgaagggttgcaagcgaggtgcgaaaggcatgctgacagtgctgtgaccttgacagtcttatcgcaaccaggtgtttcgaaacgtctcgcagagaatttaaagagtatggcgtggcgtgcatagtgtctggcgaagcaaacgtcataaaggtacgcgtggatcacgatttcggaacgtgagccgagagcgtagatgatcgaaaaacgctaaacatgttgtgaacgttggcggaccagatgtccttggtccaacagaaaatggaaacctgataaagcacgatgaacagggtgtacagctgcaaagagctgcttttaattcgttcgggtcgcctgtgaacgagataaaactgggtagggatgaggagaacaaaacctagactgaatattgcataaccggtagcacgcaagatgatactgagatttttagaaaacagtgcgatgagggaaaaagcaaccgcgaaagaagttatgaaacacccagctagaggtctgatccagtggagacaaatacccgggattccgtaggtacaaaataacaacagactcagaacaaaagtttgccaaatggtatggtcgtttgtacaaagatgaaacacactggtggacaaacaagttaaagtaacactgtagatccaggagctggtttgatcgacagattcttctaaaaggtgagacaccatgaacaaaactacaggaatcaagaacaaaacggaaggagcaggatctacgcgacaattagtggcgttgttatacaacatggggaacgtgaagcgcgcgaggccatacacgagaacggtggcaacgacggccaaggtaaagcagccgtagattttgaagatacagttcgtccgctgtagccaagagatactggctacactcgagcgctccatgtccacactcctcatcctcggaatggtagataagagtcagctttgcgagttacccgtggttacttatacgcctccactgccgcatccttacggcgtaacatgtgctgtgttagctgagtattgattgaagtaagctatgagtgagctgaacatgccgtcccatcgagcagaccagagacccggagtgaggagcagtacgttagcctcgtacagtagcacccaattgacataaagcatgatagaaggccacctgatttcatctacggggtgcttatgtcgaatggctacggtttccatgtaaacgtctatggaggtcaacactaaaaacaagaaatacatagtaataaacagcatatgggagggtgctaaatgtccaaaggaataaatgaggctcatggtgaataagacggtcatgctaaacagcatggctagcattttgcgccgatacatctgcatgttgtcaaacacagccgcggcgctctgcaggatgaacatgagcgcggtcagcaagaaactctgaaacgccgtccagtcgtcggtacaggtgctaaccaacagacatgacactgtcatgtaatagagttcccagaataaaccatctatagtgtgggcaatgcgctttggggtattttctacgataagtatggcagccggaatgcacatcatgagtagaggcgcggggtccttcacacagtctacagttaggtagggcctggctgttcgatacacgccgtacatggcgacggtcacagccacttccattcccagccaggcatagacctggaaaatcatagtaaagcgcctcagccagtgcatgttgaggtgccatcggtactcgctttccatgctgttcgtgttgagacaggataggaaatgatggtaataaatgagcagatacacagtgtttatatatcaagcgttcgtttaatgaacattaaaggaggcgtgacctcataaccatgggtcctccgccttccagggaaacgaccacataatcacattgttatagtgtaccaggtgaaaaatacagtacagaagaagtgaaatactcatggctcgttcattagagcgttgctgtcgccgcacattactaagctgtagacacatggcgttcatgaatcccacagtcccaataatatacagggtttgtgctatccaccagagcgtgaccgatggttgcgttacgctatgtacaaaacaattagccgccaacgcgccggcacataacatgtcagaaagcacttgccgctcgatgaagggtttccagttgcttccatcgctcacatagatcatcaggataaacaaacaaaaggtagctatccagctctgaatgacggtccaggtggcgacgcatccgctgaaccatacgtgggaaaaggctatgtgtatgacgcagaataaggcaactccgcaattcttccaaagagagacttttcgtatgacgcggttgatgtaggattcttgaatgaagacgagcgcgggactcgtaatcataatctgtcgtacgggttcctgtgcacaggtgtcgaataggtattgttggcaccgtaccaatccgtacacgaggacggtgatggagacttgaaaagctaaccaaccataaactgaccacacgtggatgctgcgattcagccagatcacatggttggttagtttagtcaccattttcgaaaccatgggtgatagcggcggaattgactgttggacgggtttcgttctgggtgctggatggagaaaagtgttgcatccagctcgtgagcctctctagggagctctcagtagtgagaatgagaagaactagcagatagcaatagattaagtcctcgtagagacagagaccaaggacacatgtctcttggctggaagagactttagacaactgcgaagtgtcgaaaaccgtcacccccaacataaaagccaacacaatcacgtagtaaccgagtagaattttatttggtagagacaacggttgcaacgacaacgcaaccaaggtaatagtgagaatgagaaaaaagataagaccgagagtgcgccaacggcgataatgcaggtctccaagacaggctagccccgtgcaggtgacaaataagattcccgccaacagcccagaccaagtaaccagtgtaatgtcaacacacaagttagccagcaccacagccgtagccgtaactagcgtgtaaatcgttaacacggtccagctgtttgagtgctgctttttggcgtgaaggatagtaagacaggcgttgggaataagcaggctcagggctggcagaaatccagtttggcaaatgctctggggaatcttcacataaggcgcagccaaaatcatgagcccaccgatcacaaacgtacaggatacttgcagagagacagtacgatacaaatgaaggctaaaaagacaacagcggtgagacagcttcaaagactggttttgtattcgagtctttttgataagtcgcatgacttgatggcctgtcatggtgatgatggctaagacttgtatcggcaagtgaagataaaaaaggcaaatatatggaagttacttttatatatacaaggttctgaatttcttcctctggtccattcaaggactgttctgtagtaggaaccaagcccaagaaggttcggtgtgattcatctgttgaatcatgtttcccatccattgattaacagagaacatcatgctgatgatgttgaagagcgcgatgatagccgtatacacagccaggctgcgagcaagttcagcggcctcggtgagaatcagttcagacgatgtgggatagataattagcagcaactggtgcaccagaaggtaggagacagcactatcaggcatagataattagcagcaactggtgcaccagaaggtaggagacagcactaatcaggcacatgtacatgacggtgaagatcttgtaaatgatggccgccttggcaaaggtcaaaaagaaaacaaaacataacatgcaccatccgtagaccacgaaaaacattctccagcgcacggcattacggccggcatagaacacaatggaattgcagagcacgatcaccactgcagtcagagacaagcccaaaccgagattttggcgcgggcaacaaaaacctgtcataacgcacgtgcctgtctcaatcagcatgcacatgaatgtggcggagcccgagcgattgatgagttctttttggtaacagcatgccaacccgaggcaaagaatagggatcagcatggcgcccgtgggcactgcacagagcaggcatagttctgtcacgctgggaaagctgaaccaaaaaagcgcacacacgcttaacgtggcggtcacttcaaacaaagtattgctgtacaccgacacaatactgcgaaacttgtctatccattccaataagttctggtgcatccagctttcggccaattcgctatccaaaggctcctggaggctcatggtgcgaagctcttgtttgtggctttctgctcttcaaaccccgaggtgttgagcgctctaaataaaacctcggcaaacagtctatcttatgcgaacgccgggcttcggagttgacgtcattaattgagattaacctccgcggcccaccaccgtcctaggctgaaatccaagtcaaagggagatgatgcagtgttacgccaaaaatcaggatcgacgataagaaggccgataatatacatgatgagggtttctacgtagatgcgaatgatgagaaccaaagtcgcatcttcgaagagctcctgcttgccaataatagtcatgtcgtgtatggacaatccgataacgaacgttaggagaagcgcgatatagccgccgacccaaagagtgtccgaagcaggaagcgcgattaatgccagcaccatgagtgcactgttcattagcatgacggggaaaaaccatcgatgaagacggctaacccccattcgtaaacgggtaaaacaaatgagccccaagttgaacatcataataattaatggaagcagactggccatgaaaatggcttgaaaagaacggcaagtggccatcataatgagagccgttgcgtttggaaacatgtatatcacaatgaataccagctgatgcatacaacgacactgtccccaaacatgtaatatgaaaagagataacatgggcacaaaaagagaaagtatagagtagcgaggtatgatgttacagaactcacgaaatgaactcggagaaactatccaaatgatcagactaacgatgacagtggaagccagttgtaatacaatagccatgcaaacttgcatccagaacataatgcgcctcccgagaaggcgtaattcgtcctccatgtcggtttcgttattgaagactgcacccatgaatggattgtttctttattaagtttacacaagaagctagcgactttttgtagctggggattaagtgagggtgctatttttggcgtgctccacccacttaggcatggacatcataaagataatcaccaggaagatggctatggtatctacatacaagcggatacccccccggatacaatacatgaacgaagattggtaaatcacaacatatgtgtcatatgccaagatgaaggcaaagaaactgatggaaaaagctgagatggaattggtgagcttcgtgtgccacggcgcggactgaaaggccgtagatgtcaaaaacaaggccaagacgatgatgtacatgccgatgatccatttccagcgaccgtaattcaatcccgcgatgaacgtgagtccggtgaaagcgatgaaagtagccacgctcatgatgtaggcggtgacgatgacatagccttccgaacatatgttgaacaagatggtgggcaccaggttcacacagatgtagaagaaaagcacggttagattactgggatggcgcgcgcccagaaggtagctggtaaccatgcaagtcagcggcaccaacaaagtcaacacggtgctgtggttgttaacgcacaagttctggttttgcggatagcctagccaaattaagctggcaatcgcgaaagtgcaggtcaaggcaaaggtgtaaacgccgtagacacgcagccacacgacgaagttcttaaaccacacaacggcttcttcaggcgttaccatcaagggggaactgtcggaaggagcgctttccatgttgttctcggcgttctcctgctcaaccatttcgcttgttgacaaagacaacgtctagccgctacttgctaggcgatctaactcttatacacaacgcgtgagacttcctgggagttgggcgtggacacgaagtagagcaaagtgacaaacagatacatcaaatccatgtaaagacaaagcgcagctggaatgtaactctcgtattcgatacgatgtagagtgtcttgtgtgtcacagatcactgaagcgacaatgaccgccaggccgccaaacattaccaccatctcaccgacctcgtcaggaaaatagtagaagatggatgcgagaatgatgatcagggcactggacgccgtgaccagtggtcgataaaactcaacatcgcgagcgaagcgatatgtcgaaatgctcaaaacgataaacagtaacacggtactcagcatagcatagacggcggatcggtttccgaattgaaagccagaggtggtaacggctacggccgtgagtaatgtgtaaatgagtgacacgaagaggtttttaggaaattggggctcagcccaatttagaatacccagacagataacggacagcatcaggcagaacagcatcatgcgcatattacacacaacgtgttcgaggcggtcgggaagcaccagccaacagagcgcacagatgcttagaaatagaagactttgaaaccataataaaatgtaaactcgtaacagaaacacagaacgaacgacccggacctcgtccgacaattgcatgatgttgactcagctttcacaagtgatacgtgtgtctaaatatgtaatgtgtttcccaccactgcatggagaaatgacacggtacaccggaattagataattgaatacaaatgcattgtttaatcaaagcagtgaatattagcattcaaggggtcataaatgctaaccctttccagggaacaatgccactttttcatatgtttagctcgtcgtgcacgccgcagtaacaattctctttcattggtaaccggctcttcgttttgccattccttttggattatggccataatgtctgggggtggtggatcatgggtatctgaggacagagatgactcactctcatcatcataagaatcaacactgccgtttgtttcttgtgaaacaatgacaacaggctgatgctgaggggtttcttctgactggttatcatcatcttcctcctcttctgtgtagtcatcgctttcaccctcgaactttacggttctgggagaaaaacctctgtctacacgaaacatcacagtaccatcagacgttttctccgttaactcatcattttcttgccacgcaccgctttggggcccttgtagaaccgtgacactgctccacggaaagcaccaattctgattctcttgcaatactccggtaggcatcaaatcactacgtccccaacaacaactggtaggtattttatcatgagcgcgattactgcgcgtgagccagtcgtacgcaccacagagctgctcggcggtaactgtgttgaccatagagcaccaagagagatcttgcttacgggcaccgtgatagcagtagcactcactctccagacgagcctcgccacgcaatccgcggtcaaatcgcgtaatgccacggagcttaagaaagccgcatctgaacaacatttggatgttatcggctagacgaaacacgtcgctttcgtcgattctcagcacataacacacgccgcactcgtccaacagaattattccacaggtcagcaaaattccaaaattagcgtaacggccagtaacaccaagtacgtaccatcggcaacacatgcgttgattaatatactttatgagattactaaagttatcagctctcattttagcaaagggatacatttgacgtagcttctccacagtacccagaaggagcaagggatcggcctccgatcgcccaggggttttcactactacgttaacgccatgaaactcttctgcggtcttagctagaccacgtgcgtctgtcggatcgagacacaacaatttctcgacttgaaaacgaggctcggtggtggagaagggcgtttgcggatggcgatataccgattcacatgtcagtaaaccgtggtgcgcgagttctttgagtgaggtacctatctgaaagagtccgtcactgtcccagtcatacacgtacacaaatccatagcttcccagcagaaccacacacgtagtctcctggatttttttgcgatcactgccatcacgcaactgcacccccaatattcccagtgcttccaatttctctttgcagcaaagatactcgtcgaacgaacgggtttctacctggggaatatctataccagagcgaaggacgagaaaccagctacaggggttgcgcaacggaatgatagtaccagaattctttttaatatattctcgtaaacacggttgatcgtattgtcgcagataaacaccctgtaacatagtcagacaacgttggaacacgagattacgcaaactgaagacgccgtagtcgcagcgtatcacgtcctcgggacgctcatctcgctgcttcagatatgtaccccaggcttcagcggcacttctggaaagcagtgtcatatctaccttcgaaaagactcacaaagtgttcagcgacaacctcaatcgggcagtttaaatcgatatgaatgaatgagtctcgatcagagcttaatatacaagcgcctcagggctgcccggatgactgacagatgacgtgaacgcgccgaacaattcctttattggaagaatgcccgcagatcaaaactgttaatccagtcaggcgatagatcacgattcagatgcactctacgggcctccacctcgggttctgtcacatcaacctcggtgtgataagcgtccagcaacttttgaccgagacgccagcggtccgcctgagcggcttgtctttcagcgtgccacgcgtcaatatctttcagatcgtacatgctgtcttcatcgaggtcaaaaccaagatcctcccagtcgtcatcttcctcttcgtcttcttccatctgaaaaccctcgttatcacgacctatgacctcaatatcgtcctcgtgcacgtcgtcaaagtcgtcctgcattcgagggatgggtggaggcggaggcgcttgaagcgcgggagctggcagcgcgggcacctggaacgcgggcgcctcgggcggttgtggcgcgggcacttcttgttgtgcaacagcagcagccgccacctcctccgctggcacttgttcatgctgttgctgctgcggaggcggaggcgacggctgtggctgctgttgaggcggggagggtggtggcggcggaggtggtggtggaggcaaatcctcagggttgaagagagctcggcgacggcgaggaggagcaccttcgtcacgattttcatgtggacgacggcgatctacaaagtctccacgaagtacacgcgtgtgccagatagtgaacgcatcccagccgtcccacgtagtaatcatgtctgcccgaaaacggtccgggcgacacaaccagcgatactgacgaacgaaatcccgggagactccatgatcgaaagcggtaaagtgtagacgataggtttcatctaggtgaatgcaacgcaccccgcgttccaagcgtgctatagtgcgaagatggtgctcatgccggcgccgcacatacaatttcattaagcctcctttgaaaaactccgaaagggtgtcagccactcgatacacgttccccggggccagacatacatgagatgtgcgatctgtgtacggtcgaacaatgaccgtgtagatgcgtccgaatcggtcaaaaataactacactgctgacctcaaaaaaacctcccagacgataggtacccacggcacccataatgtaccagcgacagcgtagtctcagactcaggtacatttgacattctgccaaatggtaggggtcgatggcctcgaaaggccacaaatcactcagacaaccaaaattggccagtagctttagtgtatcagcgtgacgcccgggagtgtgaagattgacatctcgattgtggtacgcgcccacgcactgcgctagggaatcggcgtcatgagcctgagttaacatagcagaaactacatcatgaggcacacgagtggcatagggtgtgtaaaactgcctgtaaacacattcggcatgcaaaagcccgtagcgcgccaactcgtccaggtgctcagccgccaggatcagaatgtcctgactgggttcataaatgtacatctttgtatctgatgccatgcacatgataagctcggtttccacaaaacgatcctgcacccacatgatacatttgccgatcactgccattcgctcgcgacaacaggtaatgtcgtccagcaactgatcacgtagttcaggcatgtggctgcccggcctcacatgtacaaaccagttacagggtataccgaggcacaacacatgatcaatacgctcgcgcacccaaacacgaaccgagtcaatgttcgcctgtcggagaaacaggtccttgaaatcagccatcacgcgaagatacgtatcgtatctagcgtgacagtaagggaaatcgtccgggcgagtgaagctcggagctccatcttcccatcgggtgcgccacatgatgataacggtccggcgtttgttcagattgggacaaattctctagatcctgtcaagctcttaaaagggaaaggatctgtgtacgtcacaagccgtgactgatacaccagagcagccagaacgcgttcagtcgttctttcccgcgtagatgatttcgtagtcaccagacaatggagtctagggccggtatcttcctgatggctcgccgcttcgcgctctgccgcttccactccgacaatgtccgattcgagcacgtatgtctgctgaaccgtatcgtagcggtgtagaaccagaacattagggtctagcctctcccaagccccctggcgagggtcaaaacgctccgttaaacagagccagtcgtaatgctgctgtacgaagcgctgacgacgctcttcgcgctcgaagggagctagaagttcgtgccgacgatccatttcacgctcctcaacgtgagggcagatgcactgatgttccatgcgaatttttcgctggcgctcaggctcgaaacggcggtagccgaacaccagtttcaaaagccccatgcgaaaaaattcagtgagggtgttggctacacgccgcagattgtggttgggctcatcgagctggatggcgtacaccgctccgaaccaatccaacaccaccatgacctcggccacgaacgagcgcccaagacgcggacggcctgttactcccaggagataccagggagtagccagattagctctaatcccccaccaccagcgtttagcttcagtttccgtgaggctgctaaagggccaaacggtgcgcagctccgtaacggtcttcatgagccgcataatcaccgttccgtaaccgggagtgtgaagtttgacatcatgatcaacgattcgatctgccgtcacgtaaaagctgtccggagtagtttcattaagaaacaaaatgtgcatagtgcgtatggagcgcggaccggaacggatgagggtcggagacaagcggcggagctggttgtgaacactgtcacgatagataaactccgatcgcagcacaccatatttggctagctcttccaaatgatgggctactagaaccatgtagttttcacgagggtcgaaagcatagatgcggcagaaacgacccatgcagataacgaaatcagtttgcagatagtcccgatcattatccctgtgcggttcaggtatgagcttgagagcgtaacctaacgcacacagcggttcgttacagcagatcagtttgcgggctgcatgttgagcttgtacgagctgctggtcgcgttgaagttccacataccacccctgaggaggtcccaggcaaagacggcgaccccggtatctccacacatagtgctcgatctggggcgcgtccaaacaaaagaacaggtccctaaaatcaatcaacacctgccgatagaactgcaattcatccaccgggcgatctgaaaactcggccatggtgacacaacgatgataactcacctcggtctgttaaccgatctagcgtttggaccgataatttaaaatctcggtccgagctgccgagcggttcaccgaccaggcttgagactctcgacactctcgcgtgcggtccaagaccatgatggttcactcgtccagcctcgtggatatatagcgacgctagagacaatcattctttcctaagaaccaatgagaccacaacgcattcacagtccacaaaaacattataaaaattttttttattgaagcacacaaagattcgtttttattccgaacgcgaacatatacacatccaaaacggtttcatgctttatttacaaaaagtatttttgtttattacagccaaggtggcaaatacgaacccggtcggggtacggctggacgagggtatgggcatccttctaagatggcagccttagccgctctgtgaatcaacacttgagtataataatcgcaggtgacatcttcgccgccatcttcgtcccctccctcctcgctactactgtctgtatgcggacgggcatctgtttccacagatctggaaggtgatgaaagagatgcggcctgtgcgcgcgctcctcccccatcaatctctaacagatcatcgtcatcagattctggtacctgaggctttttgtacagcatagcgggtttggcatcattcgacgcagatgcagattcaggttcagaggcatgtccttcggcagacatactttgtctgaggtttacaatagctcgttctaataccgggttcatttgattccatatggaataacaccgaacaccctgtttcacttctttagaatgtacataatctgagagacggcgccaaaagttgtgagcggcctccacctcggtggcttggggaaagtcgcagcgcacatgaggctcccagctaccgtcggccgctccggacacttcatggtgactgttacgagagtaacagccaccagggttgaggcggcaaaaacggtcacgccgaacaagccactgaaatcgtgtctcctgatgcttatggcccattcccctatccatgtacagatagcggtcccaaaactgataggttcgatgaggacaatgcggaggcatctccaacctctcggcatcggagagagccaagctgaaacgccggccggcctgatagattttcaacaaccccatggtaagaagggagtctatgtcatcggccagacgccacacatcgcgccgataaacatcgaaatagaacagctcgccgaacgcgtccatgagaatcacccattcagcatgaaaaactcccgagggcaaaacctcacccaccacaccaaagatcaaaaccccacaacaaagacggtctttaaaaaactgcataagcttctcgaacatcaagttgtccatacacaaaaaaggccaacatgatttcaagtcgtcggcttccgcacagattaacatgggacgagtcatctctcctggggtacgcagcggtatgcattgaccgcgataacgcgccatggcacgctgtagctgacataaagaataatcgttcattcgcagatgggaaatcacgtcatcaggctgggtagtcaacatgggcatacgaaacttgcccgaatagatgctctcacagtgaagcagtccatgacgcgcgaaatcatccaacccgctggccaaaaagtagagcacattctggtctcggtccaaaacccaaagactttcataccgccccatcagcactacacgcttgctcttgctgggcggtagaaggtcatccacatacagacagctgtcatcacagtattcgtcctcggagtcctcgtccgacgaatcgccatcatcttcattgcggcggcccggccagtactgcagaacgcccaacacttccaaaggctcttcgcaacaaattaatttactccagggagagccaggcccctggcacggcgtgtcttccccaaaaacactgggaaaagtggcaaataccatccgccaaccaggtggagcagaaataggcacactcacgcggcattctgccttcagtgataccagaatgcgcagagaactttgagactcctgatgactaaacagatctttcaatgctcccagtgtccgcctaacggcgggccccgaggcgtaacgataggattggcgtaacatcctgatgtgcccgggcacatcaacccttcacgggctttattgcccttcatgtcatgacgtcgtacctgtgtgccagactgacggcttattagttatggtcgctatcctgcgaaacccgctcagttgctcgcaagccacccgccagaacgtcggaaaaacctcgcccgcaacatgaattcgagccagcacaacataagcgtgtttctctccattggagcagggcccgtcattaccggatacacgtgcgtttttctgttcgggattctgggacacttttacttgtattggaaaaaccatcagagacgacaccggacaaacagtttcagtgatgttttatttcgacatctcatgatcaccgaagaggtctttaccctcaccattcccgtctgggcgtatcacttaactactcacggcaacttaccgggctcgtggtgccgaagtctcaccttcgttttttatctaacggtattcgctcgtgccttcttttacctgctcctcatctgggaccgatacagcgtaatcatctgcagacaccctctccccgttaatctgaactacagtcaggtcataggcctgtctgtctggctggttgccgtactgtcagcatcaccgttctccatttttaacggaagtgtgaaacaatgcctgggcaacatgggcagcatacccagcgaatcgtctgccgttcttaacctggaagtgcacctgtgctccttctggttaccgctcatcatgtcggctaactgttactaccaagcaaaacgccgagcatcgcctgaccaactccacgaactttaccgatgcagtttgctaattaccattatcacaacttacgctatcgtatggtttcctttccatctcgctttactcatagacgccctgattagcataagccatgtagaaccctctagcgctctccactgggcatccattgtcgttacctgtaaatcatttacatttgtatatgcgggcataagcccactagtgtatttcacatgctgccccaccgtacgtcgcgaactgctgatgtctctacgtccattcttcacctggatttccagcaaaacgcggcgaggctacgctccgattaaaacacaacctttaaacatccccgacgagccgatagataacaagtcaccgcacctgttaaacgaataaaaaataaagaataaaacatactcagcactctgtcttagtcgcgtatacatttctcactcaaacgtcgataaaaacgctcactcaaacattatataaagtgaccgcgccactttttccagtgacgtggttacatttggcaatgtcacgctgttatattccacatcccaaagcttgtgctaggcatcatacaactcacagacaacccaactgattgttatctagttaacgaaatctgcggaactaggtaagtgcaaataacccaacagcttctcaacaaaacaggagggttaatcaagtaacgtaacgtcgattatttatccgctgctacatgttttaacagccgtcatgaccaacactaacaatacgacttgtcatctcaacggaactttcgaaacttttaaaatcacccgtccagtagccatcagcgcctacactgtactcgtggttatcggacttttgggaaacattgtgctgctcagcgtgctcgtcgtgaaacgcaagctcaagtttccgaatgacatttactttttcaacgcgtctttggcagacgtttttgccgtctgcatgttgcccgcctgggttaactatgcactggactccacacaacttagcaagttctcatgtatcacttttacgtttggtttttacgtctccctgttcatccaggcctggatgctcattctggtcaccctggagcgatacggatctctagtctggatcgccccgatcaccagaaacaaagccatagcgaattgtgtactcttttggcttgtttccatcttcttggccgcaccttactactcttttagaaacgaaagcaacgaacaccaatgcatcatgagaaactatacctggagcgttggtgaaacatggcacatagccctggatttcttaattacgctcattacatttatcatgccagtgactattgtgttagctctgagtttcaaaatggccagatggtcaacctttggttacagaaacctcaccagcagaaccagtcttatccttattttgatactgacagtagcagcagggttctggggaccttttcacctatttatgtttatagaaaacgtggcagggcagatttaccacattcaaaaggattgctggtacttacagctcagacacttgtgtagcttgatgaccgaaaccctagtgtttctacgttcagtttttaacccttatatttatatgataatcagttacaagtttaggcagcaggtgcgcagtctactcaagcgtactcagtatgatgctttggacacgactcagttagcagaaactatgcagctgaaagcgaaaggtgtgccggtgtccgaccccgcgccgcatgactgcgaatgctttttgtaaattatcaaacgtgtaaaaacaataaaagttcatttggctcacaaaagactcggtttcctgtggagcatatgcgatgacagaaaataaccggcgaacgattagcacacggccggcagcaaacacgacagcttcaacatgaccaacgccggacactgtcacataaacgaaagtctcgcgtcgtatggaatcgctcccgcagctaccattaccttatacagcattgcgggaatctgcggtgtcacgggaaatctgttaatacttttggttttgttcacgagacgcatacactggttcgcaaatgacatctactatctcaacatgatctttacagactttcttgttttcattacattacccgcctgggtttactacctacctgctgaattacacacaactctcacactatgcctgcattgctctatcatttgttttttacgtttccatttttattcaagtttatggtagcagtggctatcgagcgttatcgaagcctagtgaaaaacaaaccccttagcgtaaaaaaagccagcgtcagctgcgcgtgcatctggatcattgttattatagtgtcttcaccatactacatgtttagatcgcaacacgaaacaaattcttgcattctaggaaactacacctggcatatgaacagtccttttcgcaccacaatggacgcatccattaacatttggtcttttgtcgttccggccgtgacgaccttgttaatagccagacgaatttatgtatgtacttcaggcaacaaaaaaatgaacgccagagccagtggtttgttagaggccatggtgattagcatgttattcttcggaggacttttcaacctgaacatctttcgagacatagtttcggacacatcggaagacaataaagactgcacatatcttaagcaggaacactttattcgcatggtcggtgtggccctcgtttacgggcgcgctatattcaacccttttatgtatatgtgtgtgagtaccagattgcgccaagaaataaaatgtttgtttatgcgaataccttatgaaacactagatgcagaacacgctaaactcatggttaatttaaaaaacagaaatgctaatgtacccgatcctaaacctcgtgaatatgaatctgtgttatagaaaaaagcagactgcaatctatgtttaaaagtcatccgaatccacggaaatgcttgatagtcgccattcaagatgaataacacatcttgcaacttcaacgtcactctcaacgcatcggcaccaagccgatacatagctattgctatgtacagcattgttatctgtatcgggttggttggaaacctgctgttatgcatcgtgttagtcaagaaacgcaaactgcgatattccagcgatgtttattttttccacgcctctatggccgacctcgtcagcactgtcatgctaccgctctggctacattatgtcctcaactttgcccaactctctcgaggagcctgtatcagcttttcggtgactttctatgttccccttttcgttcaggcctggttactcatttccatcgctatggagcgatattccaacttagtatggatggcacccattagcgttaagacggcctttaaacactgcataggaacctggatcgtatctgccttcgtggcatcaccctactacgcatacagaaactcacacgacgaacacgaatgcattctaggaaactacacttggcacattaacgaaccgctacacacgtgtatggatgtggtgatcatagtatggacctttttggccccagtactggtaaccattatagcaagcgtcaaaatgagacgaacgacctggggcaatactaggttaaacgaaaagaacagcgacattcttatagtactagttgtcatgacagtgttcttttggggaccgtttaatatcgtgttggttattgacaatattttacagagatactatgataccacgaattgcgatgtagaaaagattaaacatatcatggctatgatctcagaagccattgtttattttcgcggtattacagcacctattatttatgtagggattagtggcagatttcgcgaagagatttactctctgtttagacgccagccgtataacgatttggaccccgatgccaatcaattcatgattgaactcactagccagggaagaagtagaaatagaaatgctagacaatcggaaagcaatgtaccgcaaccagaagaatgcttctggtaaaatgtttaaagccaataaactattttcataaaattgtacatgtggtctgtgtgtcattcttctgggcgggctcatgatgtaaataaaaagcttctcggggagactgttcagagtacaaacagccacgcattaggccgttgaaagatgactaccaccacaatgagtgctaccacgaattccagtaccacgcctcaagcaagcagcaccacgatgacaacgaagacaagcactcctggcaatacaactactggcactacgtccaccctgacaacgatatcaacaacttctaatgctaccagcataacgtctaatttaagcactaccggaaaccaaactgcaactaccaatgctactaccttcagttccacattaacaacatctacaaatataagcagtacattttcgacagtttctaccgtcgcatccaatgcaacatgtaattctacaatcacaacgaatattacaactgcttttactacagcagcaaacactaccgcaagcagcctcaccagcatcgtaacttcacttgccactaccattgaaaccacatcatttgattatgatgagtcagcagaagcttgcaacttaacagacatcgttcatactactagatcagtgacagttactttctatactatcatattcatactcggccttttgggaaactttctggttcttatgaccatcatttggaaccgtcgcatttcctttatggttgaaatatatttcgttaatctagcaatctccgatcttatgtttgtatgtactttaccattttggataatgtatcttcttgagcacgacgtcatgtcacatgcatcctgtgtagcaatgacagccattttttattgcgcgctgtttgccagcactgttttcctcttgctaattgttttagacagatgttacgctattctattaggtacagaaaaagcaaatagacgtttattgcgcaatgctgtttctggatgcatgctcatgtggggattgtgtttcattttagcattacctcattttatctttatgaagaaaggaaccaacgtatgtgtagcagagtatgaaccaggacttaacaatttctatgttatttttatcaatactgaggtgaacctatgcaccctagttttgccagccgcagccattatctactggtatcttaaactaaccaaagcactcaaaacccatgaacgactgcgtcataggctaacgtctctaaacatagtgttagctgttgtcattgtatttgctttgttttggctgccgtataatctcatgcttatgatgtatagcttagttcacatgcagataccttgggaatgcagctctgaaaaaatactgagacgaagtttaattattacagaatccatcgccctcagtcactgttgcatcaaccccattatctacttgctcttcggacctcgctgtcgaagcgagttctgtcacctgttgcgatgttgctttacgcgcttatgtccacacagatcctggagttccatacgtgcagagacggtgtccatcagtctcagtcactcacaggtatctgcatcatctgaggatgatgacaacgatgtgcatgatgaattgcaatttttaatttgaaacacaacatgttaaaggctcaataaacacatttgtcatagcttgcgtatccgtgtctcttcttggggaggtgctaggttattaaaacgagccacccgtttgcacatgcaacacaaaaaccgtgcacatggaacatatcacagccgagtgccaacatgctaacccgaccgtggtacatcgatatctggtggatcacgctgggatgcgccccggccgtgagtgtgacagttttattgacaacagccacggtcggggcacactccattgtggttcatgaagcatcgccgccaccaccaccatcatcgtcgtcgctacgcttgcctatcacatccccctcctctacacactttaacaacccgtcaaaatcatcacacatcgagcgcaccgccagcgccgtggggcctacccgacagcgaacaaacgctctcaacaggcgacgacgtcaacagcaaagaaaaccatacacctgcatcaccggcactcattggacaaccaacctagtgtttacgagctgcgaaaacacacccagtttcgttaaactcgaaggcgttcgaaagtggactttaaaaggacaacccctgggagaaacctcctactacggcgggtgctgccgcctcgcgcacggagagaatgcgtacatcattctcgctaacggttatggccctgccatccacggtcatgctctccgtgtggattatgcgactactaactgcacacaacctgcgattccgtttcccacacggctggagattacgtctacgcaggggcttcagagccggtgtggatcgaatcgcttctatttttacggtctggaatgttccacccagctggccttttccaccctcggagtggtggatgtacgccggtgtccctccgtactcgccgttcgaccccttcgacgatctgggagcttttgggatgaacaactacgaggactatccctggacattctagtctgtctggcgctagtcatgctgttgttcatggaaatcattcccggtcaggcgtttcgctatcccatagggacgtggcggcgagtctccgcatttccctccacattccgtctccaccgctgggtaaaacggaatctggcttctctattttccagtgaaaccgaacatcagaaaaagccctccgaggcggctgcgaaccgcacatggacagtgccgtttccatgttctcataccgtcctgctggccccgatcccattccgcctcaggcgcaccatgtcattcccgtctctgcaattccccacgtcatccgcccacaatgtgtcccagatcaccgacaatcccacacacggtacttatgagagccacaacctgccacctgtcactttgcccgtcactgactacatagaagtgatagcggagcatgctccgataatctatcgtcaagatgccaacgccgtacaggcgatgctgcttcaggccgctctggaacgcgatcataatcgtcagcacgatcgcaatcgctgctaacgcctgtcatatcgaggttggcgaggacgccaccgtggaacaagagtgccgacagcgaaacgtgctacttgccaccggacagctgacgccccacagccatcgaccgcacgtattggagttcactttctccaccaaggacagattagggtccgtacaacggctgcagctgcacatcaccggtttgcagctcaataacagaaccgttctcgaccaatctgtctattggcgcctgttttcgcgagccacgacggtcgagggtggggtaaagcaaaaagttaagctacgtctcatctcggaacaacatgtccccgcacgccactgtgagatcaccgttggcaaagacagcgggctggacgagacagagccctggggcctgttaaacgtcctcagctattttgtctggtgggtcgctatgtgcctgttagcaatagacatcattatcaacgcctaccagtggattcacaagatcaacagcaaaaaccgcacagcggtctcggtgcgggctgagatcctgcgcaacgagcgagaaatgttttggaaaaggcgacgagcgcgacacggcggcatttcggagtcgcccgtctccagcgttccgcctcgctatgcctgcaacgagccctggtccctgccgagcaccgcagccgccacggcgagcaaccagtcagcagcagcgacccctgcatcacccacacccccagaatattcctcatcatctgtatttcctccctttccccaataaagagagttgtgcattatcgaggtggtctttgtcccttgtttcgggtcactgcctttagggtccggaacgggagacatggagaaggaggaaacctggcggggtctcatggtgtactcgcatagcctgtggtgtatctgcggacactggaaggcgcacattatcatgagcgacgaggccaactcagaagaggtggcctgcagcaactggatggaggacgcgaccatgcgctggatacgcaatgctcgcgaaacccacgacaagtggtgtcgctgcaccgactggaggggacatgccctcagtctggacgaaaatcgaatttctctggttaccctgcccgcggcaatggagaccaagagcagcacatccagacacaacagcaggctgtcgtgtttcactcgcgtgttcaaaagttttcgaaaaaaagggcgctgcggtcgcgggtcaggcacggctagcaacagcagtggtgccagcaccatcagtagtcacagctggcaatggtaccgcgtaacgccaccaacgcctcgacaagcggaatgtcaacgcgctccccatccgtaatcaagacgacccgtgtgtcgataaaaaagagaacgcgtgtacagggcttcattgtaaccgtgtcgcttcttgccaataaccaagtgcactgaaacacatgcatagccaaagcgctttgaaacaatcatgaacagaccgcgggatctcatccccacgcttcatgactcgtgcacccaaaccgaactcagatggcgaagggttttaaccgagtctcatgccctgtggtgcaactgcggggactggacaccacatgtagagtgcgtagacgacgcgtatttccaactgcggtggcgcagtcgccaagagcgcaccgccctgcgctggcgcaggcaaatgcacaggttgcacaacctctggtgcatgtgcggaaactggcgggaacacgcgctgtaccgccggggacgcttgactgactcgtcatccggatcgtcagcgtcgtcatcgggtgaatcagccgaaaacacattcgtgtggtggaaatgcttgcgcaagtggaacattctatggcgacacagctatgacttctttgatattcccgtgccgcctgagtctgagcgtgaaacgcctgcgtactcggactcaggatcggagggaacgccatgtacaagcataatagagacacacaggccacaagattgtcccatcgtcatggatgtacgtccatggtaccgagaaaccgctgtgtaacctcgtcacgaagttgtgcaagcatgtgggagggtgactgtgacatcagttggaagggtgtataaagcatgtaaccccaagggactgcagaggcgactcacttgagtgacacttggctcggtgccgttgtgcatgtggcacgcgatcactgtacacacaccaagtggtgtcgctagcgcggctcgcgctgtaaacaacgcactgtcagaccttgtctgtcgtatctctatgctgtgtgctcggcgccgacggcgggctgtgactcaggagacagcaacggccggatcatctgaggccagacaggctgaacagaagcaggagcagccacagacaagctcttcaacctcgttcctgggtcgcgctctggtcctcgtcggtcaacagctcctggcggcaaaccaggcagcatgccctccgcccgcttggctgtggaaataagaacaaacgccacctagcagattctgccaacaaacaaacagcatgtgctccacgtcctacattcgtatgggcatttgggtcacattggtgattatcatgactattgtgtttttataaacgacgttatgtaacccaataaactacgcatacgctcatagtgtctgtctatgcatgtttattcaagctcgagagcagacatagaaaaccaaacagtgtatgagtataaaaacagaaaatttacatattatatcttagcagcttttgcgtctgagaactggggagaatccaggtagtatgtccaagtagcagggattcccgaatccgcgtgtgttggtatcgccaaagtggttgtcatggaatgtgcttttcatggcttgccagtaggcttccatcgttcggggtgcttctgcaggagggggacaaggtgtgtcggtggtcagttctcggtgaagatagttagcggaggtgtcccaacacgattgaagcatgtcgtcgacggtgctagttggcgccggaggtttctgtccctgcgccttgtttgtgcatgatgaccgtctacagcagaacgtagagaggaaggcattccaaccacggcggaggattctgtggaattttgtgagcgctcccatgtccgttagaaatagcaatcaagcaagcaccactgccaatgggaaaagattggaatgaagtgtggacaagtgtgtgggcttgtagttatagtctctagcacgggacgatgagaacaccatcgctggaatacttgggaaagacggaagggtcacggtcacggggctgaatgggtaaaggtcgtcggaacggacgattggcgcgagcgcgatggttgcagatgcggcgttgcatgaccgtattaggtccgcgtacgctttggggatcccaatggggattgtagtcgccggccgcccaggtgcggtacggcaaaagagtaaaggagtcgtcttcgccaggatcttcgtcttcctcgggaccgctgggaagtttccaataacgcaaatcaaagcgcagtgcgcgcgacacaagcgcttggtcactctgcggaatgggttcctgaccggcttctgctggcagagcaagagcttgggcatcgcgaacgcgccagccgtcctcgtctcttgattgacaggtggacgtgtcagtatctaaccgccatctccccggccgtgttaaaaatgcaaattgactggccaaatcacgggggccaccagagggacgtggccacagatacaaagcatctggtcgcgggcgttcccaaacataagggtcctgatcgggcagcaggcgaacagctgcctgatcaggactggcggctgcgtagcccgcagtgagagcagctaacaggccgacacgtaaaaagtgtgataagtcctcagccagggggtataccagtccatcgtacgtacagtaaccatacacaactccgagttcgtcaatgataataagcatgacagccaaagggtttttttccaataaacgaccatcgtcgtcaacctccgcacgctcatcagactttcgttcagcgtggcatttggggctgtgagtgacagttgcagcagcagcggcggcggcaggacctggcgtggccgcgggtggaacgtccgaggcgggcgcgttgtggcgtgaatgtttgtttggtttcggtcggcgttttaccgtgctgccttgataggcggcgagccgagtgtgttcccgactggggttgcgggagcgtgtgtcaaaccagttggcgcgagcagcagcccactcgctcagatattccagccacggatgtgtagtaacgatacccagtaagtgaaatgcgcagcacaggcgctcggaaataaagttacggacggctgcgacgatggaaccagcgtgtggccatttacagaaaggtagccaacgctccacttcttcccaacatgtagttaacaggcacggttgtggaggacggcccggagtttgcaagcaaatggtttggccagctgcagtgtgaccgatagctgccgcagctgcggctgcgttgggccacgtacgagacaggagttccacaggttcgggagggtggacggtgagaggagggagggttgggcatgcatacacgcgggggaggtctccaatgccgtggcgaaagaagtcatcggcatcggtagccgcgaggtgtaaagtgtgacgagggagatcaaaaagaaacactcgaaagtggcacccaatggcgagaaagaggccttcatgacggcacagggtaggcgggtcttgtggagagggactcatttcatggaccaaggtggcgacaaggacaatccagtcgtctgtgggtgaaagttgccgtagatcagtggcgccaacgtcgcgcatgtgagagcgtggagtgacaacggcataaaagttggcagggcggcccagtggtaggagttggccagtttggcgttggcaccatttgcgagtagcgcgagcagtagtgttagcaatgaaggcatcggcccaagcggtagccatgaggaggaattcatctttagtgagagcatgctgctgtggtggaatggatgcgaggcgagttcgtgtgtcgagagaagggagagttagcgtggtgggagctccgggagcatgtgtgggaggatgcattgcagaggtcggctgatgcggaggcgtaggcaaggcatgcatgaggctggacatgtggtgtagcggcgagggttgatgagggcgccagtgagttggaggagcaggcaggcggtgagagtgaggatcggggctggtgcggagacctgcgtagcggagatgctgccaggagtgtggcgagcggtgaggacgcatgtttaagtagcagtggagtggaggtgtggtgaggaacacggggacgagtgatgtaggcggacaaggggagagttgcagagcgagacggtgagagtttgggcgagtaaataaagtggggtgttggacaggcagcgttaggagagggggcgtgcgggagacgtacggcaggcagctttcctccccagggcgctgaatgcgggtctggcaggcactccggggtggcgcgctggcgtgaagggc

SEQ ID NO: 2 - DNA, 230287 bp, Human cytomegalovirus
gggccgcgtggtgggtcctcgaggggcgggggggtgtttttagcgggggggtgaaacttggagttgcgtgtgtggacggcgactagttgcgtgtggtgcggaggacggcgacggcgaataaaagcgacgtgcggcgcgcacggcgaaaagaagacgcgtgtctgtgtctgtgtgattccccggggaaaagaggaagttcccgggggacggcagcatgggtccctggggacacacgaaaagcaacgcccgggggcgagggacgacggccctggggaccgcgggggaaataacggccgcgaggccacacactcgttcctgcgaagccgcacaccccgaggccgcgcacaccgccgacacaccccgccaccacaccccgccggcacacccgccacacgcccgcgacacacccggcacgacacacccggcacacgcccgcgacacaccctgacacaccctgccaacacacccccgacacacccaacacacgcccgcgacacacccggcacacacccacccggccgcgccccgacacacccaaaacaccgccggtgcggggccgcgtggtgggtcctcgagggagtgttgagggccgtaagcgtgttgtgtccgacgctgcctgcgcactgccggtgcgtgtcgtcccacggtatttgttgtcggcaccgggcttcgggacggtgtttcggcgcgctgccggtgcgttccacggtccttgcctgtgtcgtttcggcgctgcgcttgtcgggggttttcgagcgttctggccgccggcgatgccggggtgttgcggagacggggggtgtgcgggacggtgttggggccggggacgggggttgcgctggggccggggctgttcgcgccgcgtaggggaggttacgttggggacggggacagtttgcggcgcggaccagggaacccacctcacctatttaacctccacccactacaacacacacatgccgcacaatcatgccagccacagacacaaacagcacccacaccacgccgcttcacccagacgcccaacacacgttacccttacaccacagcaacacacaaccgcatgtccaaacctcggacaaacacgccgacgaagaacaccgcacacagatggagctcgacgccgcagactacgctgcttgcgcacaggcccgccaacacctctacgatcaaacacaacccctactactcgcataccccaacaccaacccacaggacagcgctcattttcccacagagaatcaacatcaactcacgcatccacttcacaacattggcgagggcgcagcactcggctaccccgtcccccgcgcggaaatccgccgcggcggtggcgactgggccgacagcgcaagcgactttgacgccgactgctggtgcatgtggggacgcttcggaaccatgggccgccaacctgtcgtcaccttactgttggcgcgccaacgcgacggcctcgctgactggaacgtcgtacgctgccgcggcacaggctttcgcgcacacgattccgaggacggcgtctctgtctggcgtcagcacctggtttttttactcggaggccacggccgccgtgtacagttagaacgtccatccgcgggagaagcccaagctcgaggcctcttgccacgcatccggatcacccccatctccacatctccacgtcggaaaccgccgcaccccgccacatccaccgcatcgcaccacccacatgcttcgcctcggtcagatcacacgctttttcctgtcccatctacaccctcagccacggttcacaatccccgaaactacgccgtccaacttcacgccgaaacgacccgcacatggcgctgggcacaacgcggtgaacgtggcgcgtggatgccggccgagacatttacgtgtccaaaggataaacgtccctggtagacggggtagggggatctaccagcccagggatcgcgtctttcgccgccacgctgcttcaccgatatccaataaacccatcccctcgccacgacgtctccgcgtatctttgtagcctcaagaatccgtccccacgtccacccatcccgagcactccacacgccataacaaaccacggacacgacaaatgcatgcaaacttctcatttattgtgtctactactctgtgttgctacagggagtgaagagggtgaaggcaaagaaaaaaaaaaggaacaaaataatagattagcagaaggaataatccgtgcgaccgagcttgtgcttcttttcttataaggaggcaaatatactagggaaaacataagaataggaagaaaccgaggtttgggagaaaagctgagataaaatagcgcattttccatacagaggttgttgtttttgtggatcctaagaggtttcaagtgcgaatctcaaagttctcacgagaatattgtcttcaagtatcgacaactgtggtccaagatttttttttggtctttttaggttctgcgagggacatcacgatggatcgttgcgatgaagtcacgcgtacgcctctggtgtggcgcggtgtcgtgacaggagagtgtgttttcagtgcagagctgtcttgattcctatatccgagtatctgttttctcgtaaggacggtaatcttctttggtgtaagtacatctaaaagctgcaaactatattttaagggctgtctctaggtgtactttgatgctggagtttttcgctgtgttgatgtgaataaatctactactactattatatgcagaaagagtgattatgccgagacaagattgcattggctgaactgtttcaaaaacgcctacactctacttatccgtaaacctaaggtaatactatgtgtaagttgtttttttttctttttgtagtaaaatggtgatacgtgcaattaaaactgtattccatgtttccatcctttcatttcaactttaaaggcggctttgagagcgaagaagtgcgaggataaaaatggatgactccttcgtgtccagggagtcgactactgcaacgctgattgattaaaagatggtctccgatgatgatgttgttattgatcgaatcatggtgcagaacggcgacggagaggagcgtgtccgccgccgggaaggtggtctctttctcttttcttttttcaagaaatcttccatgtgtttatcgtagtgatcgaaatcgactgatctcgggttctttttgttggtttcttttcggttaatcatgtattgttttctttttttacagaaagatactttttttcatgagcaattcctcgcccggcgccggcatgccgaggtggggccactgcgatcagcggcatgccgacgccgacccggggatcttggattcaccgttttctctcttctctctctacatacagaccgggtggcaggagcggtaaggaatcatcgtcgtctttcattcttcgatgattatggtaatactaaatcttatctaggagcatatacatctaagattggagtactagtagtcgtttgtggtttctatttttttttatatttatctatgacagtttttctgtttttcgttttgataataatataataaaaactcatggacgtgaaatctggcttggttgtggtgatttcattctcattattgttgttttctttccgtcttgcggatgaagatgttgcgatgcggttgttgttggtgttgctatacaccgagagagatgatctttttgttcttctggttcatttcctatgattgtttggctgctgaccgacgcgtcaggatgtgcagggcatgcggggaatcaggaccggacacgggataatttcatctacctatacggagatcgcggtcctcgccatgaggatcgcgacaggcgcgtcgagggggcaggaacacccttgcggattgacattcttggtggtgtttcgttgttgtcggtagttgttgttgacgatgaggataaataaaaatgaccttgtttttgttctgttttctcttgttgggaatcgtcgactttgaattcttcgagttatcggaaagctgaggtacccaaatgtctgtagcttttttctttttaccctcttgtttatcatctgcgattcgtggtaggtaggagagggaaatgataatccgagattaaggaaaggagaagataaaaaataaaaaaaaataataaaacagaagccgaccggccgccgacccgttccccaggaccagcctacgaggaacggataacgcggtggcgacggcagcggtggtggcgctgggggtggcggcagtggtactgctgatggtagtcgggacggaggagaggcgatgcatacatacacgcgtgcatgctgcatgggtggatggtacggccgggagacgcggaagagaaactcacataaaaaggtgacaaaaagagcggttgaaaaaagaaaacaagattcgaccagacagaagagaaggaccggggcttggcgacccttccacgactgctgttgtcatctcggctcctccgtcttctcccggccacgggcggctaagtcaccgccgttctccccatccgtccgagcgccgaccgaccagccggccgattcgcccgccggggcttctggagaacgccggggcagcagcgatctggggaagctgctaaacccctgcgtttttatatggtagctctgccgagcgcgggctgacgcgttgggtaagcggaaagacgtgtgtgacgaaaaggggtcccatggtatttcacgtgacgatgaggagatacggtttggagcacatacggtttagaaaaagggagttgtcgtgacaagggctgagggacctctgtctccatgtgtgtataaaaagcaaggcacgttcataatgtaaaaaagaacacgttgtaaacaagctattgctgtatcattcggctgactatgcttcattcggactgattttcttttcctaacggcgtaacttaaagtgattaacgtatgatatttgttccccagagttatactatagtcatcatcctaaaattcagatataaatgaacacatgtcgtatgggattattaagaaaccgaaactctccacagttcaccatcttcttcgtcattcaaccgatgacccactccgtacaacgaatcagtctgctgcgtcatattgcaaagcacaagcgacgtatgcgaacaacttgaaacacaggctgttgtattgacgaccgttgtaccattattagtcaccaccgttatcccatgtttcccacccgatggaaaaccgtcttctatcatcaactgtggtaagatttcgaccctgcgaggtattcagtttcctcatatccataacctggattttatcattaaaccccaatattaaacacttttttagtaccccccacccaccaaaaaatgtgactggaccggttcctagcagctctgggagccatgttcaggttgaaccacagctacagcgaaaccgagtccagtgaccggtaaccacgtccagcccctgcgtatgtaccagtccaagcacgtccggtcattgttctacacaggaaatctaactaggtcaacgcaattttattccaccgttacgcagaatactaacaaaaaaacacacaaatttaacgaattacacgtagtttattacatgaaaactgtaagaacaccaattcactaagcgatacaacatttagctgacttccaagtgccacacatcaccactgtattcatccatgttttcaccgaaccaacgagacagatcgaagaagccagaatctcccgactttaaattacataaatccaacgtattatgaccacagctcgacacacaaatagttgcgttactattcacagtagcattacctatacccgtaacgttgcacaaccactgatcaccattgttaccaaaaacggttttccacttagttgtcaacggatctttcctatgcgtaatggtaaaattactaccagtcgtcgcttttagctcattacgagtattatccgcatccacatatatcaacgtcatagctaggcacgctataagtaccccccccccacaatggaatgttgccaaaccggttctttcccgttatagccatagcgttcccaggcaaaagcaaacgccaaacctaatgcagtgaaaagcgcttgcagccagaaccagcttatgtaccagccacaatcacatccggttattgtttccacaggaaatcctaccaggcaaagccccgcttgttttgttcctatcttgtttagcaattcgtaaactgtcagcctagcgacgtccgtttagatcaaaagtcacgtatatagcgacgctgtttccatccgtttccccgtcccgccgtttccgaacaacccacccgggttcagacaaccgaccaccaacagaaatatacacacagaccactgggagttcagttaaagatttcatcaggtttattttggctgctgctagtcttttgcttcttagaaaaaaaatacccatatagagaaataatgatagtttgacaacacatatggcagggatttcttcttcatcaataagatatgcaattcccccagggagagactttcaacaattgaatttacaaaaacaaaattacatcaggagaaagagaggatacattaataaatatattatatctggtgtatatactgaatgctgctggttcataaggtaacgatgctactttttttaattccaagatggtttttctttgttagtcttttgttgacttgctggttcctaaaagttcgcaaaaacgattgtgtgaagattttatgacgttggttgactagttcatgagattctgctgtacgtgtgatggttattcgctggttcgttctaagatgagtatcgtactgtgtctgcgatggtcgtctcttactggcattctctcggctgcctcttgctttcatgattgaaaaggaaaaaaggactccgagggcgcggtcatcttttacttttcggttttctcgttggcgggtcagaggtagtcagatcatgagactgtcgtggtcgatgaaactgtgtctgctcaagtgacgtccatttcttgtacggagaaaaaagtcatcgggataaataaggctatacaaggcgttgtcaagcgtgcggctctaaacaaattaagcgatacaaaattacagtaatacgaataataaattacccccctccccctgtggtcccccgagacgagagccacccatcgtgtactctcgcaccacccacgaccacagagggagacgggacgaagagacgacgcacagcgccatctcctcctggaggccggcgacgttaactgctacagctgcggcggcgaagacagctgcgatttgtcggccgacatgccgatggtatgggcggcggcggcaatggccgcggcagcggggaggagaggagagagaagaggagcggggcgtccgaaggcgaggatggcatggtctcgccggagcgcccggcttttatggaacactcgcgtccggttgggtatcacccacaggaagatgagtcacaacttccaaaccatcttgagacccgagtaacggtttacaggtcgcacgccagtcagctaaaaacagcggacagtcccacgctgtttctgttgtggctctctccagtttcctcatcaccgtcccggtctccgtcgtcatcggaagaataccacccgctctcatgcggcagtcgatcggcctcgacgaacgagacgcggcgacgcctctccacggccgactggttgtggtggtgaaagaagagcaccagcaatcccaggaggagcaacaagccctcacatgtccaggaggtcggggagagggcctgtcggagatggccgtgaggcatcacgtacggcagctgaggagaaacggagaagaaaggaaaattaccgtcaggggccggggttcttattagagaaacagcacgtaggtcaggatccagatgctaatggcaatcatgatgacgatgatcatgcaggccaagacgcggcgcaccaatgccgaatccaatagccgccgtgcctccggttggtggccggcggcatctagagacatgatttgggggggaccggcggcgcaaaaagacagggagatggacagtgtcacggtgttttgttataattaggacatggggaccggaagccgagacagagtactacagggtgttgaagggtaacgtgagggagatcatgtcatgggcgggctgaagaccgtgcggggaggattgacgtgtgcggtgcttgtggaacacggtgttttaatatgtatccgcgtgtaatgcacgcggtgtgctttctggcactcagcttggtaagctatgtggccgtctgcgccgaaaccaaagtcgccaccaactgtctcgtgaaatcagaagatacccatttgacgtgcaagtgcagtccgaataacacatcatctaataccggcaatggcagcaagtgccacgcgatgtgcaaatgccggatcacagaacccattaccatgctaggcgcatactcggcctggggcgcgggctcgttcgtggctacgctgatagtcctgctggtggtcttctttgtaatttacgcgcgcgaggaggagaaaaacaacacgggcaccgaggtagatcaatgtctggcctatcggagcctgacacgcaaaaagctggaacaacacgcggctaaaaagcagaacatctacgaacggattccataccgaccctccagacagaaagataactccccgttgatcgaaccgacgggcacagacgacgaagaggacgaggacgacaacgtctgataaggaaggcgagaacgtgttttgcaccatgcagacctacagcacccccctcacgcttgtcatagtcacgtcgctgtttttgttcacaactcagggaagttcatcgaacgccgtcgaaccaaccaaaaaacccctaaagctcgccaactaccgtgccacctgcgaggaccgtacacgcacgctggttaccaggcttaacactagccatcacagcgtagtctggcagcgttatgatatctacagcagatacatgcgtcgtatgccgccactttgtatcattacagacgcctataaagaaaccacgcgtcagggcggtgcggcgttcgcgtgcacgcgccaaaatctgacgctgtacaatctcacggttaaagatacgggagtctacctcctgcaggatcagtataccggcgatgtcgaggctttctacctcatcatccacccacgtagcttctgccgagccttggaaacgcgtcgatgcttttatccgggaccagggagagttgtggttacggattcccaagaggcagaccgggcaattatctcggatttaaaacgccagtggtccggcctctcactccattgcgcctgggtttcgggaatgatgatctttgttggcgcgctggtcatctgcttcctgcgatcgcaacgaatcggggaacaggacgctgaacatctgcggacggacctagatacggaacctttgttgttgacggtggacggggatttacagtaaaagatgcgtgtcgcctgccgaagacctcaccatctcacgtacaggcatacggcgtatacaatcataatattctatattctgcatagagttacatgcaacagtactactaccaatactgcatccatcacatcacccaacactgcttctaccacctttgtgaccagcgtattttctactccgaataacaacacatcaacgacgccacacacatctgtcacctcacaagcgtcaaccattggcaacatcaccaacgttacctccgacttgagtactttcacaaccgtatattctacattcaatacatcatatgctaatatatccaatacggctgccactacagaattgatttcaacaaataccaacactatattatcttttaccaacgtaacagcaaacgctacatcatcttataacacaacaatcaccgtaactatcacgtcagatgaaacttcgcacaacgtatccactaatactgcacttataagcacgccatggcttacaaattgcagcgccacaacgtacaccacgtacaaccgtactaactcttccaacgcttgtcacacagagacaacaatcatacgtttcaaagaaactaatacaacaggaatagaagggagtaatgtcaccataaaaggtaattctacgtgggattgtctttcagtcgcctggatacgacattacaatcgatccacacacggacatcatctaggtcatcgtaagaacgcacatacccaatcttggtattggttacgcatccttacctctcatactgtatgtcattctcaacatgaaagaccttcactgtaccatgacttatgtcgttcgtgcaacaacacagaactacatctgtacgatctaaatatcaccaattccggcaggtacagcagacgttgttttaaagaaaattacttcacaggacatcacgaagatgaaaatttctacctattagtaacaccaaaaaatcatactgaagctattaatgctactttcgtttgccctagatacaacaccgatatcgaaaatgaagatagagagaaaggaagtcaacatactaacaatacacatcaccacaaacgtaatctctatcatagctcgcaaagaagccgcaccgtatggaccatcgtgttggtttgtatggcctgcatagttctgttttttgcacgacgagcctttaacaaaaagtaccatatgttgcaagacaccgtcagtgaatcagaattcattgttcgatatcacacagaacatgaagattgagctacgtttccgggcagacatcttatgaagctgaacaataaactaaaacattctgtaaggctcagcgttcaaaggaatattaatgcccattgagcgagaactaatattgcaatggactggcgatttacggttatgtggacgatactaatatccgcgttatcagaaagctgcaatcaaacctgttcctgtcaatgtccctgtagtactaccgttaactattccactagtactgagacagccacatcaacatacagtacaacagttatcagcaataaaagcacttcagaatctataaattgctctactgcaactgcaccagcaaccaccgtttctacaaaaccgtcgaaaacaaccacacagatatccacaacgacaaatacaaacgttgagactaccacatgtaccaacaccaccacgaccgttacttgtgatggtttcaattatacagtccataaaagatgcgaccgcagttacgaggtaatcaacgtaacaggatacgttggtggcaacataactctaaaaaatgcaatcagactgagaaatggcacaatgtagactggattcattatgagtaccccacgcataaaatgtgcgaattaggcaactatcaccaaacaacaccacggcacgacatatgttttgactgcaacgacacctccctaactatctacaacttaaccacaagaaacgctggaaaatataccaggcatcaccgtgataacggtcaagaagaaaattactacgtaacggtgttaattggagacacaacgttatccactcttggcacatgccctgtaagatataaagaatctaggaacactgaaaacaccattggaagtaacatcataaaaaccattgagaaagctaacattcccctgggaattcatgctgtatgggcaggcgtagtggtatcagtggcgcttatagcgttgtacatgggtagccatcgcattcccaaaaaaccgcattacaccaaacttcccaaatatgatccagatgaattttggactaaggcttaacatgcacatcaataaactttttttaaccaataacatgtctctgtttttttttgttaacaacctatgatataaagcggtatattcaatcattactaaacaaaaaaacatgggcatgcaatgcaacactaaattgttattgccagtcgcactaataccggttgtaatcatcctaattggtactctagtgcccatacttttacatgaacaaaaaaaggcgttttactggcgactttttctgcaaagtcaacatgtagaagcacccattacagtaacgcagggagacacagtctacctagatgctagcaataatccctgtaattattccagcttttggtaccacggtaattgcgaactttgtggatggaacggatatctacgcaatgttacacattactacacaaacacatcgtgttccccgcaattcatgtgcataaacgaaactaaaggtctgcagttatataatgtaacattaaacgattcaggtgcttatactgaacacgtttacgaatgtgatctttcatgtaacattactacttataacgaatatgaaatactcaattacttcgataactgtaactacaccataaatagcaccaagcatattatcaccgtggtgtcttcacgtcattctaaacaaacaaattcccacgtatccactcacgctggttgggcagccgccgtggtgacggtaattatgatctacgttttgatccactttaacgttccggcaactctgagacacaaactacgaactagaaacaacgtaaatcgcatagcgtgattacaaagtatcgacactaatttatccaagataaaatttgattactccgtgcggttctcaaaaactgtaaggtcccgcttttctactccatcatgaaggatcgcaatagaatactgctatgtatcatctttatttgcatcatgtgcctcatttgtatttactttaaacgtcgttgtgttcttactccgtctccagacaaagcggatctgcgagtggaatttccctcgttacccccgtgtatcggcatacaatgtgctgcatgagaacacgcgtgacacatagcgtacccctggacggtacagtttatgataacgtcattcaggggaagtatacattactatcgacgtgttatcacagaacacacagattttctgcgtgttttataaaagagcgtctcgaagcagcttgagccacactacggtccagatgacgagcgtaatcaaaaatatgccgcgcagtagtcgaaagccgtactgagcgtgcgaggcgggtagggtgccgaacgacggatatgcgtcgttgtcatcttcgactataaggatcgcgaccgagtcttcggccatggtaaacgtcaccctgtgtggctggtatgtagcgtatccggtttggaattgttctgctccagctcgggggatagtgaggaattctcaagggatacgggacccaatgactggataagagaagggtttttccccgtaagatgatcctcgtatcacatgaggtctggatatgtataaatgaagagtgaaataggcacagggaatcagatgccagcctcgtgatgcagccgctggttctctcggcgaagaaattgtcgtctctgttggcttgcaaatacatcccaccttaagcgatgagtccataaagcaccgttgtccgggtacggtgaaagtgactcggattgtagcacgtcccttttttttgtttttgtatcgcttatcgccactgacagtgcaatattttgatcgtgaggctgagtatggttatgatgcttagaacgtggagattattaccaatggtactacttgccgcgtactgttattgtgtttttgggacttgttcaatcggcacgacgactgctcccgtggaatggaagtctcccgaccgtcagattcctaagaatattacttgcgctaactactcagggaccatcaacggcaacgttacatttcgaggtcttcagaacaaaacggaagactttttgcactggttgttagggtggggtcataagtccatctgttcgttcttcccgaaactccagggcaactataacgaacaacattacagatatgaagtagcgaacctgacgtataactgcacctataaccgcttgacgttgctaaatctgacgacggaaaacagcggaaagtactattttaaaagggaagatgcgaatttcaccttttattactcttgttacaacctgaccgtgtcctaaagaacgcacgtgaagttccacagagccgcgtggctgtagctattgtgtttacgttgcttttgaaatgttaagcgtccctacggcgctaacatgtttctaggctactctgactgtgtagatcccggccttgctgtgtatcgtgtatctagatcacgcttaaagctcgtgttgtcttttgtgtggttggtcggtttgcgtctccatgattgtgccgcgttcgagtcctgctgttacgacatcaccgaggcggagagtaacaaggctatatcaagggacaaagcagcattcacctccagcgtgagcacccgtacaccgtccctggcgatcgcgcctcctcctgatcgatcgatgctgttgtcgcgggaggaagaactcgttccgtggagtcgtctcatcatcactaagcagttctacggaggcctgattttccacaccacctgggtcaccggcttcgtcttactaggacttttgacgcttttcgccagcctgtttcgcgtaccgcaatccatctgtcgtttctgcatagaccgtctccgggacatcgcccgtcctctgaaataccgctatcaacgtctcgtcgctaccgtgtagctagttagccagctgtgtatagtttgttgtgttttgcttttgcatatttgttttcagtcagagagtctgaaacggggtgggagggacttttacgggtaatgcatgctaagatgaacgggtgggctggggtgcgcttggtaactcactgtttgaatacgcgctcacgcacatatgtagcactcaacatgttagcttttgcccgcacgccccggggcgtgccgagctgcctttttaataaagtctgggtttccagatacgcgctggttctgattttgatggtttgtgcctctgaaagctctacgagctgggccgtgacatccaatcgactgcctaactgtagcacgataactacaacagcgggtcaagacgctgaattgcacggtccggcaccgttaagctgtaatgtgacccagtggggacgttacgagaatggaagcacacccgtattatggtgcactttatggggatcacgcacgcgagtctcattaggacaccgtgtagcgtttggctgttcttggaaaacattttttatttataacgtttctgaaagtagtggtggcacttattatcaaaaaggttacaactgcaccgacaaacatataacactatcttgtttcaacctaacggtggttcctcgagcggttcaaagcacaaccaccgtaatgacacccacggtggttacaaactccacattcagtgtgtcacttgttgcgtcgagactgacgacaaattccagcgcgtttagacacgctagttatcaacggcaacagcgtgtcggaaacgggacgttatccaagaacataactaacttggcattcacctacggcagctggggcgtcgcgatgctgctgttcgccgccgtgatggtgctcgttgatttgggtttgcctcaatcggcttggcgacgctggcgaagccacgtggacgatgaagaacgtggtttgttaatgtaggaaataaaaggcactgtttgagcatgactgtttccaaaccgtaacgtggtaaataaatcatggcttccgacgtgagctcccatcttctaacggttacacaatcccgttggacaatacatcatatgtacaataaactgttgattttggcgttgtttacccccgtgattctggaatccatcatctacgtgtctgggccacagggagggaacgttaccctggtatccaacttcacttcaaacatcagcgcacggtggtttcgctgggacggcaacgatagtcatctcatttgcttttacaaacgtggagagggtctttctacgccctatgtgggtttaagcctaagttgtgcggctaaccagatcactatcttcaacctcacgttaaacgactccggtcgttacggagcagaaggttttacgagaagcggcgaaaatgaaacgttcctgtggtataatttgaccgtgaaaccgaaacctttggaaactactacagctagtaacgtaacaaccatcgtcacgacgacaccaacggtgatcggcacgaaaagtaacgttacggggaacgccagtttagcaccacaactacgtgccgtcgctggattcttaaatcagacgcctcgggaaaacaacacgcacctggccttggtaggtgttatcgtatttatagctctaatagttgtttgtattatgggatggtggaagttgttatgtagtaaaccaaagttatagtgatgtgctttttatcagggagaaggttttgtgccaacaatgactaaccctgggctatatgcatcggaaaattataacggaaattatgaacttacggaagccgccaatacagcacgtacaaatagcagtgactgggtaacgttaggaaccagtgcgtcgctgttgagaagcacggagactgcggttaaccctagcaacgcgactacggttactccacaacctgtggaatacccagctggggaagtacaatatcaaagaacgaaaacacattattcttggatgctaattattgccataattctcatcatttttattatcatctgtctgcgagcacctcaaaaagtctacgatcgctggaaagacaataaacagtacggacaagtatttatgacggacacggagctgtgatgaactacaatgtatagatacacgtggctgctttggtggataacaatattgcttcgtatacaacagttctatcaatggtggaaaccagatacaacgtcatgcattcagaaaacgggatatgaaggtcaaaacctcagtctgcctcctagtaatgcattatcatctaaagactatactttttcatggtataaagattcacttaaagcccttaacatgttatgttattatactgaaaaacttgaagaaatagatagcaagccagatactatacgacgatgttttttgaatcatacattgtttcttattaatttaacaagtcactatagcgggatttactacttcgattctctatacacatatggttgggtattacggacacctctatgttacaatgtcactgtatattccatatatcaaacacacatccacacaactatattgctctatccgcctacgtccacatataattcattaactatatcatcatttacctcaaccaacttaacacataccgcggtccactatgccgccggtaacgttgaagcacaacacgatactgccaccccacatacaatgtggatcatacccttagttatcgttacaacaattatcgttttaatttgtttcaaatttccccagaaagcttggaataaattcacacaataccgatacaacagtatgctcaccgccgcttaaagaatcaccgtcgagaaaactaaaacgtaaaaagaatggccatgtacgtttatttttcagctcactgtttgaataccgtaaacataatgacgtacatatacgtgattatacaacaggtgtttgtgttatgcggcgactgattaaccatatcgtgaaccatgatcttttccgatggtccgtcatgaccgcaatgatattttacaggtattccgaaacctgtatggaggtcactgtcagagtaggtgatccagttaccctcggtagtggacatggttatcatccaggacaaaaagtacactggtataaccagtcatgcgtcggcattagcaacggcgaaaatacgcatcctatctgcacctacgaccctcctaaacctggtagacgaaagacaatgaaaaccactccgttaccatcaccactgttgtacgagtgtcacaattccacattaagcattcttcatgtaaacgtctcagatcccaaaaactattgcaggcgaaaatgtccaccaaacggtaactgtgaatttcccacatgttttacgttatcactgatttccagaacgacaaccaccagaaaacccggacaaaaaactacgttgtcgcgattaaaaaccacgccaaataaacatacgcagcacaaaagatccacgcgaagaacgtcacctagagattacaatgtaacgggtctgccgaaaggctttgcggactcgtttaccggtaacgtagaggcacatagagccaaagatgccgcacacagcgcatggatcctcattgtcatcatcattatcatagtcgtcattttatttttcttcaagattcctcaaagactcagagagaaatgggacaccagaggatacctttacaaaggaaccgacggcctgcccactacggactacttatcgtgagcggacggatatctccggtttcaaacccactgtttgaatatagggacagtccctacggaacctgagaacatgtggaaatcacctgtggtagaatgctgctcaggtacattacctttcatcgtgaaaaggtactttacctagcgatcgcatgcttctttggtatctacatcagtttccacgacgcatgcattctggtacctgctaaagtaggtactaacgtcacattgaacgcggtacatgtgcatgacggtgactatgtgtactggtcttttggtggaggtggagctaatagattaatgtgtcgctatacaccaaggctagacgaaattcacaaaaacaccaatcgaagtttttcatgtcttacaaatcacagtctccttctcatcaatgtaacggaagaatatactgattactatcgcaccatgaccacattcgtacatcagtcccataattggcacaaccacggcaacaaatggactttagacacatgttattatgtatacgttacccaaaacggaacacttcccactaccaccaccaaaaaacccactacgaccacgagaacgacaactaccaccacaacaaagaaaacaaccaccacgagcacgacaacgaccaccactaccaccaagaagacgacgacaagcactacccatcatcgacactccaatcccaaagaatccaccacccctaaaacccacgtagaacttcacgtcggtttaggagccacagcagcggaaacaccgttacaaccaagcccacagtaccaacacgtggctacacacgccctctgggttttagcggtcgtaatcgttattatcatcattatcattttctactttcgaataccgcaaaagctgtggctgctctggcagcatgacaagcacggcatcgtgctcatccctcaaaccgatctgtgagcaagtcgcgtaggaaatgattgcatgaaatcactgtgaaacgccaactccgtgccagctggcgcggcggacaggcctttgacgtatttgaagccaggcgcgctctcgataccgaaaggatccgagggggctttccaaagccgacgtccctgattcccttcataaagctgttgaccggccctagaaagaccaagagcatgctgtgggcccactgcggtcgcttcttgcgttatcatctgctcccgctgctgctgtgtagactgccattcttactccttttccagcggccgcagtgggcccacggcttggacattgtcgaggaggacgagtggctacgggagatacaaggagcgacgtaccagctgtccatagtgcgccaagccatgcagcacgccggattccaagtcagagcagcgtcggtcatgacgcggcgaaacgccgttgacctggaccgaccgccgctttggtcgggatcgctcccgcatttgcccgtctacgatgtgcgttccccgcggccgttgagaccgccgtcatcacagcatcacgccgtatcacccgaactgccgtcgcgagacgggatacgttggcagtaccaagagctgcagtatctggtggaagaacaacggcggcgaaatcagtcgcgcaatgcgattccgagaccctcgttcccccctccggatccaccatcgcagccggcagaggatgcacgagacgcggacgcagaacgtaccgaatcaccacatagtgcagaaagcaccgtcaggcacgacgcgagtgagaacgcagtgcggcgacggcacgaaagacggcgctataacgctctgacggtccgcagccgggactcgctgctcctgacgcgaatacgcttctccaaccaacggtgtttcggacgcgggcgtctgagacatcccgcgggaagcggtcccaacaccggcggaccgcgacccggcggtgcgggactccgtcaactacgccaacaactgacggtccgctggcagctgttccgcctacggtgccacggttggacacagcaggtctctagccagatcagaacccgctgggaggaaagcaacgtcgtgagccagacggccacgcgagtacgtacgtggttcgtggaaagaaccacgttttggcgtcgcacgtgggttccgagacagaacccggcggccgaagcgcaagaactggccgtcataccgccggcacccacggtgctccggcagaacgaggaaccacgtcaacagcttacgggagaggagacaagaaattcaacgcacactcaacgtgaagaagtggaggacgtttcgagagagggcgcgagagaagggaatgatgggagccgagcaagtggaaacgacgagagaaggaataatgcgggaagatatgatgatgatcatgaggttcaagagccgcaggtcacttatccagcgggacaaggagaactgaataggaggtcacaggaggagaacgaggaaggtggaccgtgtgaatcgccgccaatgacgacaaatacgctgaccgtggcctgtccgccccgagaacccccgcatcgtgccctgtttcgtctatgcttaggactgtgggtctcgagctacctggttcgacggcccatgacgatttagaatacaccgagccattcctttatttccccccatccccggtcgcttatgcgtgttaaacactaccaataaagataatctgccaatcgcaccttatatataatatgtggtcgcgtgtggtctttttaaggagctctgaaacacagacaggtatgggcggtggtcggctgccgccgctgtggctgccgctactgatcgcctggagcgagtggggcaactgctgcctcgatgcgcctccggtggtgcgttcgccctgtctgcagccggtgcgcgaccgcaaccgcgagcggaacccgggctcaccgcagttgctgccttacggcgaccgtctggaggtggcctgcatcttccccgcgcacgactggccagaggtctctatccgagtccacctctgctactggcccgagatcgtgcgttcgctggtggtggacgcacgcagcggtcaggtgttacacaacgacgccagctgttacatcgccggcgggcgctggcgcttcgaggacggcggcgcggcgcagcggctgagcctctcgtttcggctcatcaccgagaccgcgggcacctacacctgcgtgctgggcaacgagacccacagcctggcgaccgagaccacggcgctggtggccgacgtgcacgacctgcgccactcggaccgctcctgcgacctggctttcggatcgcgctcacagacgcggtacctgtggacgcccgatccctccaggttgcgcagtataaactgcggttgggagggtgaacggcaccgcgtagtccactacatccccggcacctcgggtttgctgccctcgtgcgaggaggacgagcgcgaactgtgcgtgcccttcatcagccagagcattgcggacaacaactgcagccgccggcatcgagttgacggcgctaggcggcgctatcatctacggagggattactggctgacggatccgaagatcgggttgctggccgcgggatcggtggccctgacctccctctgccacctgctgtgctactggtgttccgaatcgtaccggcgtctgaacaccgaggaggaaagcgaggcggcggaggaaactgccgcgggagaagcctctgcggtagcggcggcggccgtctctgaggaagagcagcggcgggagtaaacgaggagagccatgaagcggatgattcgcagtcacggcaggaaaacggaatgtcagatgacgagcgccggcgagcgacgcggctccgccgtcggtgcgcccatctgcggcagcggtacccgacgcggcagcggcgccaacgaacgccgcgactccgacgtcggtcccatcgcccacagtagcggtaccagacgcggttcggcgaatgaaacgtccgcctgtacgcggaccgatcaccagaaggcggacattgggctgtggttcatgtttctggtttttggactgtgttcgtggttggcgatgcggtatcgcgcacaataaattttgaatcgatgtcaaggaacgcgtgttttgtattttattgggaatattggcggggataaacctgtttcggatgtttacccttaatcttaccggggacctcgttgtcctctcctccttcttcctcggacaccgggctccatgctgacgtaggtaccgactggggtcaaaagcctgggtacttatgaggagcgcgcacaaaggaccgttaggcgccggcatggagcgtcgccgaggtacggtaccgctgggatgggtgttttttgttctttgcttatctgcctcttcctcgtgtgctgttgacctgggtagcaagtcctccaactcgacctgccgcttgaatgtgacggagttggcctcgatccatcctggggaaacgtggacgttacacgggatgtgtatttctatctgctactacgagaatgtgaccgaggacgagatcatcggcgtggcttttacttggcagcataacgagtctgtggttgacctgtggttgtaccagaacgacacggtgatccgcaatttcagcgacatcaccactaacatcttgcaagacggactgaaaatgcgaaccgtccctgtgactaaactgtacaccagccgcatggtcactaatcttaccgtgggccgctatgactgtttacgctgcgagaacggtacgacgaaaataatcgagcgcctctacgtccgattgggctcgctatatccgagaccgcccggatccgggctcgccaaacacccctccgtaagcgccgacgaggaactgtccgcgaccttggcgagagacatcgtgttggtctcagccatcactctgttcttcttcttgttggccctacggatcccccagcgactgtgtcagcggctgcgcattcgcctgccgcatcgataccagcggttacgcaccgaggactgaacggataaccgcaaaggccacgtgcaacgttcacgctgctataagaaggccatgtcccccgtggacgggtctctttgacacgagcgcggcacgccgttgccacgagcatggatcacgcgctcttcacacacttcgtcggccgaccccgtcactgtcggttggaaatgttgattctggacgaacaggtgtctaagagatcctgggacaccacggtttaccacaggcgccgcaaacatctacctcgacgtcgcgctccgtgcggcccccagaggcccgccgagattcccaaaagaagaaaaaaggcggccgtccttctattttggcacgatttgtgctggctgtttcgacgacttttctttcctcgggaggactcagagccactgatgtcggatccggcacggtctcccgaagaggaggagtaaacaacacacggctaagaggatacatcatcaaagaagataggaggggtcaaaacgcggactgaaagtatataacgccgatcatgtccgaggaactgttaataaaacgccatgatgacaatgtggtgtctgacgttgtttgtgctgtggatgttgagagtggtgggaatgcacgtgttgcgttacgggtacacggggattttcgatgatacatcgcatatgacgttgaccgttgtggggatttttgacgggcaacacttttttacctatcacgttaattccagcgataaagcgtcaagtcgggccaacggtaccatttcttggatggctaacgtctcggcggcctaccccacctacctggacggggaaagagccaaaggtgaccttatttttaaccaaaccgagcaaaacctgttagagctggaaattgcgttgggttaccggtcacagagcgtgctgacgtggacgcacgagtgtaataccacggaaaacggtagttttgtagccggttacgagggatttgggtgggacggggaaactttaatggagctcaaggataacctgacactatggacgggccccaattacgaaattagttggttgaagcaaaacaaaacgtacatcgacggtaaaattaaaaacatcagcgagggggatactacaatacaaaggaactatctcaagggtaattgcactcaatggtccgtcatttatagcgggtttcaaccccccgtcacccacccagtggtaaagggcggtgtccgaaaccagaatgacaacagagctgaagcattctgtacatcttacgggttctttccaggggaaattaatattacttttattcattacggtgataaggtgcccgaggatagcgagcctcaatgcaatccgctacttcccaccttggatgggactttccatcagggatgttacgtagccatcttttgcaatcaaaactacacctgccgcgttacacacggtaattggacggtggaaatccccatcagcgttacctcacctgacgacagttcctcgggggaggtccctgatcacccgacagctaacaaacgctataacaccatgaccatcagcagtgtcctcctagccctgcttttatgcgctttgctattcgcgttcctgcactactttaccaccttgaaacaatacctacgtaacctggcctttgcgtggcgctatcgcaaggtccggtcgtcatgaccagcaacgccctgtatgagctgtttcgacgtaggttaccgcgtgcccccgtcaacacggtcatgtttctcacgcgacgcactcgtgatgggttctgcggtcggttgacgtccatcgccacgaattcccactacactatgttcgtgttagatcacgggtccgtgcgcatcgagcgaccgagtcagtcagaagtggattgcgccagtttaatggaaacgctgaagcggattcggttacgaaattcgtgggtagcgtcagaagacgagctagatgtgagtcgcggggacgcgtgacacaaaacgcgttcaggattaacgtaggttttcgaaataacctacgtccgtgagtgacgcggtttcgtgttgaaacccgcgccggttctcacggtggtttatgatgaaaccggcgttggggatctacgcgggttcctcattcaacctgcgaaaagaggaagttgcggtaaaaccacgtcaataaagacgtcaatgacacctcaatgttgcgttggaacggtctttatatatacaaacgccgttatgttcagtgtccggcaagatgctcgggatacgggctatgctggtgatgctggattactactggatacagttgataacaaacaatgacactcgaagcaacaataccgataccatctttgtatctctccttaccggggccaacggagttactcgcacagccatcgggggtctgcattcaaactacaccaacttaaccgaggcattcagattcactccagcaaacacaacaactaactcttccacggagggtaattggagcgtgactaacctaacggagagttgcatcaaccgcggtgagtcctatctaactaccatctggcttctgaactgcgctgacaacaatacttattggtactctggaaatgcctataaccatacaattgacacttgtaaaaatacagtttcgggatatctcttcttcggcatgtgccagctatggaaagattgggttactaatgcttctcacgacactgtcagaattcagtcgttgggaaatgaaatacgctgcatgctgctccctagacagtataccctcaacgccacggtggaatggtacaacaaatctgaaggtgacgtaccagaagaatttatggactatgttatcctgacccccttggcagtgcttacatgcggactgcaggaagcttatatactcgacaagggtcgtagatacatgtatttgttttccgtgtcctgcgcgggaatcacaggtaccgtatctattatactcgtctccctatcgctgctcatcctcatctgttactatcgctgtggccggcttctgatatgcccacgcggctttgaactcttgccagaattcactgaggaagaggaggaaaaagaaaaattgttaacgtacaaggacattgaagtccaggtgcctatccgcacgcggcggctgctcgtcccttggatccgggagagcaaaatgtgggtactaccacccccgctgcctccacgacctccccacttaatagaattcccgccgtctcctccgccgtcgcctgggcccatgcacatggtggtctgcatgccagcatgacggactttgaactttgagccccaagcggtacggactacatattttccataaatctacactgaacttgagcacaaaaatactgacaatggactgaatatacagacttttatatgatccttgtacagatgtaaataaaatgtttttatttaaaactggtcccaatgttcttcgggaatcatggggtggggacgggggacgcggtaaggagcaaaaccgggtacatgggggggaacatcgtccagcagtagcaccagcggattgggtaggggttgctgcggaggtcggtcgatgacgatgtcgatctccatcggcagatccggcaacatctcttcgtctccctcaccgaccagcactcggcgctgttctggatgtatatgattttggaaaagcctccgacgagctcgcggcgcgtagaaagccaagcggcgcaagggccggcgagcccgaaagtccatgcgcacagatggcatgagtccttgagtgacggtggtgagctggggaacagggctacctcccatcgcgacggtgacagtggatccatgagagaggcgccgcacgctgcatggctaaataccgtgaatcccctgacgtcgtctttcgtcccgaacgcgtcatgttgggggcgaggcgtaaaccgtcgaggttgaaaaaccgcgtatctgcgacccgtccggactacgttgtttttcagaagcggccacatgacctcgagatgtcgtcacccaaggtatttaacggcacacagccagacgcgttcgtcagcagcgacgccgacaagacctcagcatggctcggaggctatggatcttgagcttactagccgtgaccttgacggtggctttggcggcaccttctcagaaatcgaagcgcaggtaaacggaatctggggaattcaacacaggtaagaaatacaaaaaataacgtgattgtgaacgcggttatcgtgtttttgcagcgtgacggtggaacaacccagtaccagcgctgatggtagtaataccacccccagcaagaacgtaactctcagtcagggggggtccaccaccgacggagacgaagattactccggggagtatgacgttttgattacagacggagatggcagcgaacatcagcaaccacaaaagactgatgaacacaaagaaaatcaagccaaagaaaatgaaaagaagattcagtaacagcagaccccaagggttaacgattatgttgactaccttgttttttattaaaaagctgtaaggttttgctctaaaaacaccccgcctccggtcttttttcttttgtattcggcacgcgaaacacggtttcttcccatagcctgtctaactagccttcccgtgagagtttatgaacatgtatctcaccagaatgctagtttgtagaggctatgcgggatgctgcggcggcgcgaccttccctctccacccagccccgtcaaaacacacgcgactcgagcggttcgtatgaaaaataaaaaacagctttttatttacaggaacggggaaaaaaaaggcacacggtccgtgggagacgcgggttcacgcgtcgtcaaaaagttggtggtccactccgtaaggacaggtaggcttatttagcttccgcatgctcctggttccgtaataaatgccgttttcgtggcagcgtgtcatgccgcgagtcacaaactccatcaaactgtcggccacgatgcaaacgtgctgattgttggcagcaaagacgcgcatacagtcgtccacgaagaggttgatcacgtcgtaggggctcaccaaccagcctaaaggttccacgtggttactgccgaccatgaccctccagtcgttaatctcgctccagtcgtacagccgaatcgtggagacgcgaatgacgctgtaatcacccatgaccatgagtcggccgcgatacgtagcacgccactgcgcgaacgcgtggatgtgcatgcagccggccagcgctctaagcgaggcggtgtgcggcagctcctctgggacggtgatgaagttgcagcgtcgcaaaccgatgttgagaaattcagtgatgctctcggccacaaaggtcaacgagtcagagtagatgtggtcggtccacaggtacatggcgcccgaggcgcccaggtacagttcagacggcacgttgtgatcgcccttgtgtttaagaaagttgtaggtgcagatgctgccgacgaaacgcagcggctcggggcagcagaggtagctggccagacgctgtgcatcccgtccttcgtcgcgcaccaagcgccagcgacgccggataacgaggcagcggtctttgggccagaccagggccacgcgttgcccgggtttccacggtcgcgacgtcttaggaggcctccagcggtcgagcagattgagaaaacagtccttgattaccgacatcgcggtcgcgcgtcggtggacaaaaagaaatcgggccgatccggaaaaaaaaaacgacggcaaaacaccgccgtgctcgagcgaagggtggcggagggccagaagaggcggccttgacggcgttggcagcgaaaaaattggcacgcgagtcaaacgggaagtagcgtcggtgttttatgccccaagcagcgtcgtcgtcactcgtggcgtcacagtcaacggtgctgacgtcctttggggcagtcgggcacgcgatcgtagatgccgttgtggccgctgaaacgtcggttttcaaacagcaggttaagtcccagacacatgaacgtgttgagattatctcccacccggatgtagcggtcgtcgcgcacgtcgcaggcgtagacggccccggtataggcgacgacgatggggataaggtcgacgggccagcgcaagtgaggaaagggcgcgttctcgcccttgaggctgacggttcccaggccgagaacgcgcattccgaaagcggttttgatgttgcgcagcaagtgaccgccttccacgctgttttcgaaacacctgaggttgcatagacgcagttccgttcccggcgggtacgtcaacggcatgaactgcccgtggtggcggatgatgaatcgcgccatggtatccaaaccgaggctccaggcgcgcaacagcgggcgaaagtagcgcttaaccaacgacgaggtcaggtagcgcatgcagtgcagggtctcgacggcgcgcagcccgacgcgcgcaaactccatgaggttgcgggccaggtagtagacggcggtgtcctcgcgtacatagcaaaaaacatagccctcgtccgagatgaggcacacagcggtcttcttctgctgatccggcgacaacacgccctcgttcacgaagcgacccacgaaggccaggcgcgtctggcaacacaggtagtgactccaagccttcacgtcctccggtttgaagtcctcgtccgtctcgatctcctgcagcactaggttccagcccggcggccagaccacgggcaacacctggcctgcgttgatgcgcacgtaagcttccagacagcccaggccgaactcggccgtgagcgccaggctagccagatcgctcatgtgacgcgccgagtcagtgggcgagcccgggggcccgtcgcacaccacgctccgtcttcttgtcctcaccgcggccagcgtggcgaggacactttccgcgcccgaggctgtatcttcggtttgcccgccggagccggccctcactatataacgtcccgcccgggtctcctccatgtatgcaggtaagcaactgagccgaacgcacctcagcagacgagaggatgtcgtcgcggcgtcgcagctcgtcacgtcgctctggcgaaccctcgacggtgatttatatcccctcgagcaacgaggacacgccggcggatgaggaggcggaggacagcgttttcacgagcacgcgggcgcgcagcgccacggaagatctggatcgcatggaggccggtttgtcgccctacagcgtctcctcggacgctccgtcgtccttcgagctcgtgcgcgagaccggcggcaccggcgccgccaagaaaccgagcgaaaagaaacgatcgtcgtcgcgtcggcaaccgcagatcgcagcgggcgcgcctcggggctcgccggcgacacccaaggccggcaagtcgcctaaagtctcgcgaccgcctagtgtgccctcgctgcccgagaacggcgccggcggcggtggcgacgataacagcagcagcggcggtagcagcagtcgcaccaccagtaacagtagcagaagtaccagtcccgtggcgccaggtgagccgtccgctgccgagggcgatgagttttccttctgcgacagcgacatcgaagactttgagcgcgaatgttaccgggtcagcgtggccgacaatctgggcttcgagcccagcgtggtcgcgccgcagcacgtcgagtatctcaaattcgtgctgcaagactttgacgtgcagcacctccgccgcctcaacgaatgcatacccatgccggccttcgcgctcaccagcctcgtcgaccccgtcttaaacaacgtagcgcctggcgagcgcgatctcacgcgtcggataatcacgcacgcggtgatcatcaactattactacgtggcgcaaaagaaagcgcgccacatggtggaggccatacggaccaccgtgcggggcgacacggtacgccgggtagccgcgcaggtcaacaaccagagccgttcggggcgtgcggccgcgctagcgcttcattttctcacgtcacgaaaaggagtgacggacggccagtacgccacgtctctgcggcggctggacgaagagctgcggcatcgcggcacgcccgaatcgccgcggctcaccgaggtttaccagacgctacgcgattacaacgtgctcttctataccgcccactacacctcgcgcggcgcgctctacctctatcggcaaaacctgcagcggctcaacgagaaccaccggggcatgctccggctgctttcggtcgaagagatatgcgaagagcacacgctcaacgatctggcgttcctagtaggcgtcgagcttatgatcacgcactttcaacgcaccattcgcgtgctgcgctgctatctccagcaccagctgcagagcatctcggagctgtgttacctcatctatgtacaactgccgtcgttgcgcgaagactacgcgcagcttagtgacgtgatctactgggccgtcagtcaaaactacgactacgcgctctacgcgagcacgccggcgttgtttgactttttacgcgtcgtgcgtcagcaggacgccttcatttgcaccgactacgtgtactgcgccctgcgtctgctggcctgtcccgacagacctattatcggtgacaccggcggcagcagtagctcccaacgcctcgtaggcgagtttatggtgcgcgatccgctgttgcgcgacccgcgcgccacccacctgcgccagaaactcatcacccgcgacatatgcgtggcgcggttgcaagcgcagccctcgagtcgacacattccggtcgaacacacgggtgtctcctccgtcaccctgctcaaaatctttagccaagtcccccccgacgaacgcgaagaagacacgttacgcgagatggctcttaaagcgtttatggaagcgaacggtaatcaccccgaacaaatctgccgatccccaccacccccgctgccaccgcgcgactatcctcaacgcgacgagcgggaccgtcaccgtcgcgaccgccgcgacagcggggaatactgttgctgatggtgggacgaaacagcagggcggaacagtttatgatagaaagtcacaggaaagtatgtgttgttttttttttaatgtaccaagaataaaaagtgcgtctacgaccaaagcggtgtgtggacgctcgtcctctctgtcttctccgggtttttttttcacgtgttttttccttcctattttgttacggcaacagcgctgatggcacgttgccggcttcgaacatcgcgtcggtgatttcttgcttgcccggcgtcacacggtgacgtagcagcacgcggctcacgtagcaggccgactcgcggatgacctggccgtcggcgtcgcgtcgcaggcccgagcggttgccgtgacgcagtctgccctgcgcagcgcgctccacgtcttcaaagtagctgtgtagcaggccgcgctccagcagctgcggcagcgagtcggcggcgcgcactacaaagttctcacggctgatctcgtagcacagcacgctgccgtcggccgccacgccggccacgctgcggtcccaactgaaaaggttggcgagtccgatggtgccgatgacgcgcaactgaccctgggtcaccaccagcagcttccagtattctacgtcgcgcggggtgaggatggtctcctccacgtcgcagacaaacaacgtgtagccgcgcggatagggcagatccaggtggcgaccgcgctggcggcgcataaaatcgtctaaattcaaaccgccgtcgggtgcgcgcctactcgtcatcgccgcgccttgtcggtcgatgaccccacggtgcttataacgcgccgccgcggcttcatgtggcgtgacctccgacctcgtgaggccgaaaacggcgtacatgaagacgctcaaacttttgaatgtgggcccggtagcgcaccgagggccccggggcggcgacgacggcgggcccgagttccagcggggccttgcggcggcagcggttggcgtggttgctcagctcggcgtccgagagcgccgagctgaactgcggcagccgcgtgcgatcctgcggcgcgtccccgtgtcgcagcgagtgccagagcaggcgctggacgcgcgccgtctcgggcgtcggcggcgcgcgacagccccggcgcagcttgaaaacgtgcaggcacagcagctcgcgcttgatgcgcagcgacacgctgcggtagtcgggaatccgctgcaccagctcgagaaagtcgcagaaggtctccacgaacgtgtcctcggtgaagcgaatgcgcttcagatcgtggacgtgtttgcgaaaccgcgacagttctcgacgttgcacggggttctgagcgagtcccttgcgcagcagcgcagcctcgcctttaaacagcctgatgagccgctgcacgtccccgctcaacatacgtatacacgccgtgtactcgtgacgtatactggcgcgcagcagccgaatgatacgcagggccagcacggcgttagaggccaggtacatggcgtagccgcgacgcgggttggcacaggcccagcccgcggggagcagaaagtagtcgtcgatcagcgtctgcgaccagtcggcgaagcccaggtcacgtgatacgctgtcctggacgcgggccacgtcgccggccgtgaggtggcggatcgccggcaggtgaaacgcgcccaggtgtcggttgcgctccagcctcagctcggcgtgctccaaacgggaatggtgggacgccaccgcggagggcgacaaagaggagtggtcattgccgtcgtggttaccgtcgtggttaccgccgttgtcgcgcccgtcgccgcactcgcaaaaggccgcgtagaggtccttcaatgccgcttcggctcgcgccataaacgtggcgtggaaaaaaacggcggcgcggtgcgtccggtacttgacgggcaacccgcggcacagggccgccggcaggcagcggccgatgagttcgcgctcctcgggctccagaaacaggcacagggtgccgtccaggcgcaggtacagctcctcggtcatcgagcatagctgccgcaagtaatgggtgcgcgtcccaaaggtcttgtaatcgagcaacgtgcacaccacgtattgccccgtggccacggccagagcgatgcgtttggcggcacgactgatctctggcaagtactgcgcctcgtgcaccagacggcggaaagcgccggcgttgagccagcgaaaatgctgcggatcgggcggcaagggcacgcctcgaagcgcggcccagacagcgaggtccgactcgagcgtcagaccgcggatgtcgtacttgccgtgcgccgtagcgcaggctgaatggaccagacagctgcggcgaatgtacaccatggcgtgcttgggatgtttgggcgccggcgttttctttttctgaccgccggcggccgccagatcctcgggcgtgcgacacaacaggccggcgcgcacagcctcctgtcgattacgaatcggcgtcaggtaggcgcgcaggaactggtgacaaaactcctcatcatcacgacagtcgtcgagatactcgtacgtggtgagcggatcgcgaaataggcgctcgtcaccgtcgtcatggtcttctttagcctgctcctccggctgctgggttggcagtggaggcggcggctgatccacggggttcatgactgagaggaagaagaaggtggcggcgaagcgacgcggagcgacggcggtaaagccagacaccggctatatagctagtcatcacagtctcctccttcacgacgcccccgtgccgctcacgctatccagcacgctacggcccgaaaacacgtactcgctgacgtcgtacgcgggcgatgtatggctgctcaccggtttcgcggcgacggttgcgctcgagtccaacggcgagaagcaaaaacgccgtgggcaacgaaaccagaaggagccctgacggataaaaccgcgcagcgtctcggccaacttaaccagcatcgtaccgtacagcagtacgtgaatgccgccatgcgcgtccataaatacggctttgttcacgggttccatccatccgatgactacaaaatgggcctgttctagcacgccgatcacgaaattgttggcctcgtcggcctcggccacgttccacgagccgaaagtgaaagtacaagcgggcgagccgcccaggcggatcttgctaccggcgtggagctgacatacgcgcagcagattggcgcggtcgtgcagtatctgggagagttcgtacatgcccgcaaaggtgtgcttaaaccacgcgccctctacgatctcatccacgtagtcgcgctcaaagaagctgtacacggcaaagaggccgttctcaaaaaactcgccgaacgagagccccagcacgtacaccttgtcctcgccgggcaggtacgcaaaggcgtgcccgtgcccggagacccagatctcgggcgccgtgtttgcgtccggcacgcattcgtacacactgacgaggccgataaagtacaagcggccagcctggcgcaggcacgagaagcgccggtaggtcttgtgatcgcgcaccaccccaaagtactgagtgtcgcccagcatgatgccgtgcagcggcggccagcacagcgggagccaacgacccgccgtggcgcgcacgtagcgctgcaggtgaaccccgctcgcacgctcgcgcggcttcgggcgcttgtgggtccaggcatcacgcagaccgcgccagatgctgctgaacttgggctgcccgcgcagatagagcgacgagagcgagtcaaagtagcccacgacgagcctgtcgggagacacaagagcgcgaaaatcaaacctagagcgacgacggtgaaaaaaccgaccagaagcgcgtgtctcaaacacgctactttcggttataaaaacaccgtcgccctatttctgggcgcgtgtacactgatgactcacctacgctttttgaacggcagtctcagctcgggattggcctcgtacagcgagctgcggtccacggggccgatgctctcgtagcgaaagtcgtcgatgagcagcgccagccccacgcgcacgaagcccctgaggtcgcgcgccagccgcaccaacttatcctgccccaccagcgccgcgtacacggtgcccgtgtcgccgcagagaatccgcacgcggtgaaagaaggtcttgtcctcggcgccctcaatttcgcccagcggcatgacgggctcgcgcgtgtacaacgaacgttgaaagcggcgcagcatcgaggccgagagccccagatcgcgcgccgtgcgcagcactagggaatgcttctcgggccagatgagggtcagttgcgcctcgcggtgcgcctctacgtaggcgcaacgagcggcggtgtcctcgcaggccagcaactcgcggaaagccagcagcgaacgtaggtagcggccgcgagcggaggcgcgcgagcggcggcacagctcggcccgatggtcgggatgcaccaagggcacgttaggttgcagacgcgcgcagatggattcgtgcaccgggtcgcagcggatcatgcccttggcaaaaaatccggccagatccgaggccaactcgtacaggcagtcctcttgcgcgtcgtaggcgaacacggcgccgtacgcgtccacgaacacctggtaccggcaggtggcgtgcgagaccgtgccaatgagatgcagagctcggaattcgccgaaaaagtcgttctggcagtgctccagatcgatctcggtcagcgagtgcggcgaatgctcgcccccgaccacgtagatgcactgcgagggccagcccagcgacacgcacgagccctcgaagcgccgcaagtaacgccgcaggccctcatagtcgcgtcgcacgcacaggtcggccaagtcgcgcgtgcaaaagacctcgggtaccaagcagcgtttgcgacgcggccgacgcgcgtgcccaggcagaggaggaaggcgcgacggcggcgacgacgaggaggaagacgccgtggccgccgagcagcccttgcgacggccggacatgccggcagtccgcgacgatccacaggagacaaaaaagcagaagcagcagtagcctcggcgacccgctccaccccgtcctccacacgctcagccgcgactgaacgccggggcgcgccgctacttgggtttttatagccatctgccccccgtctcgggcacccgggagcgatctacggagacctgacagcagttgggcaacacaagatagggaaatacaaagacacttttaataaaaaacgagactactttgtgtgtgtgctccgtaaactgtttattctccccctccgcttcgctctggatgggctccgggtccgtcaacacgcgactcgcgcggcaaaaggcacgctgttgacggcgcgagagcccgtcgtgatagtccatcatgccccggagatcgtgcacaaagcagctgtcgccgcgcagaaaccgacgcagcgtctccacgtgctgcagctgccggcgcgtatcaggagccgtcatcgctgatgtcgtcatcgccctgacaggcgcgtagatggcttcgcgagatcatgcgcgttttcaaccgccgtgacacatcaggtccatcttgagctggcgccgggcctcgcgcaggtgttgcacgcgttgtgagcgggaggcgagttcggcttcttgctcgaactcctgctgctcactgtccgagagggtgcgataaaaggcggcaaagtcctccaagtcggctacatgcgccctgggtctgacgctccaaagcgtacgcagtctgatgaagcggacccatcgagcgtcacggcacgccgtcttgaacgcggggcccgggaagaggttcttctccccggcgcgctcgggccggcgaggccgacgcggtttatatacaccgtctcggacggcgggacgccgagcccgcgccgcggccgctcatccggagacggcggaaaccgcgacgccggaggaaacggggaccggcaacgacggcggtggcggcgaccagattatgggggacaaacccacgcttgtgaccctgttgaccgtcgccgtgtcgtcgccgccaccgtcgtcgccgctgccgctcgtcagcttcacggagctgttgttaccgccgccgtccgtcgccgccgctgcggtggcggcgacagcgacgagcgaggtgggcgagaaaaccgcggagcaagaggtagcggctgcggatccggagaccgggaatgagagaagagaaaacagggagaacgaaggaggggagacgaggacgacaggcaccaccgcggtcaaaaggtcgcacgacggtatccctcgccaactggcagagcgcctgcggctgtgccgccacatggaccccgagcaggactatcgtctgccggcgcaggacgtggtgacctcgtggatcgaagcgctacgcgacgcggaccgcgacaactacggtcgctgcgtgcgccacgccaagattcaccgttcggcctcgcacctgacggcctacgagtcgtacttggtgtccatcaccgagcagtacaacacggcctcgaacgtgacggagaaagcttcgtacgtgcagggctgcatctttctctcgtttcccgtcatttacaacaacacgcagggctgcggctacaagtacgactggtccaacgtggtgacgcccaaggcggcgtacgccgagctcttctttctgctctgctccaccagcgagagctccgtggtgctgcaaccgctcatcaccaagggcgggctctgctcgtccatggcggtttacgacgaggaaaccatgcggcagtcgcaggcggtgcagatcggttttctgcacacacaactggtcatggtgcccttcgtgccgcacgcctgcccgcattacgccgtgcctttcacgacgccgggaaagccgggctgcggcggtgctccgagcggcgttgcggggttggaggaggcggcgccctttggacgggtcagcgtcacgcggcatggcgcgacgctgctatgtcgcgtggaccatctgacctggatcagtaagcgcgtaaccacgtacggacacaaaaaaattacgcgctacctcgcgcagttccgcggcacgatggacgacgacgaggcagcgctacccggcgaggacgaagcgtggatcgcgtccaaaaacgtgcagtacgaattcatgggtctcattttcaccgtcaacgtggattcactatgcgtggacgcggaacagcgccaactgctgggcaccgtggccacctccttctgtcaccgcgtctcggacaagatcacggcgcgcaacatgccgcgcgctttttccttctacctgctgacgagcgcgcagcgcgggtacgacctgcgattcagccgcaacccgtcactcttttttagcggcgacgcgctcaactgtccgcttctcaatgagcccaacgtgttttcgctcacggtgcacgcgccttacgatatccacttcggggtgcaaccgcggcagacggtggagttggacttgcgctacgtgcagatcacagaccggtgtttcttggtggccaacttgccacacgaggacgccttttacacggggctcagcgtgtggcgcggcggcgagccgctcaaagtcacgctgtggacgcgcacgcgttccatcgtgatcccgcagggcacccccatcgccacgttgtatcaaattaccgagggcgacggtaacgtgtactcgtacaaccaccacacggtgtttcggcagatgcacgccgccggaacaaccacgttctttctgggcgacatgcaattgcccgcggacaactttctcacgtctccccatccctgaccctccgtccgtcctcctttcccgacacgtcactatccgatggtttcattaaaaagtacgtctgcgtgtgtgtttcttaactattcctccgtgttcttaatcttctcgatcttttggaggatgttctgcacggcgtccgacggcgttttggcgccccccatgccggcagaacccggttgcggccccgtaccgctcttctggggcgacgataggtcgaaagccaccgttttcatgcccgtcgtgctcttgacgggggaacctacggcggcggtccccgtcgagcggcgtgattgcaaagccgcgctcgcccccggtttcaggatggagggggaggccacaggcggcgcattcgatacgctgcttttggccgtagacgacggtgggtaaacggtggttaccgcgggatacgtcggcgtggtcgaggcggcccggctgctgccggacaggcgacccggcgcgctaccgctcacggggaccgagggcggtcgacctaccaccgccttgccgcccaaagtaggtttcaaggaaggaacaccgacgcggctgccccggcctttcaccggagacgggggggcactcttggccggggacggagaggctgacgaaagcatggacagcggcgatgtggcgggggacacgacatcatcctccgtgggcgacaaaacggacgccgaggctgacggctgtcgagccgaagaagcggaagaggttcccgcgccagaagtcacgttccttgatgacgtcgttttagacgaagccggttgaggttgcaacagcgtggcgggtaccgtcgacggcgtgcccgacacctgtttctctagccttccctgaaccggcgtcgacgtcaccgtctgcgctcgggcggacgcgtgcggcgtcgcgactcgcttgcccagcaccggtttctggctcgtggatgtcgtcgtcattggagacgataacttagctttacgtattctggacggcgtcgactgctcgggcgtctgactgggaggcgaaatgacgtcgttgttgtaatcggacgacggtgttgtgtgtcccaggctgacgacggagccggtgtccgaggagtcgtcgtcttcctcctcgctgtcttcgaccggtgactctgcagtttggtcccttaaagcccaaacctcatcagcggcgtcccgagacgctgtttgtgtcaccgcggcgcgtggagtcgacggcctccgaggggtggtggacacggtgttttgagaagccgtggaagtcgtaggcatcctgaagggattgtaagccaggtgaggattcttgagggcccacgcgcgttcgcgcggccagttggcggggttcatatccccgggcaacggcgccgtcggagcccagggcgagttaccgttgaccggggtttgggtacccgcgaaggtaggtgtcggggccggagcgggggccgtggaaggattgacaggcgtcggcgtgaggatggcagcgccggcgccagcaggaacgttaactccggcgccgaacgtcaacgtcggttgctcgaacttgtacgcggtggtgacgggcggtttggcgctcgtctcggtatccgtgatgtccaccagcgtgtcggtgaaacgcggatcttgacggttggggggatagccatccgagctgtcggaatcctcgtcgcccgagaaaagatcccctctggtctccgtgagcggcctcacgtcccacgcgctgtcccgacggacccttcccgggctggccttggtcacctgcggggagacgagactgaaagccgcgtgacgctgttgttgttgcgggatgttcaagggaccgctggtcggtttctgactgcccgaggataacaggccgctgaaaatgctggaaacaccgccaccactagcggcgcccttgccgctagttcccggtttcttgatgggcgtaaagatgtttttctcgtcatcatcatcgtcgtcgtcctcatcggcactggagccaaagagcctccgggaggcgctcggtttacgtgccgggggcggtggttgctgctgacgttgctgcaggttctgctgcctctcctcccaagccttcagctgctgtttctcacgctgcaccacctcgtcgtccacccgtttctgccgctcgcgacgcttttcctcttcgtcgtaatagccgacggccgccgaacgggcagcgtgggcttcggcggccggtgccagagaaccatgggcctcgaagcggaacggtttgtgtcccttccagggactggcgatccagctccagccgtccagcggctgcgtggggacatgtttcttgggtaccgacgagaaggccgaaccgccgccgagcgagaggagattggcgtcatcgtcaaactccaacgacggcgagcgcgcgcccaaaaacgtgtgcgccgactgtgggaagctgtccacgtagatatcaaagtcctcgatgagcagctccaacagcgtgtcggccgagtcgccgttttccacggcgtgcttgaggatattgcgacagtagttggaatcaaaggaaaggcacatgcgcagctccttgaccagcagcttgcagcgctcctgaatgcgcgccagacatttgcgctccagctcctcccaagacctgcgcacgttcatgatgagacggcccgtgtacacgagcttgttgacggcgttgaccagcgccgtgttggcgtgccggtccaggttaaggtcgagcggtttcacgcagaacatgttacggcgcacaccctccaggttttcttcaatgcgctgcacctccgtatccttgaggtgcacaaaggcgatgggttccgtctggccgatggctgtgaccagcgtctcgcgcaccgacatcttggccagaatgaccgcgcttacgagcgcgcgttccacgatctcggcatcgtggcgcacgtccgtatcgaattcggtacggtctagcacagccaggtggtcacgcgccttaccacgatcaccgaacgggtaagtgtagccgcgacgcgccacggccacgcaacgcacctcgaactcctcgagcactgaggagaggtcggggttgtgaaaacgcagctcgcggtagtatcccaaccaaagcatgagctcgttgaacagcaccgtacgccggtgcaggcgtttttcgccacattttttcaggatcttggggtgtgcctcgagatccacgtcgggcttttgcgtgagatggcgcagaaagttgaccagggctaccacatcgcgccgctgtagaccgataaactgcaaactcatgctggcttttctccagaacccggaagcgtcgtcgccccggactgcgcccgcggtctgctattcgcccacgatggacaccatcatccacaactcggtgagcgccccacctagagggagggggggtagtttaatagcggaggcggatacgcggttttcttttaagcgccgctgacttgtttcttctgttttttcgccccgtgtgctgttccgcccagacccgcaacaacactcctccgcacatcaatgacacttgcaacatgacagggccgctattcgccattcgaaccaccgaagccgtactcaacacattcatcatcttcgtgggcggtccacttaacgccatagtgttgatcacgcagctgctcacgaatcgcgtgcttggctattcgacgcccaccatttacatgaccaacctctactctactaattttctcacgcttactgtgctaccctttatcgtactcagcaaccagtggctgttgccggccggcgtggcctcgtgtaaatttctatcggtgatctactactcaagctgcacagtgggctttgccaccgtagctctgatcgccgccgatcgttatcgcgtccttcataaacgaacatacgcacgccaatcataccgttcaacctatatgattttgctattgacatggctcgctggactaattttttccgtgcccgcagctgtttacaccacggtggtgatgcatcacgatgccaacgataccaataatactaatgggcacgccacctgtgtactgtacttcgtagctgaagaagtgcacacagtgctgctttcgtggaaagtgctgctgacgatggtatggggtgccgcacccgtgataatgatgacgtggttctacgcattcttctactcaaccgtacagcgcacgtcacagaaacaaaggagtcgtaccttaacctttgttagcgtgctactcatctccttcgtggcgctacaaactccctacgtctctctcatgatcttcaacagttatgccacaaccgcctggcccatgcagtgtgaacacctcacactgcgacgcaccattggcacgctggcgcgtgtggtgccccacctacactgcctcattaatcccatcctgtacgcgctgctgggtcatgattttctgcaacgcatgcggcagtgtttccgcggtcagttgctggaccgccgcgctttcctgagatcgcagcagaatcagcgagctacagcggagacaaatctagcggctggcaacaattcacaatcagtggctacgtcattagacaccaatagcaaaaactacaatcagcacgccaaacgcagcgtgtctttcaattttcccagcggtacgtggaaaggcggccagaaaaccgcgtccaacgacacatccacaaaaatcccccatcgactctcacaatcgcatcataacctcagcggggtatgagctttcctgttactttattcagaaagcaccagaacccgtcgccatttcccctcatatacggtacacgtccccctgatctgtcatcacggtacacagatttcgcccgactgcggacgccgacggccaatcgcgtggcgtaggagtggcgccccggcttcattataacgccacgtcggagcccctgcgcgccacaacgccgtccggcgcaacttctgtctcggcacggtacgataaaaacaacgtcccccgtcgacgttgttttctccgagcggtgatcgttcccgtccctctcctccctccgcggcccccacggcggcggcctgctcgcacggacctatactattaccgccccaccgccgtcgtcgtcatgaacttcatcatcaccacccgagacttctccaacgacgattcagtcctgcgagccgccgagatgcgtgacaacgtggcaggctcgatttccaaagcgtacaagggcacggtacgcgccgaaggcaagaagaagctgctgctgaagcacttgcccgtgccgcccggcggctgctcgcgccgcaacagcaacctcttcgttttctgcaccgagcgcgactaccgcaagttccaccagggcatcgcacagctcaagcgcgcgccggccgaactggacccccacgagatccagcaagtcacggccagtatccgctgccgcctgcagcccagtctccgcgagccgcccacgccggccgacgagctgcagacggctgtgtcgcgcgtgtgcgcgctcttcaaccagctggttttcacggcccagctgcgccactactgcgagcaccaggacaaggtggtgagctacgcgcgcgacgagctgactaaacgctgcggcgaaaaatcggcgctgggcgtggaagtgcatcaactggtagccctgctgccacacgagcgccaccgcgaactgtgccacgtcctcatcggcttgttgcaccagacgccgcacatgtgggcgcgctccatccgtctcatcggacacctgcgccactacctgcagaacagcttcctacacctgttgatgaactcaggtttggatatcgcacaagttttcgacggctgttaccacagcgaggcctaccgcatgctcttccagatcggtcatacggactcggtgtcggcggccctggaactctcacacggcgcggcggccgggccgcccgaggccgatgaaaacaacgacgagggagaggaggacgacgacgagctccgtcacagcgacccggcgccgcttcacgagtccaagaagccccgcaacgcccgtcgtccccgcacacgcgtgccgcctcacgagcaaaagcccgaagaaaacgaggaggaagaagaggagctgtttccctcctgcaaggcaaccgcagcattcctgcgggcagaaccctccgtctccaacgacgacggcaacggcggcgaacgctgcgacacgctagcgaccgccctgcggcatcgcgccgacgaagaagacggacctctagccagccagaccgctgtgcgggtcgccgcgaccccctcaccttcagtcaccccagcccttacccccgtcacgtcccccataaccccgttgtgtatttaacgtcactggagaacaataaagcgttgatttctcaagttccgctctggttttggtttcgttttcaaagggagccccatcatggcccaaggatcgcgagccccatcgggcccgccactgcccgttctccccgtggacgactggctcaactttcgggttgatctatttggggacgagcaccggcgcctgctgctcgaaatgttgacccagggctgctccaactttgtggggctgctcaactttggcgtgcccagccccgtatacgcgctggaggccctggtggacttccaggtgcgcaacgcttttatgaaggtaaagcccgtggcccaggagattatccgtatctgcatactcgctaaccactaccgcaacagccgcgacgtgttgcgggacctgcgcacgcagctcgacgtgctgtactcggatccgcttaagacgcggctgcttagagggctcatccggctctgccgcgctgcgcaaaccggcgtcaagcccgaggacatcagcgtgcacctaggcgccgacgatgtgacattcggcgtgctaaaacgagcgctggtccggctgcaccgggtacgcgacgcgctggggctgcgcgcgtctcccgaggccgaggcgcgctatccgcgcctcaccacctacaacctgctgttccacccaccgcccttcaccacggtcgaggcggtggatctgtgcgccgagaacctgtccgacgtaacacaacgtcgtaaccgaccgttgcgctgcctcacctccatcaaacgcccgggctcacgcaccctggaggacgcgctaaacgacatgtatctgttgttgacgctgcgacacttgcagctgcgacacgcgctggagctacaaatgatgcaggactgggtggtggaacgctgcaaccggctttgcgacgcgctttacttttgttacacgcaagcccccgagacgcggcagactttcgtcacgctggtgcgtgggctggaacttgcgcggcaacacagcagtccggccttccagccgatgctgtacaatctgttgcagctactgacgcaactgcacgaggccaacgtgtacctctgcccgggatatttacatttcagcgcgtacaagctgctgaaaaagatccaatcggtctcggacgcccgcgagcgcggcgagttcggggacgaggacgaagagcaggagaacgacggcgagccgcgcgaggcccagctcgatctcgaagccgatcccacggcgcgcgagggcgagctctttttcttctccaagaacctgtacggcaacggtgaggttttccgcgtgccagaacagcccagccgctacctgcgccgacgtatgttcgtggaacggcccgaaaccctgcagatcttttataacttccacgaaggcaagatcaccaccgagacgtatcacctccagcgcatctatagcatgatgatcgagggcgcctctcggcagacgggcctgacacccaagcgcttcatggaactcctcgacagagcgcctctgggccaggagtcggaacccgagatcacagaacatcgcgatttatttgccgatgtttttcgccgtcctgtgaccgacgcggcttcttcgtcgtccgcgtcttcgtcgtcgtcctcagcatctccgaattctgtttcgctgccgtctgccaggtcgtcatccacacgaaccaccacgcccgcgtccacgtacacctcggccgggacttcttctaccacaggtctcttgctctcttcttccttgtcggggtcgcacggcattagctccgcggacctggagcagccgccccggcaacgacgccgcatggtcagcgtgaccctcttttcgccctactcggtagcctacagccaccaccgacgtcaccgaaggcgacgcagcccgccacccgcaccccgagggccggcccacacacgcttccagggacccgacagcatgccgagcactagctacggcagcgacgtcgaagacccgcgggacgatctggccgaaaacctacggcatctctgaaagcggtttttcctctttttctacgtgtctgtctcaagatgagacgtcgatatcaataaaaataccgtcgacgtggtttttttaacagtgtggttttctttattgactagcgaagtacacagtttacgagtagaaaagacagggaaaggttatataaaatgctgtattatatacaaaaacatgcacataaacaaacgggaccatcgtgctcatcatcccctccttgatcagttgttcatgtaaacgtgtggcggggtgaggggcggcatgccgttggcggcgccgggaataatgtgccgtcgaccgacgtcgcacaccttgaaacgccgtcggcgcacgcagcggtcgcaggacgggatatcccagaggaagcccatgtaggtctcggggtcctcgtcgtgaaagcggtaggagagttcaaagtggtgcaacgagcccgtccgagctcgcagcttctggcgaacaccctccacgtcatcggtgcacagcgacagtgctgggctgtcacacagggcctgaagctcctgcggccacaggtgcgtggccaggggcgagtccgtcgtcaccagtttgacgcagtgcatcaggttctcggtgatggcgtcgtacaggcgactctcagcctcctcgtgcgtcatcacgtttcgaggcagcgacagctcgtcgtcgtcatcctcgtcaaacatgatcatggggtcaggggtttttttgggatgttgacaggtgggtgtcttttccagacgcacgatggcctcacgccggccgctgaaacggtggtttcggtgtcccttctttcccatgacgcaggtgaacataaccacgtcctcggccaaacggtagacggcgtccatggcggggtcgtagccgtagacgacgccgaaagtgtccaccaagacgtactggcgtacgaggaactctttgcgttctggcacctcgtggcccagcgcgcccaacaactggtggtaacaggtgatgcgcggcacggtacggatcatgagctccatggtctggatgctgccgcccgcgcggacgacgctgaaggatgtttccttgaacttcataacctctgtgttgtgggtccagaaggcgaaatgggtgtcgggacactcatcgaaagggtcgtcgatggtgtaggaagcgtagcctcgcttggtcacctcggccgacaggctctccacgtcaccgcggtagagcatgacggcgttccagtagtcgtcgtactgcaccatgggccgctggtagtcgcgcatagtgtggaagtggtcgcggtgacgaaagccgttccgcagaaagtccttcatggtgggtgccagctcgtagacgcagtcgcgcaggtcatcgtagcagtagatgccgccgcgctgcccgatgagcacgatgagttggtagcgcataaagcccggaccctcgacgaagccaaaggggtgcaggtactcctgacagcagacgtaagcacctggtagagaatagaaaaaatccacgcacgttgaaaacacctggaaagaacgtgcccgagcgaacgtcctctttccaggtgtcttcaacgacgtggggcttaccttgcgaacagacggtgcccatcttgcccacgaagggccccagggcgctgcgcgaacggagctggatgaagcagcgttcgggccaggccacgtgcagccgggtgccgcattcctgctccagaaagtcgttgagaccgttaaagtccccggctcggatggcgatgcagccgtaggccatcagcgtgtcccgtaggtcgtccatgacggactcctctaccttcgctcgccgacgctgcgcttctccagccaccgctgcggtcgacagactcctccgtccgccttcggagaactacggcgcggcggcacggcctttatagacactatcagcgttgacgtcagacgatccgatgaacgtcgttttttgtgctggaacttccctcgtcccgacaaatgtagcggaaatcttcaagcaaatcgcgacgaagtccgatgaggaggatgcaaaagaggctgagcaacgcgatgctgcccgccgccacagtacatatgctcaacaacgcccagtgtcccaaggcgcgacttttggctcggaggagagccgaacggcggtttctccacatgacggacaacgtggtccagtacgtccatcctttgcattccggtgtccagacgggaagcgttgtcatgttatttcccgtaactgtcacgttatgttttgttttgtttctcgtgagcttaacggtcctcttgagaaatcgcgggcacatgtcttgtagaaagatataatcactttccgcgtatttcgtcagtgttgacatcacggtggtagtgttttctgaagaagtagcgttgtcagtgacgtttgtttcttcccaacgtacgtatgattcgaacggactcgtgtgcgctattgcccgcaacacgtagctgtggccggtgaagttgagcgtcagttgtcccacggtcacgttcgtgtcattcctaaaacatgctacttctccgtgaacttccgtgacgtttatctcacgactctcgttcaagacacgcaggggaaaccagccttccaggtgatactgaaaaccaaatttaagcatgacgctgtgccatttccgtcgtgattgattaaacgttacattcaagggcagtctggcttcggtcccgagacaggggccgttgtagatttgcgtgtgattgcgtgtgcagtttaggtggcagttcatgctcgtggtgttggaagtgcgattaacgtccgtaccgtggtacgtacatcggaccgaaacaccgtgtcccgtgctccaaagcagcgtcaacaacagccacacagaaacctacgtggagacgacacgggactttttattgacggagactcacgtttctaccctcccctttcccgtaggtaaaaacccacgtttatcacacacgttgtttttacctgaaacccgcgcagcccgtggacgcgacaaaaaaccgcggcactagaaagaaaatgaaacaagtatgtttattaagcagcatgtggggctaataggggggataactgaggtatagcaactatgaaaaaatactacaaaaaaaaaagctgaacatggtcatctagcagcaaagttctccttctagaccacgaccaccatctgtaccacgtcgccctccccggccgtgtacacgacatccttcaccacgaccggcggcagcggcggcgacgaggacaactcgctctcgacggaggccgggacgacagaggacgggggggtggtggcggcggaggacgaaggggtggcggcggcagcgggatcttcttccgacacgggcaacggcaggctcggcggcgcggacagcacccgttgcgccggggcgtgagaaggctgagccccggtggcctggatgtgggccaacgaattggctcgcagcgagtcgcgatccacgaaggtcataggaattttcccttcgcggatccgccgctcagattccaggatggcgcgcacgtagctgttcaccgacttggcaaaagtgcgcggcccctccgtattcttgtcgcgacgcgcttccagcacctgcttttcgtagtccagctggtggaagaccatcaccaggtcgtccatagtgtgcgcgtgctgacggacgtgggagcgcacctccaccgggaacaaagcgttccaatactccagcacgatagcaccgtgccagaactgcgccatgctgggcgccaggaaaaacaggataccggagtcgtaggcgaacacgtcccacttgggcgtcatgaacaacaccagctgacgcgtgggccgcaccgaagcttcctcccaggcctcgatgaccccgaacatgatgagctcctggtccaacggggggcagtgtcgctccagccaactgatcttgctcaggttcatctgcagaaactcgtacgaagggtcgcagatgcacacgtagagacccgagtcgtgccgcagcctggctccgcgcttcatcagtttcctcaccgcgtagcgaagcgccaccttgcccaacgccgacgcctggatcagtccccccacgtccatctgcgtctgtcgccactcggcctcgtccagcaggctcatgatagcggcagtgctatgcgtggtcgtagtcatcctttctatccttctctatgaatagcagcaatagcggtaaagtcccttcttatactatcccggagtctgtggtttttttgtttacccctgcttactggtgagactgctgggggccgttgtgctgcagcatccgagctcgttgccgccgttgccacaggaaccggtgtctccgcagggcctttttgagggcttcgcaggcttctcgcgcaagtcctgagaggccctcggcgtcgatggggttcacctcgggcgtccgagcctcgttttcttcttcttcatcctccctttcctcctccgtgtcctcccgctctgtgtcctccgttacgctctcctccccggcctcggccaagagcgcggccaccaagtccacggaccgctcggtctccgagttctcaccgtcaattacgccatgttggcggcgtaaccggtgccgagaacgccgggtgagcgcacatgcttttttctttcttaaccaaggcgggagaggatcttcaaggcgttttcgctggatccagcggtagctaaagtaccaaaaggccagcaggcccacgctacctaacagattcacgtagactggagacataattaaagaaagaagtgaaacccgcgtgtgggtctcacgtcgtcttgaaacaccgtcttatatacatgaagatgccggacatgacgcgcccaagacacgtggggttttccccttaggcgacccggtttcttaagatgtttttcatcttcgcacgcgatgtactacatcaaagggtcggctgaccgaccgcattgacgcacagtttccgagtacgcgcgtctcggagcacctgacggtgagccacccaactcacgcggataggggacaacactgacgtgaggggcgattcacgtcactgacgggaataagacgggtgagggatttccacctttttcttaagtgtgactctctttacggtaaatcgcacctgtgacctcttaacccctcctccctggtacccgataaccgtgaaaaacacacaccacacgtcacgacaccgatcgattttctttattcttagtgtgatgataggtaagggcactcgtgaggatgtgcaattatcattatcaagcctttttcaaggcgtagtgatgatcgttgggcagaacccccaggctcctagcgatctgggaatagaaggaggagaacgagcccagggccagaatgcccacagtgtacatggcccaggtctccagaccgaacgtggcgggtcgcagcttcagatggtaggccacccgctccgagagttgtgaatgctcgttcaggcaacaggactgcaggtgggtgagcccaaaagcgctttcgtttacgccgcgcacgtgcaccgtctgggccgggcaatcctggtgttgcgcgcgaaagtggtcctgacaggaaattccgtctacgtggcggcgcgtgttgttacccacttcgatcaacaacgtgttatcggcaggatgatgcgagaacgcgacgacggtgttgttggaggtctggcggcaacagtacacgtcgagcgtcatgagggccatgtcgccttggtggtacacggcgtacgcccaaccctggaacacgagcggacataacggaccgtgagcggacgtcacggcggcggttgttaccgtcgtctcggcaggagaacacaataaactcctgatcctcatacacaggagtccaaccgtcagaattaaagtccgcggagccataaccgcgcaagtgaagccgatacgagtgttgctgaatttgttcattctgccgactgttgctcacgagcgttcggaggcggtgccacaggctgttggccattaaaaagtcctggcccgaatgacgacaagacagagcccgaggcgaagaaaaaggcgcccgtcatgaagacgtaggcaggggaattcccatatttttatggcttcttttaaaagtctgtatccgactccatccggcgcttttcccaaaccgtggtctcctcgtcgtccgactcggtacccaggaggtggtaagtcttttgccgcacgtagaaagctttcaacgtggagcaaaagatgagaataaagaccccgaaaacgaaacaaaccacgccgatcatgccgatgcagacgttcatgtcgacgtagccggcggtgctgttggcggtgcggcaaaagagtgtcatgtcgtgcgtgcacaaaaaacaacacacaccacaggccaggtcgtagcgtagttattattccgtagcagcaatgatggtacagtcaagcacatgctctatccccgttaccccgatgatgcttgcgtccccgttgttatattggcactgtcccggttaatcaccacggtgaacaccacggccaagaaaatgatccctaatatagcgaccactaagagagcaaaagtccatttccagccgttgtcaaagtacgcccccgtggtgggatgcatggtggcgggcatttccatcatgtccatgtcgaacgtgtgtcgcggcgacggcgaactaaccaggcagtacgggggtcgatagggcggtgggctgcagtcgggtggtggcggcggtggcgtggaaaccgtcgtcgggcacagacccatggcctgctcgtaggtggggggcgcgtcgtcgtgatcccggtcgcggagcatcggcgtgggctccatgtcggtggcagtgacggcgacggtggtaactgtggtggagacggtaccgacggcgtccgcggttcaccttcgagcaaagagccccttctttttgcgcaaacgacggcaaaacagttctctgggacaaccggtggcgcggtaagcgggtgccacgctttcagggtgggtaaaacagtcgcgggcgaagcagtagttgttgcagaaccgcaagaacccgacgcgaaagaagcccaggagtccgcgcgccagaaagtgcgcctgccgcgtctcgggatgcacgccgaagacggcgccgctctcgttcaccagtatggagatgtccaggcgctgctgcgactccaccggcacggcccgcaccacaaatacctgcagcacgttcagcgagcacgtctcttttaaccagttgccgtgggccggatcctcgtaagtctggctcccgttcaagacgaccgtcgtcagcgcctcattaccgtctcgccagctgaagatggaaccctcgcgcttcatgcacaggcgccacaaggccagcaggtcgcgcgccaacatgaactcgcgacccacgtcgccgccggtctcgaagcggacatagcccagttcttcgcgcagcggcgcgtagttgcgcaggccctcctgcacgaagccgcggaaaccggaccgcgacaccaggtacagcgattccaccacgggcgagtagacgtagacgcgaccgccttcgccgatgagtacgggtagcggtgggcggccgatggcttcgcaacgactcacagtgcccaccggcagcaggaacttgtcgcagcacaggaaggtcttctccaaacctttaatattgagatgtccaaagtaaccaacgcgtaacaggtcgcagtaggtgaagaaccaaccgtttggccagctgagacgcagcaccgtgccgctgacgcgacgaaccagcttctgcaggtccttgcgagcgtcggaggtgacagagcagcggaaggtctcgttaaccagctcgacagccagcgcgtcctccagcgtgcgttccttcatctcgtcgttgatgctctgacggcgccgccggatttcgtcgaaacgggccgcggaggcggcgaccgacgcggaggtcgtccgaacgccctctgtgacgctgccgtccggccagtcaagaaagctaaggctggcgctgcgccgcctaaagtgtccgatccgcgcgggacgtcgctgagggacggtggctggtctgctggggcgggtacggccgcgggtgtccgcggacacgttagttatacacggaattgagtcacgtggcacgttgccagctgaaaccgccgtcgtctccgccggcgttttctccatcacgggaccgcgccgtgcgcgcgttcccaggcacgcggcccgcgctctagccgcacttttgcttcttggtgttagggacgaactcgaacgttacagaatcctcgctgtcgctctcctctttcgcgtcgttgaagtaattgccggagttgcgatccaaaccgccgcctcctcctcctccgccgccgcccgatccacctttggacgtcaggtagctggtgatcttgtgctgctcgtatttttccttggaggaaagaccgtggtcgtgatcaccgccgccgccaccgctgctcattttccgcgtaccggaaccaccgccgccaccgcggtcgtgcttcttgccgccaccgccgccacctcctcccagaccgccgagacccatgggctcgttcatgagatcgttatccagacccgggccgtcgtcatgcagaccgccggcattggccagcgaagagaggctgccgccaccaccgccgccgccacgcgacttgccgctgttcccgacgtaatttttgtcgaagggatcgccacgctggaaaggttcctcggtgagaaaattctccacggcgaacagaccgttgcggctggccacgtacaacagcgtgtcgtgctccgtaactatacgcaacgtgcacggcagtttggtgacggcgcaattgagcagcgtctggtagaagttcttcagctgcacgttgatacgcatgtttttcacgccgtggaaactgacgcggttattggctgtgaattccagctcgctgccgttggtcaggataaacttgatggccggtggaccggcgtgcaccagaatctgcacggtgcccgtagggcagggcgcttttttaacgttacgcttgacgcgggtatgcggcccgatccacttaagcaggtcggccaccacgccgaaatctagatccacgtgcacggccgaattctcgctttcgcgcacaatgtcttggccgtgcacgcaggccgagctgaactccatattgaaatcgggcgcgcacatggagatcttggccgacaggtccgagatgtcctgcacgtagaacttggtcaggtccttgctggaagtcaggtacatgaaattacccagcagcggcgtggaattgttaatggtcttgggctgaaacgacttgtcagtgatgtagaggcatgagctgttaaaagtgatttttgacacgcagtgactgcgtaccgtttgcaagataagcgacggcgtgggcaagaaggtaaccgtggtgttctccttgagcgcacggatcacagatcgcagctgctggatagccgtcttgtacggcttcagccgcagcgccagcgtcggcggctccgagaggcgcgtcttgcgatccatcccggacagcgtgcaagtctcgactaaggagcgggcgcgagcgagcgaaagttttatagagagcacacacgacgaccgggaacgctgcgaagacgcccggcgtctaataatacagccgcgccgagccagcgggcccccgactaagaggcacagtacttatatactccgaccttaaagcgccagtggtaccacttgagcatcctggccagaagcacgtcgggcgtcatccccgagtcatagtagaaaaccagggccacgcactggtccacaaacacgctcaggttcacggccgccatttccacgtcgttttggatcgccggtgccgcctggaacagacactgcgtcgccttgccctcctcctggtgctgctccaaccacgcgtaattcaccacgggcacgcgcagcggcctccgcaccacggtggggaagtaacactcacggttgggcgggcacaatgaccacaccgtctcctcctcgaacacggtgccgcgcgaagcccacactgacggcgtcacgccccacagatgcgccacctcgtcgtcgggacccaccgccagaaactgacagttgcgcaatccgaactcgagcatgtcggcgcgcagcgcttcccagcgcgcgctggcgatggagagccgcggcaaccgatacaattcgaaaatgaatttgccctcttgatagatggtgcgttcgaaccactcgcagcgcggcaaacccgacttgcacaaatcgacgctagcgcgcaccgcggcaaagtacatgtgctcaaagatgcgctcgatcaagtcccaagaggcaaagtacgtgaaccctaaccgcatgagcgccgtgtgcaagccagccacgccgatgtgcagcggacgcagtttttccagcgcgctctctacccaccattcggacgccgacattagcgcgtccaagcgcgcgttgccccaaaccaccgcctcggtcaccaactcgcgcagcacgctcaaatcaaagtaacgtcgcgtgttccccaaaaccacgtcgggtagatgcagcttctgctcgtcgctacgcgcaaacacgcagcgagccacgttcaccgtcagccgctgcaccggcatgtcacactcgccaaagtggcacgacgccatatcgggactcaagcacggcggcaggcacacgctgtcggccataatcgagtacttgactacgtgatggacaaagaccaccgaggcacggcccttgagcgcgcacagcaacatctttttcagaaaatcgtccgtgttcacgaccaccttggggcacgattgctcgcagcgcgaatactctttctcgaaagccgactcctgacccaggtccgagagccgccgggagacaggccgcccaaacagcgagtagcgctgctcacgcgcacggtagcgcttcattaacacgctaggcacgttgaaagcgtagcaaacccccgtcaactccgacgtgctttctttgagaataaagttaatcacgcggatagcggccacgtcccacatgtccacaaacacacgtaccacgggtcgatgcacctccttctcgcgtatcaaatcgcagtatccccccaggcaacgaatcacgctgttcacatcggcgttaagtcgcgttacgttcaccgacacagaaacgccgcaactcaaggtactcatccacttgcacatggccgcccaactggcgtcacgcgagaaagggtcggccgagatcagaaagtcgtactgcggcacgcgatcgaaacccacggtagacatggtgaaggtggacagcgacagctgcccatcgcgacagcgcttcaacaccgattccaacacctcgccctcgaaacgcgcatccagatggaaacgatagatgcgcgagtgcctactgttctcgatagcggccgtcaacgccacggcgatgcgcaaaaacacgccgcccgggctctcgtcctgtccgtgcagttggcgacacaccttatccaaacacaaaatggccgcgtacaagccccagcaaccggccaattccacaaaacgcgccgtctcctcggccagcttgggtagatcctccatgtgacgcagcacaaaacggcgcaccgactcatcgcacagctccgaagcgtaacacagtggcgtgcggctttcacgcgcccagttggctttgaaataaaagcgacccaacagcaggtcgcaacgcggcgagtgacgaatcagacagggaccgtggcgcataatgagctgaaatagcctgaaactgcccaaaccggcactgtgccgcgacacggtgtccatctcgcgccacagcgcgttcctgtcggacggcagctcccgcgccggctcctgtacgccgcaaaagcgaaacttgccccagtagccgtgacaatgacactttttgcccatcaacatgcgcgtagcttgtatcggcggcgatactttgcagagcgaagccccgaaatcgtcctcctcctcgacactgtccagctccatcctggtcgcgccggccggattaaaggtgctcagaccgctactcacgcgtccaccgcgactgggcacggcgggaccgctgtcacgcgtcaacgacagcacagacggcgtgccgtcgggagacggcgactcgggacgccaactgacgacgccgccaccactcgtaaaacccgctacacatgctacaccgctcgatacgttggtatttccagcggacgcttccttgtcacccccgggcagcggcccctcctcgagctcgctgtcatctcccccgatagtatcagcggcgacctctgccgacgattcctccgtctcggtttccgcgctgcggcttggaatcctacctggccggcaccgatgtgcgggcaccgaggacacccgctgttcctcgtccgcgtcagccggattcataagtttacgaggaaaataacaaagaaatcaggtagatttcaataaagtgagtctagatggcgccgacaactacggtttataaagtctgtgtgcgatgtgtttttttcttctgtgtctcctccccgtatgctgtcagcgccgctcagacgaattctcgaaagtctcccaattcgacgctaaagttgtccaaacggacgacggacagtttgagttctttgtgtaccaggaacgaggtgtgaatgtcgtcagccaggcaccagcccagcttttgtatgaccccggtacacagagggatctggcgcgggcgcgtgatgcgacggttgacaaagctacagcgctcgcgggcgaactttccgcgtgcaacgtcgaccaaggtctgccagtgtgcgatgctggaggtgagcacgtagatgccgggacgtgtttcgggcccgtcatagtcatagacgatgattaaatacacgtattgcagccgtccccgggtctcttcccacgtcaggtacatgtctttcggtatcatcaacgcgaacacctccgttttgagcgtgttgtaaaggtagccgcgcatgacgcaggtgagcaacgaggtgatgcccagcgagacggtcttgacgcagcccagcgtctcgaggcggcggtgcagcagatgcgggcccaggtccagccactgcagcgcggcgcgcgcggccgaggccgtgtacacgctttcgagcaggcagcgcgtgctggccgagacgttggaggcgcgaatgcctaacaggtaaaggctaatgtagaggtgtcgcggcgagtcgcaacccgtctccatgcggatgagcagcgcgcccggctgcgcctcgaactctaccaggccctcgggcacgaagaaacgcgccgtgagcgcctggtgatcggcgtggtagagatagcgaaccgatatagtatttacctcgcgtttggctttgagcgccgtcactagttcattgtcctcgtcggccgggtcgcgcggccgtttggccaccgcgcgcgcgtccatgatggcgaggcgcacggtagatttcaaaaagttgatagagcagctgcgggcacgggccacggacaaagcggaggcgttaaataccgtgagccaattggagatcggcgcggtggatgcccaggacgtgaccgcgagcgccgtgcgcgccttcgtgggtgcgttgccgagctcgggctaccactttggcttcgtgcgtcagaacgtggtcttttacctcctaagccacgccacggtacagacggcgcgcgacccgctgtacgccgccgagcagttgcacgaacagctggaccgcttcctgcgacaccagcacgacggcggcggagacgaggaccggttgccgttctaccacaacggggccacgctgacggctttccagaagctgttgcagaccctgcgcgagatccagaccgtaatagccgaacagagcggcggcaccgcggcggcggcggacttgatcgccagtaacaacgcgtcgaccgagcgccgcggcaagaagggcggttcgagttccgggggccagcagccgctggtccgccgggtgatcacgcagctggaaacggctgccacggaggcgcggccctacgtcaattgtcgcgccgtggccgaactcctggacctgacctaccagcggctcatctactgggcctgcacgctcatgccctacgtgttgtttcggcgcgacaccgacaccgaactggacacggtgcttctgatgcattttttttacacacactaccgttcggttaacggcgatttggccgtggagtttcaaaactacgtcaagaacagcgtgcggcacatgagctctttcgtcagttccgatatcgacggcgaccagaagcccggtgccgaacacatgcgtgacgtcagctacaagctgttcgtgggtaatctgcaagcgcgtgacgccagcggcctcatgtttcccatcattagcacgcgcatctccaccgtgaacctttacctgtcgcccgaacgtatgtttttccacccgggtctgatctcgcgtctgttgagtgaggaagtttcgccgcgcgccaacctagacgcttacgcgcgcgtgtgcgatcgcgtgctggaagaccacttgcatacgccgcgacgcgtgcaacggctactagatctgacgcagatggtaatgcgactggtggaactgggtttcaatcacgatacctgcgcggcctacgcacaaatggcgctgatccagccggccagtcagaagagctcgctctttgtcagcgagattcgcgagaaactcatacagatcatctacaatttttacacgtttttcatgtgcctctatgtgtacagccccacgttcctgttcgaccaccggcggcggttgattttggagcagcatcgatccacgttgatcggctccaaggaggaactacagcacgtctggagcaacgtgacactgaacgtcaatacgcactttgcggttcagtacacggaagaagactttgaggcacatacgaagggtgccacggaggcggagcgcgagtacctgtatcgggacctgcacagcaagtggggcgtgcacctgtttaccttgcgtccgtctcgcggcgcggccggcgcggcctcgcctttgcctccgcttgacggcgtcacacgctccgacatcttacgcgaatgcgcgctcgttaatctgaacgaaggccgcgtcaactacgcctccctgctagccttcagccatcatcccgagttccccagcatcttcgcgcagttggtggtggtaactgagttctcggagatctttggtatcccgcagggcctgtttcaagccgtgggttcgccgcgtcttttcgcactcattcagctgtgccgtgtattgttgcccgagcaggtgacgctgtaccagaacctggtctccatctacaacctgaccaccttcgtcaagcacatcgacgccgcggtttttaagacggtacgcgattgcgtcttcgacatcgccacgactctcgagcacctcagcggtgtacccgtcacgcccaatgtggacctgctggccgagctcatggcgcgctccgtagcgcataacctgtacaccaccgtcaacccgctgatcgaggacgtgatgcgcagcagcgccggcagtctgagaaactatctgcgacatacgcgactctgtttcggtctggcgcgtggccgggcgcgcctctcggaggacggcgtgacggtgtacgtggaggtacaaggtcaatacggactacgcgtacccaccacgcgtttcgtagaacagttgcgcgagctggttcgccgcgatcggctgttggccgagaatctgcgcggcttgaacgagcgcctgctgagtgttcgcgtgcgcgtacgtcagatcagcagcgacacagaggaagtaagccgacacgccaagggtcaccgcacggtggcccagatgagcaaggcgctcaaaaagacggcctccaaaatcaaagtgttggaaacacgcgtgacattggcgctcgagcaggcgcaacgttccaatggcgccgtcgttaccgcggtgcaacgcgcgctagccgtctttgacgtactaagtcgcgagaacttggaacgccgcggcgcacagctctgtctgacggaagcgacgagcctactgcaccgacatcgcgcgctagcgccgatgacctggcccgcgggcacgggcgttgcggcggcggccgaagcggatcgcgccttacgcgagttcttggaggcgccctgggaatcggcgccccaaccgccgcgactccgcatgacgcccgacaccgatcacgaagaatcaacggcaggcgcgacgtccgtaccggaggtcctgggtgcgcgctacgaacccgcacacctggccgcgagcgacctattaaactggtacatcgtccccgtaagccaggcgcagcaggacatcttgtcttcgatcgacccgcccgccggctcgacatcggtgtccctgccgccggcctcgccatgaaagtcacacaggccagctgccaccagggcgacatcgctcgctttggagcgcgagcgggcaatcaatgcgtctgcaacggcatcatgttcctacacgccttgcacctgggtggaacgagcgccgtcctgcagaccgaggcgctggacgccatcatggaagagggcgcgcgtctggacgcgcggctagagcgcgagttgcaaaagaagctgcccgccggcgggcggctgccggtctacagactgggcgacgaagtgccgcgccgcctggagtcgcggttcggccggaccgtgcacgcgctctcgcggcccttcaacggcaccaccgagacgtgcgacctggacggctacatgtgtccgggcatcttcgactttctgcggtacgcgcacgccaaaccgcgtcccacctacgtactcgtcaccgtcaactcgttggcgcgcgccgtggtcttcaccgaggaccacatgttggtctttgatccgcacagctccgcggaatgtcacaacgccgccgtgtatcactgcgagggtctccatcaggtgctgatggtgctcacgggcttcggcgtgcagctgtcgcccgctttctactatgaggccctttttctctacatgctggatgtggcgaccgtaccagaggctgagatcgccgcgcgtttggtctccacctatcgcgaccgcgatatcgacctcaccggcgtcgtccgagaaagcgcggacacggcagcgacaacgaccaccgccgcaccttccttacctccgctgcccgaccccatcgtcgacccgggttgccctcctggcgtggcgcccagcattcccgtctacgatccctcgtcctcacccaaaaaaacacccgagaaacgccgcaaggacctcagcggtagcaaacacggaggcaaaaagaaacccccgtccacgacgtccaaaacactggccaccgcctcctcctccccctcagcgatagcggcggcctcttcttcgtccgcggtaccaccgtcctacagctgcggcgaaggggccctgccggccctgggccgctaccaacagctggtcgacgaggtagagcaggagttgaaggctctgacgctgccgccgttgcctgccaacaccagcgcctggacgttgcacgcggcgggtaccgaaagcggcgctaacgcggcaacggccacggcgccgtccttcgacgaagctttcctcaccgatcgtctccagcagctcatcatccatgccgtcaatcagcgctcgtgtctgcgtcgcccctgcggtccgcaatcggcggcgcagcaggcggtacgcgcctatctgggcctatccaagaaactggatgcctttctgctcaactggctgcaccacggcctggatctgcagcgcatgcacgactacctgagccacaagaccaccaaaggcacgtactcgacgctggatcgcgcactgctggagaaaatgcaagtcgtcttcgatccctacggacgtcagcacggcccggcgctcatcgcctgggtggaggagatgctgcgctacgtggaaagcaagcccactaacgaactgtctcaacgactgcaacgtttcgtaaccaagcgaccgatgcccgttagcgacagcttcgtctgcctgcgacccgtagactttcagcgtctgacgcaggtcatcgaacagcgacgtcgggtgttgcaacgtcaacgcgaggaataccacggcgtttacgagcacttggccggcctcatcaccagcatcgacattcacgacctagacgccagcgatctgaaccgacgcgaaattctgaaagcgctgcagccgttggacgacaacgccaagcaggaactctttcgcctgggcaacgccaaaatgctagagttgcagatggacctggaccgtctgagcacgcagctgctgacgcgcgtgcacaatcacatccttaacggctttttgccggtagaggacctgaagcagatggaacgcgtcgtcgagcaggtactgagactcttttacgacctgcgcgacctgaaactgtgtgacggcagctacgaagagggattcgtcgtcatacgcgaacaactgagctacctcatgacgggcactgtgcgcgacaacgtaccgctactgcaagagatcctgcagctgcgacacgcgtaccagcaagccacgcagcaaaacgagggtcgcctcacgcagatccacgacctgcttcatgtcatcgagacgctggtgcgcgacccgggcagccgcggctcggcgctgacactggccttggtacaggagcagctagctcagctggaagcgctaggcggcctgcagctacccgaagtgcagcagcgcctacagaacgcgcaactcgcgctaagccgcctctacgaagaggaagaggaaacgcagcgtttcctcgacggactctcgtacgacgatccgcccaacgaacagaccatcaagcgacacccacaattacgcgagatgttacgtcgcgacgaacagacgcgtctgcgactcatcaacgccgtactgagcatgttccacacattagtgatgcgactggcgcgcgacgagtcgccgcgaccgacgttttttgacgccgtcagtttgttgttgcagcaactgccacccgactcgcacgaacgtgaggatctgcgtgccgccaacgccacgtacgcgcagatggtcaagaaactggagcagatcgagaaagccggtaccggcgcatccgaaaaacgtttccaagcgttacgggagttggtttactttttccgtaatcatgaatatttctttcaacatatggtcggacgactgggcgtcggacctcaggtaacggaactctacgagcgatatcaacacgagatggaagaacagcacctggaacggctagaacgtgaatggcaagaagaggccggcaagctcacggtaacttctgtggaggacgtgcagcgtgtcttggcccgggcaccgagccatcgtgtcatgcatcaaatgcaacaaacgttaaccaccaagatgcaagactttttagacaaggagaaacgtaaacaggaagaacagcaacggcagctactggacggctaccaaaaaaaggtgcagcaggatttgcaacgcgtggtggacgccgttaagggcgagatgctctccaccatcccgcaccaaccactggaggccacactcgagctgctcttgggcctagatcaacgcgcccaaccgctactagacaagttcaaccaggacttgctgtcggcgctgcagcagctgagcaaaaaactagacgggcgaatcaacgagtgtctgcacggcgtgctgacgggtgatgtagagcggcgctgtcacccgcaccgagaagcggctatgcaaacccaagcctcgctaaaccacttggaccaaattttgggtccgcaacttctgatccatgagacgcagcaggccctgcaacacgccgtccatcaagcgcagttcatcgagaagtgtcaacagggcgatccaactacagccatcacgggcagcgagttcgagggcgactttgcacgctaccgcagcagtcaacagaagatggaggaacaattacaagagactagacaacagatgaccgagactagcgagcggctagatcgctcgctgcgccaggatcccgggagcagctccgtcacgcgtgtacccgagaaacccttcaagggtcaggagctggcgggtcggatcacgcccccgcccgccgacttccagcagcccgttttcaaaacgctgctagatcagcaggccgacgcggcccggaaagcgctcagcgacgaggccgatctgctgaatcagaaagtacagacgcagttgcgacaacgcgacgagcagctgagcacggcgcagaacctgtggactgatctggtcacgcgccacaaaatgagcggcggactggacgtgaccacccccgacgccaaggcgctgatggaaaagccgctggagacacttcgcgagctgttgggcaaagccacgcaacaactgccgtacctgtcggcggaacgcacagtgcgctggatgctggcctttctggaggaagcccttgcgcaaatcaccgcggaccctacgcacccgcatcacggaagcaggacccactaccggaacctgcaacagcaagctgtcgagagcgccgtgacgctagcgcatcaaatcgaacaaaacgcggcctgtgaaaattttattgcacagcatcaagaggcgactgccaacggcgcgtccacgccgcgggtcgacatggtccaggcggtggaagcggtctggcagcgactggaacccggacgcgtagccggcggcgccgcgcgtcatcaaaaagtgcaggaactgttgcagcgcttgggtcagacgctaggcgacctagaactgcaggaaacgttggcgacggaatactttgcgctgttacacggaatccagaccttcagctacgggctggactttcggtcgcagttggaaaagatccgcgatctgcggactcgttttgcggaactggccaagcgacgcggcacgcgtctctccaacgagggagtcctgcccaacccccggaaaccgcaggcgacgacttcactgggcgcctttacacgcgggttgaacgcgctggaacgacacgtccagctgggtcaccagtatctgctcaacaagctcaacggctcatcgctagtctataggctggaagacattcctagcgtgcttccggcaacacacgagaccgaccccgcgctgataatgcgcgaccgcctgcgtcgcctatgcttcgcgcgtcaccacgacaccttccttgaagtggtagacgtcttcggcatgcggcaaatcgtcacgcaggccggcgaacccattcacctggtcaccgattatggcaacgtagcctttaagtacttggcgctgcgagacgatggtcggcccctggcatggcggcgccgctgtagcggcggaggactcaagaacgtcgtcaccacacgttataaagccatcacggtagccgtggccgtctgtcagacattgcgcactttctggccacagatctcgcagtacgacctacgaccctacctcacgcagcatcagagccacacgcaccccgcggagactcacacgttgcataaccttaagctcttttgttatctggtgagcaccgcctggcaccagcgcatcgacacgcagcaggagctgacggccgccgatcgcgtaggcagcggcgagggtggtgacgtaggggaacagagaccgggccgcggtaccgtgctgcgcctgagtctgcaagagttttgtgtactcatagcggctctgtaccccgagtacatctacaccgtcctcaaatacccggtgcagatgtcactaccctccctcacagctcacctacatcaggatgtgatacacgcggtagtcaataacacacacaaaatgccccccgaccacctccccgaacaggtcaaggccttctgtatcacccccacccaatggcccgccatgcagctcaataaactgttttgggaaaataaactggtacagcaactgtgccaggtaggcccgcaaaaaagcacaccgcccttaggcaagctatggctctacgccatggccacgctggtctttccacaagacatgctgcagtgtctgtggctagaactgaaaccccagtacgccgagacatacgcctcggtgtccgaattggtacagacgttgtttcagattttcacgcaacaatgcgaaatggtgaccgaggggtacacgcaaccgcagctccccaccggagagccggtgcttcagatgatccgcgtgccacgtcaggacacaaccaccacagacacaaacacgaccacggagccgggacttttagatgtttttattcaaacagaaaccgccctagactacgcgctgggctcctggcttttcggcatacccgtgtgtctcggcgtgcatgtagccgacctgctgaaaggccaacgtatactagtagcgcgccacctcgaatacacgtcgcgagaccgcgacttcctccgcatccaacgctcccgggatctcaatctcagtcaactgctccaggacacgtggaccgaaacgccgctggagcactgctggctacaagcccaaatcagacggctacgcgattacctgcgtttccccacccgcttagagtttattcccctagtcatttacaacgcacaggaccacaccgtcgtacgcgtgctgcgaccgccctccacgttcgaacaggaccacagtcggctggtgttggacgaggccttccccaccttcccgctgtatgaccaagatgataactcatccgcggacaacatcgctgcgtctggcgccgctccaacaccgccggtacctttcaaccgcgtgccagtcaatattcagtttctgcgtgaaaacccgccacccatcgcgcgagttcagcagccgccgcgccgacatcgtcatcgagcggccgcggccgcagacgacgacggacagatagatcacgtacaagacgatacatcaaggacagccgactctgcattagtctctaccgcctttggcgggtccgtctttcaagaaaaccgattgggagaaacaccactatgccgagatgaacttgtggccgtggcgcccggcgccgccagcaccagtttcgcctcgccgcctatcacggtgcttacgcagaacgtcctcagtgctctagaaatactgcggctagtgcgattggacctgcgacaactggcgcaatccgtacaggacactattcaacacatgcggtttctctatcttttgtaaccgacactgacagtagcgggtaataaaaacaataggatttttatcgtttttttatgttacaaaacaacgtatcactttcacggtgatttattcttgctattccttttccccttgggctgtcagcgccgggtgcgcgacacggctaccatgcgcaacaggtccagcttaaaggcgcacttgtcattaaacaggctggacatgcgcgtgtacttgctcagcatggtggccaacaccgggtgggtggcctctgatatctcggtcggcagctccaaaacgacgttaacgacgtgacggtgtttttcgtcccgcttgttggccaccgtgggtcccggcgcggtgttagacatggggcaggccgtggggggaggacgaagaggaagccgctgctaaaccgccgcgcgcctgctgcacaatgtggccgccgacgtggcaggcggtctgtttaaccagcgcgcagccccgacacagcggggcgccgtcctcgctttccaaacagctgtcgcggtactcgcccgtctgacagcgcgcgcacagcaggccgtgcccgtgcgaagtgaggcgcaggagacgcgggaccgtcacgtcgcgtaccaccacagtggagtcgcaggtgcgtgccgcgcagggcagaatgacgtcgaaagccagccggtgatcgtacacggcacaagccgcgttgaggcccagcacggctttccagcccacgcgtacgcagcgctgtccaaagagcgtctcggagacgagctcgtagacgcgctgccgcaccacccgctgactgccgcagagcgagcagtgcacgagctcggcgtgcgtgttgaagatgacgctcttttcttgacggtcccgataatagaacatcgagttgagcggaaagttttgctggcagtgtagcttttccttacccaggttgaggcagtgtccgcactgccgacagaccacggccaccagcgagcgcgcgtccagatggcgctcgcacttgagtcgacacagacaccagagcggcaggtcgatgacgctgccgatgaggccgccgcgcagcgcggcgctgagtgcaaagaggacgatcttggtgggctctacgtgacgcgcctgctgtccggcgcccgcgtgtcctaccgccgcagctgccgccgtcgagcctcctccgcgcgtctcgtcgtgcagacccagtgcccgcaacggcaccaggtatcgcggacacgtgtcgcaaaacgtctgcaccgcttgtcgggccagtacgtagagcgggtttccgcagggtaccttcccggcgtaccggcgcaaggctgcgatgaggccccgcaactgcggcgaccgcggctgccgttggtgacaccactggttacggtggtatacggccaaatcagcgcgggcgtcgaagcgcttggcgcgtagtaatgctaggcacggcgagctggtggggtgaagcacgggcagccgaaggtccaccccgaaaaggaaacggtgaaggtcacctagcagcgaggcggtgacaccgtccaacaacgcgtgcagccgctcgggcgggtagagccgcagacggcgcagcaggtagtcggtgtcgtagcgttcgaaacgcagaaaggccatcgtgcggacggccacggtgtgcagacagtccatgctgtagacgtaagcgagaaacacaaagtagggcttggtcataaccatacgctgaaagagcgccgtcaccgcctcccgctcggcttgccgacacaccagccattcgcgcaggaagcgttggtagagacggtcgcccagctcgcgattcagaaagcgcttatccgtcacgaagagatgaaggacgcaagaacgtggcacgtgatgcaccagctgctgctggaggaccgccgacgtctgcgccgcaaactgcgccggtggctgcgacgtttctaccgccgcttcctccggctgcagcgcaccgcggccgatcaccagctgcacatggaaatggtcctcgtgaacgcagaggggcgcgaagagacggcgcagagcctggtggaactcatcagtcgcggtgtgcggagcgtgtcggagacgacgactggccatgaccgcgccacagcagagccagcaccagcagaagagccagcaccagcgggcccagagtcgcaaagcgcgcgggcagccacggcccagactgcggtcgcgatggcccggagcgcgctcgccaccacgatgacggtgcccaacgataaccagtccgctccaaggacggcgcgcacggcggagacggcggatgacggtgatgggtcgacacccctcgccgacgactcacgtgctcctccagaggccgacgcgcggaccctccgacgtcctggcccgccgctgccgctgccgccttcccttctcccgccagagccagcaactcctcctcctcttcatcagcgtctccctcgcttgcgcatccgcatcgtcccatacaggcctcacaacgacacagccgccacgaccccgccgccatgggtggcggcggcggccgaggcccggcagcggcgccgccagcggcgaccatggtgggagagcaactcggatgacgaggaggaggagggggagatgcggtccgagaggaccgctttcccgccgttcgcgtaagcgcggccgacatgcgggcgcgccacagggacggaccgctgccgctgtgactgcttacggtgacgtggttccggaccgccaacgacgtcgacgcggctttcttggcgtacagctcgcgcagcagattctcgtactcgccctcgttttcgggtccgaaggcgatgagctcgatgttgaagaccgacgccgaattggatttgcgcaccacgcacttcgtcagcactccgtaggccgagggcttgatctcctcgatgtccttgagcgtgacgatgagcgactcgttcaccttaagcacattgaactcacctacgtggcgcgccggcgaaacgagcttgacgggcgctcgtacaaaacagcagagggagacggcgcagccagtgtttttaaagataaaacaaggcacgtggtctgtgcggctctcccagtagctgagtagatactcgacacaatagaccgtgtctgtcttgagcatggcgtcgcacaccgagtaattggggtttttacagatgaggccggcatcggtgacgcgcagctcgctgggacccaacttgaggatacgccgcgtggcctgcaccagatcctgatggagaaccttgttcatctccatcgcaccgacgccaccgccgatttatttacccggcgccgactcgtcttttccctccaggattccgttaatgtccatgagcttgctgacgatcgccgttaatagttgcgtcttctcacggaggatctctccgtgactgcaggtcgcgcagtcgccgtgcacgtacttgaggaaggcggcgtacttctgacccgcgttcacgaaatttaagcgcgcgtccagagagggcagcaacagatcgtagacgcgcggcagcatcggctcgaactgtaatagcagatcgtcgtcaagatcgggtagcgcgtgtccgtcttcaccgtcctcgtcgtcaccacctcccccctcgagcccaccgctcgtaccagccgcgggctccgcgtcctcgtcgatcaccagcggtcgcgtcggcaccggagaatccacgtcatcctgcacgtcgttttcctcctctccgtcgtcatcgtccagaaacggcacccgctgcttagcccaggacattcttttttccgcgtcctcaatcagcggcgccgatcgccatgaatccgagtacccacgtgagcagtaacggcccaacgactccccctcacgggccccacaccacgtttcttcccccgaccagcccggccccgtccaccagctccgtcgccgccgctaccttgtgcagtccgcaacgacaggccgtttcgcgttacagcggctggagcaccgagtacacccagtggcactcggacttgacaactgagctgctatggcacgcgcacccgcgtcaagtacctatggacgaagcgctggccgccgcggcggccgcctcataccaggtaaatcctcaacaccccgccaaccgttaccgtcattacgaattccagacgctcagcctcggcacctcggaggtagacgaactgctcaactgttgtgcggaagaaaccacgtgcggcggcacgcaatccaccgtactcaccaatgcgaccaacaccactagctgcggcggagccgtcgccggcagtagcaacgtaggacccgccggcgcttcggccgcctgcgacctagatgcagaactggccggcctcgaaacctcggcggccgactttgaacaactgcggcgactgtgcgcgccgctggccatcgacacgcgctgtaacctatgcgccatcatcagcatctgcctcaaacaggactgcgaccagagctggctcctcgagtacagcttgctgtgcttcaaatgcagttacgcgccccgtgcggcgctcagcacgctcatcatcatgtccgagtttacgcatctgctgcagcagcacttttccgatctgcgcatcgacgacctgttccgacaccacgttctcacggtcttcgatttccacctgcactttttcatcaatcgttgctttgaaaaacaagtgggcgacgcggttgataacgagaatgtcaccctgaaccatctggccgtggtgcgggccatggtcatgggtgaagacacggtgccttacaacaagcctcggcgccacccgcaacagaagcaaaaaaacaacccttatcacgtcgaagtgccgcaagaactgatcgacaactttctagaacacagctcacctagccgcgaccgcttcgtgcagctgcttttctatatgtgggccggcaccggcgtcatgagcaccacgccactcacggaactcacgcacactaagttcgcgcgactagacgcgttatccacggcctcggaaagagaagacgcaaggatgatgatagaagaagaggaggatgaagaaggaggagaaaaaggaggagacgatccgggccgtcacaacggcggtggcaccagcggggggttcagcgagagcacgctaaaaaaaaacgtgggtcccatttacctatgtcccgtacccgctttttttaccaagaaccaaaccagtaccgtgtgtctgctgtgcgaactcatggcctgctcctattacgataacgtcgtcctgcgcgagctgtaccgccgcgtcgtctcgtattgtcagaacaatgtgaagatggtggaccgcattcagctggtattggccgatctgttgcgcgaatgcacgtcgccgctcggcgcggcacacgaggacgtggcgcgctgtggactcgaagcacccacctcgcccggaggcgactcggactaccacggcctgagcggcgtcgacggcgcactggcgcgacccgacccggtattttgccacgtcctgcgtcaggcaggcgtcacgggcatctacaagcactttttctgcgacccgcagtgcgccggcaacatccgcgtcaccaacgaggccgtgctcttcggacgcctgcacccccaccacgtccaggaggtgaaactggccatctgtcacgacaattactatataagtcgacttccgcgacgtgtgtggctctgcatcacactcttcaaggcctttcagattacaaaacgcacctacaaaggcaaagtgcacctggcggactttatgcgcgatttcacgcagctgttggagagttgcgacatcaagctggtggaccccacgtacgtgatagacaagtatgtctagcgtgagcggcgtgcgcacgccgcgcgaacgacgctcggccttgcgctccctgctccgcaagcgccgccaacgcgagctggccagcaaagtggcgtcgacggtgaacggcgctacgtcggccaacaaccacggcgaaccgccgtcgccggccgacgcgcgcccgcgcctcacgctgcacgacctgcacgacatcttccgcgagcaccccgaactggagctcaagtaccttaacatgatgaagatggccatcacgggcaaagagtccatctgcttacccttcaatttccactcgcaccggcagcacacctgcctcgacatctcgccgtacggcaacgagcaggtctcgcgcatcgcctgcacctcgtgcgaggacaaccgcatcctgcccaccgcctccgacgccatggtggccttcatcaatcagacgtccaacatcatgaaaaatagaaacttttattacgggttctgtaagagcagcgagctactcaagctctccaccaaccagccgcccatcttccaaatttattacctgctgcacgccgccaaccacgacatcgtgccctttatgcacgccgaggacggccggttgcacatgcacgtcatcttcgaaaaccccgacgtgcacatcccctgcgactgcatcacgcagatgctcacggcggcgcgcgaagactacagcgtcacgctcaacatcgtgcgcgaccacgtcgttatcagcgtgctgtgtcacgccgtctcggccagcagcgtcaagatcgacgtgactattttgcaacgcaagattgacgagatggacattcccaacgacgtgagcgagtcctttgagcgctacaaagagctcattcaggagctgtgtcagtccagcggcaacaacctatacgaggaggccacgtcgtcctacgcgatacggtctcccttaaccgcgtcgccgttgcacgtagtttccaccaacggctgcggcccctcctcctcgtcccagtccacgccgcctcatctccacccgccgtcgcaggcgacgcagccccaccactactctcaccaccagtctcagtctcagcagcatcatcaccgtccccagtcaccaccgccgccgctgtttctcaacagcattcgtgcgccttgacactgtacggcagaaaagccggctccaagtgcaagcgccgcggcagcaccatgtgcaaaaacttgtccttgcgcgcggtttcgccgccgggaaagacgggcgacagcacgttagttacagccttgagaacctgctcaaagtacttgtcggcgtgaatgggcacgccgtgctcgcgcacgtagctcggatcttcggctacctcgtagttgcacacggccgacggtggtttccgcgccctcttctttgccggctctcctcctctcctgttgctctcctctaccccgccgccgtcagcgtcgtcgtccgtgccatcaatcgcgtccgaccgggaaaccacgccggcggttacagaatcaccgttgtcggaggaaccctgcggcgccgtccggacaccgggcgccgtcagaacgtaaaagacccgatccccgaccgagggtagctcctcagaacgggccgccaatcgcttaatgacggcaatgtgcggcaggttagattgacggtacagcgagatgtccttagagagcaccgacgaaagcaccaggtcctcgacacgcacacggtgcaggtacagatcgtcgcgggcctgcaccaagcggcgtaagatacgccagaaaccgcgtggcacgccgtacttcttgacttcatcgagtgagaggcgcgacaggcgcacggctgcttccgagacctcgcgatcctcaaagagcagcgagaggacgtcacgcgtgacgcccttgacgaactcgcaggccgtcttgcgcaccagatccacgcccttcatgctcagacccgaggcgccctccactttgccgatgtaacgtttcttgcagatcatcataagagagacgaagaccttttcaaactccagcttgacgggctccacaaaaagacaggccgtcacgtagtgcgccaggctgggcccacgcgccaccagagcctgcggcgtcaggccacgaaagcggacaaacacgctgtccgtgtccccgtagatgacccgcgcctccacccgccgttcgttcgagccccctgacgatgtttcgagcccctccggtaacgcgctgctctcctccgaatccccctcccgcgttcccactacatagtcttcctgattaaaaaaattgtgcaaaaaacacggctctgaaaagttgtctttgatgaaccgcgccgtgcgctctagcatgtcgcgaccgatgcgcgtgatgctggcggcgatgggcagacacggcatcataccgttgaccacgccggtaaaaccgtagaaagcgttgcacgttactttgagcgccatctgttccttgtcgagcagcatacggcgcacagggtcttgacactcgcgcatgcattcgcgcacggcacgccgctgcgaaacccacttgttgagcagttccgagagcaccgagacgcgcaccgaagcacgcacaaagcggtgggtcacgccgttctctagcgtgacgctgtatacgtcggcggggtccacagggtactcgccacccggcaccagcagggtggagtagcagaggttgtgggccatgatgatggaagggtagaggctggcaaagtcgaacacggccacggggtcgttgtagtaacccacctcgggctcaaacaccgtggcgccctggtacgaaaccgccgcagtaccgccggcgccgtgattgtcgttggaaacgccgacgccgccactactgccggagccgacgctgaaaacgccgacgctgctactactgttactgccggagccgggtgaaacgccgtcctgactggacggcgcagattgcaagggcggcgacatctgaaacatagccgccacagaacccgcgtcgccgggcacagcggcggtagagatgatagcagcgttaggtgacacagcaacgctattcgtttcgggcaccgtcgtacctttgctgtagtggttgggcaggataaaatcgcggcaggcgcactcgtccagcagcgaggtgtagatacggatctgctgtccgtcaaagatgacacgccgcaacggaattttagccagccgcgcgatggccccggcctcgtagtgaaaattaatggtgttgaacagatcgcgcaccaatacggcgtcctgcagacagtaacggcctacctgggcgcggccctcggcattagccacgaaacaacgcgggatgtccttgtaagacaggtcatccttgcgttgccgcaggtaaagctcggccatagtgttgagcttatagttgggcgagttagtcttggccatgcatacagggtacatgtcgataaccaccgaacccgcaatatacaccttggtggcggccgtgctggccggattgttgtgagaagccgagggaaaagcggcggcgtactgccgcttaaaacccacggcggggctgtgtaaaaagaaacggccgccctgcgccgtaggcaacttgcagaagcgctgcgagtccaccttatacaggtactcgagacgcgtgaggatgtacttcaagtcaaaagagttgatgttgtaaccggtcacaaaggccggcgcgtaccgttgaaagaaaagcataaagcccagcagcagctcgtattcggaagggaactcgtagacgtccacgtctgggcccacctgcccgcaggtgccgatcgtaaagagatgaagacccgagtgcccaaagatcacaccctccgaagtgcagccccgaccatcgttcccgtttgggatcccctgatccacggcggtgtttccccccgtctcgtagcacacgcacgagatctgaatgacaatgtcatcggacttctcggcgcagggaaaaccaccctcgccgctcatgcactcgatatcgaaggacaggcatcgatagcgcggccacgagctgtcgtcgggcacagccaccaggtcagagacatcgcagtctacctcgatatcacaagtcgacgcgcgaccctgctgccgccagtcgtaacgattcacggagcaccagccgaacgtggtgatccgccgatcgatgaccaaacgcgtcagcggatccacacggacctcgtacacgggaaaaccctgctccagcagatactcgccgatttttctggccatggtccagttgctgatagacacacactgcaaatcgggcacgggtcgcgtcccgtacccatagatggaggtcttggtggccggcgtgacagacacggcgtatggcgtccgcggttcgggcactagttcgcccacgctggcaatgacctcacgcagcctatcggtgtcgctgtactcacagtaaaagtagctgcgctgcccgaaaacgttgacgcagatactgtagccgtgttctgtggccccgaagaaacgcaacacgttccccgaaggcaccagatgctgacgatagcgcggcgacacgttttcgggcgagtcgaagaagagcacggcgtccgtctgatcgtaggtgtgaaaacgaataggtcccaccacgcgacccaccagggtctcgcgccaaggacacggccaaaccatgtcatgactcaacaaatgtttaatctctcgatagaacatgagaggcagccgtcccgtcttatgcttgatcaaccccgtctgaccgtcgaacatgacacctcgcggcacgatctgcaaaaactgtttctgtggcggccgcttgcccgagccctgcgcggagccgggctgcgaacgctgacgccggccacccgcgaccgcaccgccggtcacgccgccgctcagatacgggttgaaaaacatagcggaccgtgagaggctgacagcttacgaagcaaaatcacaaagaaaatacacatgcagcacctagatatccagtttaaccccgtatatcacaagtctctgtgtcaatattttttgtctagtttttttttcctcctggttcagacgttctcttcttcgtcggagtctttcaagtgtctgtagccgtttttgcgatgtcgcagccggtctagcaggttaggcttctgtcccttgtcctgcgtgccagtctgtccgtccaaagaatctgtaccgttctgctgcgctcgctgctctgcgtccagacgggccagggccagaagcatctggtaagcctgctcgttggtgtaaggcggagccgccgtggatgcatcagacgacggtggtcccggtcctttgcgaccagaattataaacactttcctcgtaggaaggcggagcctgtaacgacgtgtctttggtgctgcccgacgtcacggtggtcccgtcggcggacaccagatagggaaagaggttctgcagcggctgcgtgcacagacgccgctgtcgagtatagatcaaataagtgataatgactacggctatggccacgaggatgatggtgaaggctccgaaggggtttttgaggaaggtggcaacgccttcgaccacggaggccaccgcgccacccacggccccaatggctacgccaacggcctttcccgcggcgcccaggccgctcatgaggtcgtccagacccttgaggtagggcggtagcgggtcgactaccttgtcctccacgtactttacccgctgcttgtacgagttgaattcgcgcatgatctcttcgaggtcaaaaacgttgctggaacgcagctctttctgcgagtaaagttccagtaccctgaagtcggtattttccagcgggtcgatatccagggcgatcatgctgtcgacggtggagatactgctgaggtcaatcatgcgtttgaagaggtagtccacgtactcgtaggccgagttcccggcgatgaagatcttgaggctgggaagctgacattcctcagtgcggtggttgcccaacaggatttcgttgtcctcgcccagttgaccgtactgcacgtacgagctgttggcgaaattaaagatgaccacgggtcgtgagtagcagcgtcctggcgattccttcacgttcatatcacgcagcaccttgacgctggtttggttgatggtcacgcagctggccaggcccaagacatcacccatgaaacgcgcggcaatcggtttgttgtaaatggccgagagaatggctgacgggttgatcttgctgagttccttgaagacctctagggtgcgccgttgatccacacaccaggcttctgcgatttgcgccagcgcccggttgatgtaaccgcgcaacgtgtcataggtgaactgcagctgggcgtagaccagattgtgcaccgattccatgctggacaaatgagttgtattattgtcactcgtacttcttctggtcctatgagtgatattcagactggatcgattggccaaacgttccaattccaccaaagatttttgcttgatgccttgccagaacaccaccagaccgccgctggtttcgaagacggacacgtttccgtatttttcatatgtttgattgtatgaagtattgaaaatctgctgtaacttatttatagcctcatcacgtacgcagtccagcgcggagtcggacatgttcacttcttgtttcttagacagaaaagttgcagtcattttggcagaagaaaagtggtacgagtcttcggcttcggaacggatagtacgttccgaggcttcccagaaggtgagctggcaggtgacattcttctcgtcctgtatatcccaagagatcaccgagtcggcacgttcgagaaaagccaccaacctatgggtttctggcgcagcgttgggtcttccaaagtcggaaacgatggtgtagttcgggaaaatgaaaaacttgtcggcgttttctccaaagtagctggcattgcgattggttccgttgtagaaaggagaaatgtaaaccacatcacccgtggaagttgcaaaaaaatgataaggatacttggagcgcgcagtagtgatggtcagcatacagttcagattacaggtctcacgatagagccaggtgctgccgcggctgtgccactgatccttgaccgtcacgtaacgggtactgtgggtgttggaataatcgtcgggaattaattgcatggttttgttttcataactgtccctatgatatgccacgaaaaccgtgcctcctataacgcggctgtaggaactgtagcattgagcaaacttgttgatgtgatgaatctcccacataggaggcgccacgtattccgtattgctgcccagcagataagtggtgtagatgtaagcgtagctacgacgaaacgtcaaaaccttttggtagacccgtaccttaaaggtgtgcgccacgatgttgcgcttgtagaccaccatgatgccctcatccaagtcttcattgataggcttcatcgaggtgcagatgatattacgttcaaagcgaataagatccgtaccctgggccatagaacacacgcgataggggtacttggtagtgttgactcccaccacatctccgtacttgagggtagtgttgtagatagtctcgttggctctatgactgacggcttcagaagacgttacgtgttgagaatagactgaccgggtttgagcagacgtcgtacgagaagtatggcttccattgtgagtagaagaagttgcatgggaagtactagaagaggaaaccgcagcacccagacagacgatacacaggttaacgcagactaccaggcaccagatcctggattccatgttcgtcgcgggccaaatccagcagcgatgaggcgcgtcgtggtctcttgcgtgtcgcgcggaccctccgggaaacacccgcagtcgaggaggagggatacggacttggcagccaaggtcggtccggctccctgaagacacccgagacggccgcggcggccgtcagggtggagggcttggccacgggagctgttggcacgtcgccactctcatccggtctggacagatgcctgtagaggaggagatatagatctttggacttataaagacttccttcgtgacgaagcagcagcggccactctttgttatacgtgagaatcacatctctgtccgggtgcagttcgtcgcgcaggcacgcgatcgagagttgtttcccgaaagtttcattatatagtgcgacggagagcacgagctcccgcacgtgcatccacatctccttctgcagcacgtttaggtcctgacagtccgaaaaattgaaaaaacccatatacttcaccaccatccactcactgggatacacggtaccttccgcgcatttgaccaaatcgtccttgacgtggggtagtacgcccgcgttgtcgcaggcataggccatgtccacattgtgagagaggggataacgatcggtgcagtgggtgaagaggggcccgttacacaactcgtagatctgctgacccagtagcgggagggattccacaggcagactcttgtggatcaggttattgaccacatacaggtgctcatcgtaggtgaactgatcacccacgtccaccacgtcttggtcctggtggtattggctgcggtacagaaacccattcatgagcttagagataaagtccagacacaagggccccactagattgacatcgatgagcttgctagtcagacgctcctgcgttttgatgcaacggatcaccttgccatagcccacctccgagaccttctgcaggtaggcgcgtttgcgcacgttcacctcgcgagtgacgttgtggatgcgggagcgcgcgtccaccaagtcgagagcctcgtgttcgtcgcagttgcgcacccgtaagccgttctcgctgccgtcgccgtcctgcccattcacccctccccctaccactttcttgcctcctccacgagcccggccgccgccaccgttattcctctgactgtgagtactgctgttgctgctgttgctggccgtcatcaaagtcgtacccgtccccgacatcgcctcccgtccacgcaggtgaatagcctcgccctcggggccgtcgccccccgtgccatctggcagcggacgtcgaatctcctcgagaatatgcttgattttggtgtacatctcgttgctttcgtggagcttgttgaacaccgggttgtcctcgaaagcttgaatgctgagggatgtgatgaggtcgatgatcctgttgggggcggcaaagaccgaccccacgaacatgcgctcctccccgtccaacgccttttccccgagcacgaagatgtcctccacgtcctccccgtacagatggcgactgatgccgttcatgagcgcccggcacagctggtgatacacatttagctgctggatggtgatgcccacccgcttgacgataacctccgaggtacgggaccagtaggtaaaatccgacaaggaatatattcgttccggtatatccgtaaacaggttgtactccctcagcgcctcctccgcctcctggatgtagctgtggtaggccgatgaagaagagaataggcttttgagggccgaaaggactccagccaagtgggggatgcgcgttgtcaggtccagcaggtcctgctccaccgtctggatattcacatcggactggcttgacggacggtggaccgctatatggttgcacagcaagccctgcagccgcttgttcagcgagcggccctgattcgggatgatggtcagctcctcgtagcattgggcgcatgtcgtcccttcgacgtacacttcctgacgcgccaccggcgagatgccgcataggcgacggaggagctccagcaactgcgcgcagacctccaggccggcctccggcgccaggatcccgtacacgtagttcattttgcacaggaagcgctcgatgtcgttgagtgtggccagactgacgctgaaacggacgttgtccgtaaactggagctccacggtgtgatggcgatcgcagcgatccaaacggaggacggtacggtagaaggccgcccggtccggctggcgcgagtaggccatcagcgcccgatccagcaaagccgtatcctcgtgcagcgccttcagcagcatctccaggtagagcgtcagcaacgaactctgcgtacgattctgcgccaccacctccgggtagatcttccggtacagatacactatagccgccgcgtttctcttgaacggcgtggactccgccagtaacacgttcggatcgcagtactttagacactccagctccatggcgtattcgttgcatttcgaacacactacgcatagtttctgtaacaaattcatctccatgactcgactcgctcacgtacgagacgctgtcgtccggtctggcgccggccagagacatggagtcggtgcacaaataactcgcgggccgctcgctatgccgactgacgttgacgttaatatataacgacgtcgtcgacgacgcgggttctgctcccgaagctgttgccgccgcttgcggcgcaacctcctccaccaccgccgccgccggctcctccgcctcgggcgacgggggctcggagatgaccggctgtgtctgacactcctccccttcctcaggcggcccgggcgccgacgcgaatgtcggagtttgccagcgcggcggcggtctctgtctctggtgccgcggcgctaaccttcggggctgttgctgctgttgatgatgcgacgccgtctgtcgccgctgttgcggcggtagctgatacggtgtcgcctggtgctgctgtgtcggtggctgctgttgctgctgttgttgcggtctgaaaagcggccacgggggctgcgactgttgttgctgttgttgcgatgctcgtggctgcggcggccgttgtcgcggcgtttgctggcggttacaaccggctgcgtttggccggcaataacccgctgcccccgccgcccccgctgctcccgccgacgccgccagcctcgtcttcgccggcgttcacgagaaagcagccacctcccgtctcgccgggcacgccgaagcaaatggagttgcccgcgacggactcgccgagaagaagaccgccacccccgacgccggacgccgcgccgacgccactgggcgcgaagagcgccgacaggtcgtgcacctcccccccggcggcgtccgttaatcgctgggcgtcggcgtccagcacgcgtcgcaagttctccagcgaaaagtcctccacgccctgctcctgcaacgcggcaaacttgtccatcagcgacgcggccagcgcctcgcagccatccacgaagaagagcacatcgtcggacgcggggatctcctcgcgcacgctcagaatctcgtacacggccatcacttcggggtcgcaatccaagttctcggcgtccagcgccagcatgacgcggttttttataagatccgcgtcaaaaagcacgttctcgcggcgcgagcgtttgatgagcacgtcggccagacgcgtagccaagaggtagcgctggcgcatgaaacgataatcttggccgctcatagagctcacgttaaggctgcgttccacaccgttgcccgaaaagtagccgatctgcccaaactgatagatctccttgctgttgttgatacccgcatatttttccacgctcacgggcacggtcaccaaggaacgatgctcaaaaacgctccgtaccaacgattcacgcgccacagtggcggccatgggcgccggcacgcctgcggtcttcaagcccttgacatgcaacgcaaattcggcgggcgacgagaaccgcggactagcacctaacacgtgaggaaactgcgcgtggttctgcgtcgttaagcgcgtcgtcaacccgtgcagcgagccgatgtagtctttgaagccataatagcagaggaatttgttatggaaacggctttccacgtaactcagcacacagtctggcgccacatccagcagatcgtgctcctgatagtcagccgtcacagccaccagaaatttgacgaaagcattgaactcgcccatgtcacctatgggcacattcttgggcaacgcgttggaacagaccttctgccaaaactgtaagcaggggagaccacattcaggaaagagtcgctcgtgatgtcgatacagcagaaatcccaagcagcccttagccggattacgacgcggaacgtgatcgcggcgaaaaaacacgctacccgcgttgcccttgcccgcgcggtagatgggtcggtttttcacccgcaccatgatcaacgtgggtaccgacagccgcgagagcttgatctccatgggcaccacggcgtacgtgccctgcgcgtacagcctaaagtccagcaggcggtcgtgatccgaattcttggacgacttgatctgcttggtgaagagaaagcccttgcgcgacgacgtggtggagaacgcgccgtgaatggattgaaaatgctgcgtcatccatttggataccaagttggtggtcaacggattgtccacaatgtatgaggtagcggtaataagcgccacgttctggatcacgtaaaagacggatctgaaataggcgtaggctagcagcggctggaaggccacggcgtagggattcagatccaggttgaaggcctgcgtggcgcccgccacctcgtcgcggctgctcttgaggcgcacctccgaaacgaaacccagggcctcgtcgtccacaaacttgttgagcgccgaaaagacggccacaaagtcgcttttgccgtgcgcgctaaaggtatcctcgcccgtcacggggtcgatgagccgcatcttgcggcagtaatccaagatgcgattgagccgataggtacggtccacgctagcgcccaacatgcgaccgccgcgccccatcattcccccggaatccccaccacccccaccaccacgaccgccacccagaccgtcgctcgggcccccgctcacgtctcgtccaccacccccgccagcaccgccgcccggaaccccgtcgtcacctttgccgtccaaacccccgtccttggcgtcgacgttgtaacgccgaccgaagctgcccaaaatatccacgtcgttgagaaaacgcgactgcacggtgatcacgcagggctccttcttgggctgcttgggcaccacgggcaagcgggtgcgcacccgcacgaaggccgtctgataacacgtgtggcaacaagtacccccacaggcctcgcacagccccgcggcgcagcccaccaggtgattcgtgagcgtcgacgaacccgacaagcccgtgttgtacaccgagacacgattcagataccagacgaagcccgaaactagctgcggacacgtgccacacaccaacgccaaatgctgcggcccatagcgttcgtccttgagcggcgcgccctgaaacttgagcaccttgcgcgcgtcgttgtagacgtcttcgcaggccgccgacaacccgttggtgaactgaatagccttgagcaacgtctcctgactggccgtaccgccggcgctgggatgccgcgccgacgactggagatacaccagcctgtgctggtagagcaccgaattagcgctgaagaccaaggcggccacgtgcgtcgagagatgcaacttgagctcggtcagcgcgcggatcagatcgcggtgatcggttgcgttggtcactaaaggccactcggaaaagagcatagattcggcaggttggtaagccgaatcgaaaaataccgaggcaaaactgaaggccaactcgcaaaccaccgcgtcactcagcatcagatgatccttttccagactgctgagtcgctggctcatgtaccccaagtagcgcttatgtggcgccagcttcaccgactgctgactgtcgtgcacaaactgccgcaacgccgcctcgatcagcacacgcggctccgagaagcgcagcgattgacaccatgacgtgtacacgtagtagaaaagcgtctcgcttacggccggcacgtagagccctcgcgcctccacaaaagcgctgcgcgcatccagcgagacctcgtcggcttcggcgtcaagctgcaacgaattaaagagcgtaggcgggtacaacggcacgcgcaccgcctcgccgccgtgcagtcgcaccgtggtcgcctcctccacgcatggaatcagctgaccggcaaagagaaactccttcaagccgttgcccaccaccacgtgcacagtcgtctcggacgcctgacagcccaccgccgcgcacaacgccgccagatcggtaggcacgcgatccgcctcgggcatgtaagcctccaacgcgtacttctggcgggcgtcctcgcacagccgatgcacgtctccgtgatcctcggtaaaagccacgatgccttgcgtatgatgaaagtagagcgcaaaaggacagaaggacgtgactttcgtgagcaccccgccgtcgtaacaaagcacaggcgtgcgcacagagacgccgaaatccgcctccaccgtgagccccgccaacaaaggagcgatcaccacgctcgaggaacggtcgcatagcgagagagtggccagaatctcctgcgtttctgcgttcaacctgctgaagtagagaaaagccgcgggccccaccggcgctagcgcggttagttcctcgtggctcatggtggatgaacggaagacaatggctacgccgccactgagtgaattttataccaaggaaaagttcagcacgtcatgtttgacgcacgacgtctgagacaccaccgtggccaccactgcggtctggctgcggttgcggaccaccaaaggcgacaaccgcaacgatcccagcaattcgtaagaaaagctaaccgctacggtcaggtagcctctcgcagccagaccgctagccgacgcacccgcccgcgaaaatagcgtgatgttcgggacggctttgcgtcaccgccaactaacgtcggtagtcgagcacgtcgtttatcctcagcacaccgtccgatcacaatccgttttcccactcagtcgcacaagcagcacataaaaaccccacacagggcacgtgaaaacaccgtccctagaaaacggcgttttctgtcctaccgtcacccgtatacacaggcaaatcccaatcccgatccccgaaaacaccgtacggtgtttgtgacctccaaaatcacatcagctaacaaaccgtgaaaagtcacgtttcacgaacacggtgtttttaaatcacaaagaaccgcctgacggtttacaagcagaaacaccgcaccacggtggtacaagcgcgatgaatctggtctcgcaacctcaatcgccgctatcaccaccgattttcgctgcgctccgccgacaaaacgccgtacaagctacacaccccaaaaacccgcgcgcctacgggcgccaaacctgtgtgttatctcaacgtcacaacacgacacaaaccgcgtaacgtggtttcccgaacacgtacgcggcacagacccccgacacgtactcgaagaccttacagtttacgagtcaataaaacaggaaaagatccgaactttaaaattgtgtgtttttattttcccatccccctctttttaccaaaaaacacatttttcgtcttgtaaaaagtaactttcgcccattgccatgaaacaccgtgatggggaacggtgttgtgtgtcgactgacgtcactacggcgatcagtatcgacgtcgtgtatacataacggtgcccggtgtttttattcggggcgttgtcgcgtcttgatgtaatgtaacctgaaaccgccgtgcccaagaatgcggaagccagcgtgtaatcataacggggttttgggtacaatctgacgacatctggcggcgagcgtacaccatcgaatgtggcgatcgccggctctacgtcacaatgacgcaaaaacacactgtaaaacccgcgtagacagctttcctggtcaacgagcgccatctggtgtcggcataagaacaggcatcaaccccgtggccggcgaggcggtgagcacttttgttggtcacgtgaccatcagcgcaggaagcgaggcccgtagaaccgcccaagaggcggtgccagatgccaacgtcataatcacaaggtgatttgttacgtcacgcgcgcgcacgcacgcgcgcggtagaatacagcgatccctagtgaagccacacccattacgtgtagccatatccgcttacgtatacagccacacccctaggtacgccaccttatctaccaatcacagaaacggatatacaatgacccctccctagactccaccccttgtacggaaatttcagataggtggaacccgttagggttccaccgtcctcggtgtacgtacaggcttctccgtctaccggaaatatacacctgctgacgtagacgctactcccggatacgcgtcataagctactggaccctaggggggagtgtctacagggctacgtgcacgcccccttacctagggtatccgcccccttcctctgttttggcctagtaaacttaacgccgccgcttctcacgtgacccctgacaagcctacgtcacactcgcgtgaccacacccactccggatatacgtcatcctgtggaattccggacatacggtgacgtagcgagcgtagcgagctacgtcacgtatgcgtgcgtcatctccggcggaaatcatctctgatgacgtagcgagcgaagcgagctacgtcatcagtccgttttacgtataccggatgctaggcgacgccccgtaggggcggagcctagcttccacccctaggatgcataccctatatagcataattcttctaacgaaacgttctacgaaaacggactggcggaacgggaaccaccgtaacccccccccctcacccccccccttctcctccggaaccggggggggcaaatttttaccaaatttgggcaaccatgatttccaatgggacggcgtttccgtgcgcatgcgcagtcggggcgagtttttggttgtcagggcgttgccacgcggattatgggatggtgactcgagtgcgcatgcgccggggatgccgcatggaaaacctatatataaggaggggtgaaccaggggccccggggcgcatgcgcgggccagggcccgcgggagggtcgccctgcgcatgcgccggtaaaattccactgtgtgtgtcgtgcgcatgcgccagtatttttccactagaggcggtcagtgcgcatgcgtcggtaaaattccactagatgtgcgccgtgcgcatgcgccggtatttttccactgggcggccgcacctagggagcgcgagccccgtgccgggcatgggccgcggcggtggaaaattaccgctccgcccacctaggcggggcatctgaaaacctataaaacccggcgtgcccgccgccccccggcgcagtccgcggcagggttccggccgtgctgcggtccgcacgctgcgcccgctcccgcctgcctcccgccctaccccccaccctccccggccgaggcccggcgccggtccgtccgcgggcccgtcccaccgccctggagcaccatccggggccgtgggccgggcaccgggcgcggcccgctccggacctcggccgggggtccctcccctccccccgctcgacccccccatccgacggcccggccgggctgggacccccgcaccggggtcccggttcccgtccgtggcccggggggacccgagcgggggcttcccacccccaccccgctcctccccgggctccggcccgggatccctcgctgctcccggcgacctccgccggcttcccggtccacccgccgcggaatggacgggacccggggtccgcgcccttcccctccccccacggggggctgggtcgcggaccccggttcctaggctcgttccgcggtgggcgaccggggatcccccacccagctccccttcccggcccgccttgctggcttttgggcccctgcgggctttttttttccggctgggggtcgcggcggtcggccgacgacgacggtaggtgggccgggtggacggtggtggggacgggcgacgccccggctcgacggcaatcggtcccggaaggttgggggctgggggcccggtcaggagctccgggagcggggtcgaccgcgacggcttccgggtctcgcggcggctccctctcggcggctccggttgggctcccctcccccctctcgagggtccggccgccagtcgtgaccgggggtccctcggcctagccgccggctctcggtccgccttatcctgggcgttggcctgtcccgtgacgctcccctcccccgctgctccccaaaaaaactccgcccgaaccgtcgcggcttgctggccctgggcgtggtcccccactcccctccccccatcggccgcccagccggggtcggcgcctcggaccccaccaggctgtggcgtgtgtgctggccgatgcggcggcgaggttgggtgtggccggaagcgctcggggtcgacggtgggccgccatgacacctcaattgtcgtcagtacgcccctccacaatcaccgtccccacacgatgggcccggcaggtcacccaacgttggttcaggcccagtcgggttttttccccggcacgaacgcacgtccccgtgggctccacgcgttttccaccctttcctggaggggtccggaacaccgtgaatccacggggagggtcccggcacgggccgaggagaccacgaccgtcccacccggcgtgtcgactcgtccgagacccgggaagggaacaggccccacctttttttcccttctccgattttgccgtggaaaacccgtgaaccgatacgggtgcagacggccgaaaaaaatcgagacgacaatatgacggcagggcgcgatcttctcccccatccgacaaaaccgtgtcccttaaaattccccacctttctctgttcaaatggccccgaaactgtaaaacaccgtttgaccgcaccccaaccggcgccatcttggtgaccttctcgacggttctctcgctcgtcatgccgttctgagctccgacatggcggacgagagaaaatggcgtcgagagcctaggagcgtttttgctccaggcgggtaaaaaaatagcacgataacttttctgtgcttttttttgagacgttttagaagagcttttttctgctcagagcgaaaaaatgatagccctgaaaatctcgacgagtctggccgagcggcgccatcttggaggaggggcgagtcgcgggcaccgcctcggtaccccctggccgaggcgagtccgcggtcgccgcctgttccgtgatgctacctagagggcgctgtcgaggcgactcttcctgttttcgccctgagggctaacggtcgctgacgtcaaaccatctcgtgctcgctgagtcacatccggttgttgacaagcgatggaggaccgcacccaaagtgcgccctctagtcatcgcgcctgaccccttttataaactgctcgaagaaaagaacaccttatgtgaaaaaatacagaatgatgacaagttcatccaacacaaccgctcaacaacgccatatctatcagtgtccaaaaactatcttctatcctttgaaactataaatgctgcctatatacatatttagtatccaagactcttaccacgtagacgaaaagaagtgatacaatgatcttgacgtgtatcgtctatatcgtgctagatatattcagataagacgcgcaaaccatagatttctcatcagtatcatgaaagacctatagctctatatacgaacctagtcattttaggacagccgccggagaagccgacgagggatcgggcgggtgcagccagaacctcacgcccgatcccgcctccggtaggcgatttgcatctgtttggtaaaaagctcataagtctgtatgtgacctatatatattatacgctatgtacaccgaactgtcgctgttgtataagaagaaaaaactctccatatttatatcgtctgaatttttgcttgatagacacgtgtttggaactctgtccccccacgttttcactgtgtataacaaaaatatgtgtttctcaaaagatcttgaggtgtttgaaaacgggggaaacctgcgtttgggtgctctaagccccggactgggacgtagccggcgtccggcacctatatttttctatttttttttacaaaatatatgatgaaccaagaataaaactctagctctcgtctatttttaatatgctctacttagaacctttttaatgacagaatgaactccatgttatacgctctttatatagtttctctgcactaacctttaaaaccgtatccttccctgttgtacaaatcatcttttgatacacaatgatgacctgatatccctccatatatatgatcggatattattccgttagacttgtcctccttttttttcctcatctcctgtatctggagatatatgttgaccaccaccgccatgaccaccaaaaagctagccgtcacgactagaaatgtgtaggattcggactttccgttcgagaagaaaaagagaccgcgtctctggacgctctttttgtcagtctgaatcgacccgggatacgtaagagagcggccctacatcggggggcgctcgagaccgacgacgttccatctgaccagaaaaaaaaaggcacccctcggtggcgacctctcaccatcgtttgcccgtccgcccgtccttcgtagccatcatcatctcaggctctatcggtaccatcgttgtcatctgaaaaaaaaactgcctcacccacctgcgtaaaaacaccatctttccggaggtgcggtaagacgggcaaatacggtcgtgccgaggcaaaaaaaacgcaccatcgacaccacaccctcatgagcaccacctgtcggtgttggtcgtcctccatcgttctctacgaacatctcgacgcccgggtgacggacgacggcaagacgtcccggagaagacggtgttctctcgggcggtacgctctctggatctataatatctatagtagctaaacgagactgtgagtacgacgaaccacatcatcttttttttatgttgcttctttagaaaatgacttatgtcgacgacactcggcatcagccatctcgtgaaacacgctcgcttttcgtctctccaaggaacactgggtccgctgaaagggaccgtgtaccgaccaaagcaaaaaacacacacgtagtaacatgatcaaccacgtctgaatgacacgaaaacacaatcgtataacgctctattcatggaacgaacttggaataaaaaaaccatcgcaggccagaggctaagccgaaaccgtccggggaagcgggcgcgagttttccgacttagcctttggtgctcgttgagcctcttttttttttctgattctctgaagaatcaccgtcacagccctatgacgcgaaatcaattgctagaacataaacgttctcaacaggtatgaaatgaacaaactagatgatgctataaccttatattgtgtgtatatagataggtgtgaaatttgtaggataaaaagtgtcgttgtatgatgcacaacgatcgtgaaactggagactgtagctctctaccgaatgcaaatacacaaatgacatcgattcccgtccccacataaagaaatgtgctttactgtgaaagaatgaagaagattcttgttcctcgtacgacggggccctcgctcgtcgtgcctcttcccccctccgggagaggggacgtcggggccctccgtcgcaccgggccgaagccagtgaaatgtttactacactgtcatcagaatatatgatgtatattatttcctccaaactcctcaccatagccaccaattcgcatcacttaagaaagtagtagcaaccgcggcggcggcgaccggccggtcgtcgtctcctcgtcctcaaatgttgtacatgtgcagaaaaatgtgtaaatacgtgttatttatcccatgcgtcttgtacatagatatatgtttttatatacgctatttatactttatatatccttttgcataaccatagacagtcaaggattttaatgatttgctcatccgcctttgagccatcgcttaggagttagttcctctatgttctcggcccaccttttcgactacagtagcaaacccttgtactaccaccccgataaaaaccacatcatcatcgtcaccacgacctggaaacgacacacgttcccccccaatcttgggcatgtgtatatataaaaagaatgggagggagaggacgtggggctcgagaagaaataaacgccaagctcgattcgaaccaaaaaaccacatgtgtattgtgctttgtttttttttttacggtgggggaaaaggagggggccgtcattaacggaaaccgtgtatggggtccggacacgaacagtacacagcttatggggaaaaaagctcacagagagaaaaaacaccaagctcaggcacgcgtacatcattattatcatcatcggatatctcaccacgggtcatagtagtaccaaggagtgtgtaacaccattttttcttttctttgtaacgggataagggacagcaatcatcacgcacaacacccttcactctctttttagtcatccatatcatcgctgtaacacagcatgtcctcgtaatcgggcgtctggcagcgcattaccaccgagtcgtcttcttgcggtaccggtggtggtggtggtggcggcggcggctgctgctgctgggttgccgtcgtactgtgattaccgttggcggactgcaccgggatgatgggctgcttgtggggaacctggggtggactgccgccgtgagaaggcgacggcgtcatcaagttaagctcaccacggtgactccggacaccggcgaggggcgccgggggactgggagggaccgcggtcgtcttgtagacgacggtgtccccgtgtcgatccgtggctcgtaccagatcttgactgctagcgtcgtcactgtcttcgtcctcttccagctcgccctcagagtagtgctgctgtggttgcgacggtggctgggcgggaggagcggcggcgatcattggagagggatgtcgatgactcccttctctgtcctttttatcgtaggctgtcagcgttgctgggtccgtcctgctttccatatttgcgtattgctcatcggtgggatgaatttggtctcctccccgctgttgtccgccggcagtggcgtggttgctggcggttgtcgttgtcgtaccggcaaagacggtgagatccaatagcgactgctcgtcgaagggacagtacgctatcatgaaacgatagggtgccaacgcgcgttggatgcgcagttcgcacatctcgttctgacactcgtggcactgcagggcgcctaggatcaggtccgagacagcgccgcagcggtaggtacccatggcgttgttagtatcgaactggtcaaaaaattggggcgtaccggtgacttgcaacgcgcgacggcgtagcgagacggccacgcgcgagaaagagcacacataggccatggcgcggtgcatgggttgcgagaaggtctcgggcggacgcttctgcagatcgcagacgtcgtcgcgtagccaggcgctcatttgaccgggcttcttgactagccgtttgagcgtgctgcaatggtcgccccagccgtcctggtggtccaggatgcagcccaggtccaggttgttgagtttgttgaagagtagctgacgcatgccgcccaccgtctccagatagggatcgtgcgggttgacgggtagcccgtgcaggtggtggtacttcatgtagctgagcgtttcgtcgatgatggccagcaacgtgtgcaagttgggagcgttgtacacggcgaagatcttttccaccaccagcttgcgcagcaacggttcctccagccaatcgaactgttgacgaatgtgcaacaggtagtcggtgtgcatgagctcgtcgtgtgacagcaggatgcgaccgcgcggctgatgatcttgcgggaaggcggtggggaccttgagatcggcggggtagggtgccagacgtagactctcggccgtgtagcgctgaaggtcgtaaacgggcgaggtagaactcggtgaggtacccgacgaggcggcgccgcgctgcagacgcgctctttttttcttttcgatcaaacggctgagttgctgtagttcgtcctcgtccatggcgtccagttcgtcgtcaataagcgccagcatctgttgttgttgcggtccggcggacgatccgtgatgattattggctgaggaggggtgagaagaaccgaaagtcgtaggacaactgggaactcggcgacgaagatgcgtcgaatcgccgccgtgatggtgcggttcgccgtcatcgttgtcgtaagacttaccgtagtgggggttaaggggcaccgaggcggacgcggccacgcgtcgcttgaaagaggaggacgccctatgtccgccacggaagcccgcggtgcccatgatgatgtgtccgccggtgcccccgagtgcgtggcgggaggagggtggaaggggaggaggatagtggtccggatcgccttcggtatcatcgtctttgctgtagcggggtcgtcgtgcggggacgcagggtcggtgatgatgcgaggcggcgccgacggtatcttccgcgagatggtgttcgctggcggctgctccgttccgtgtcgacggcgaggttggacttcgctcgcgtcggaacttccgtggcacgggttcgtaatccagacagaagcgccgtgcgcgacgggcgcggcgttcgcgctcgctcagggaagataacgacggagcgtcgtgacggccgcgtgagtgcagctccatggccgccgtcgctaggaaggtcacgttcgggcacgctgatgtatatatagatgagaccgctgccggggggcgggtcaccggcgccgtggaaagtgaggctcagacggcggtcgccggcggcacgggcgcgtcgggcggtctgattttgatggaaatgtggacgtttttggcgttggagtgacactttttggtgaaacagcggctccagaggctggcccagagcgcgtagctgtgctcggtgcgcaggtcgatgaacacctgcacggtctcttgcgggttgcggtgcgtgtagttgagacagcgaaaatcccgcgtgcgcgcgccgtcgcgccgcttgacggccacgcagcaggcgccgtggggctgaaagaggaggacgtggggcgcggtaaactgctcgctgacgtgcggttcgtagtgttgcgtgaggtgctcgagcagcggcggccacacgcgggtgacgacgagccgctgcaagtccgtgtcggaaatcgcagcggcagtggcgccgtcgccaccgtacaggtgataggcgagcacctcggtgagaccgcggcgtcgataacgcgtcacgttaagcgagcgcgtctcgataaagttggcttcggtcgaggggcagattttgtcgcgtacgctgagaatgacgcgtggcggcggcgacaggggcaacgcgggcaggtcgtgcggcgggtggtggtgaagcaggttacgcagatccagttgggcgcgcacaaagcctagcgggtgttcgcggtaggcgtcgggcacgatgaacagcggcaacagacggcgatgcatgaaatagccgtcgtcttggtccattttatacatgtagggcagacgtacagagcgtccatggtggtagatgcctgtgtctaggctgctctcgggatgcgagatggggtccagcagcgtgtgcagttcggcgtcgagacagacggcgtgattgagcacctgcgccacggcgcgtaaaacgctggggtgtacggcgacggtgcaggcggggaacggcgtgatgatgcgcagccccagtttgcccttgcagcggcagtaagggggtgacgtgtcaacggaggacgttgttttttggaaaacgccgttatccgggacgttatttttatcctctttcccgtcttcgtcttcctctgtgtcgcgctcgtcccggtaatcgagatagtcgtcgtcatcgaaaggcgcgccggccgcgtccacgggcacgctgttgggtgggcacgcgcttttgaagaaatagaccgggtgccggtcggggtgcgtgtagccaaagaggctcgcccatacggtcatccagacgcgtcgtagtccgcgacatagctcaaagacggtgtgtcgcgccagaccggagacgccgtcgcgcagccgtaaatcaaagtcggccacaaaattgaagacgggcagacgttcgttgaagacttcgtgtcgcgtgtagtagaactgtgtctcggggctggtgctggccacgtcgtcgtcgtgtagccacacggtctcggtcagggcctcgtccgagaaacggctgtcgggtacgtgacggagcaggtcacgcggaaagaggctgcgatgccaggtttcggaggccacggcgcagaagacgtgctggtcattgggcaggtgtacgcggtagacgggcagcggtcgctccagcagcggtgccagcgcgggctcgggtagcaggtagcgacgttgcgagtaacgcgttagcgtgccggtggtgtaagtctgggctgtgcgtagcgaggcgcatagacgtaacaagccggacagggagcgttccagcggggagaagacagactcggaaagcgtgttgatgcgttcgagctggcgcgccagctgcgtggaggtgccgaagaagcccgccaggtgcgtgccgtcgatgcggccgccgtagccggccagccccaagccgtgcgggctggtcgccgagtggggggattcgtcgagacgcagtaggtgcgtctccacgtagtcgtgtagaaagttgtcgagcgagaagtatttttgcatgacgtccagcagctcggtggaaagccggcggcccagaaaacccggttcgcgcgtgcactgcgcttcgggcgccgcgtcagcgtcgtaagccaccacgcgccggtactcgagcaaccgcgcgcgtgccagcgccgtgcggtaggccaggtagacgtagtgcacgcagaccgtgtcgggcagacgcgcacgttcgcggaacgcgttgatctgcgtgtccacctgctctagctcggtgtagtcgcggcggttgcgcgcgacggcgtacgccacgaaagcggacacgcgctgacggaagggcgagcccagtagcagacgcgcgaactcgcccatggaggcgtgcgtggggatgatggtgcccaggtcgcgcgtgcagaagctgcgcacgtactcctccacggtggagatggtgctgtactggccctcgaataggtagtaggccatggtcagcagcacctggccctcggtgtgcccgaagacgctgatgaaccacgagggcgaggtggggcagaggaagacctggttgagatgacgtagcacggccgcgtggtgaaagtacaccaggtgcttgaattcgcgcacctcgccgccgtgttcgggcgagagcacgggcgtgcggaaaagatgccggtagagcggttgcgtctcggcctcgtccagactggcgatgagcgccgagagggggatgggctggcgcgcggccaggtagcgcgagagctgcagcgtttcgttgttcacggcgaagacgggcgccacccgccgcgagtccgagcacttttgcgtctgtaggcagaagtaaacacgtcgcgagacctggtgtttgaccagcagggggaagacgcagtggtccgtcggtgtctgcgagagtacgttggcgactatatgagcagaatcatactctgttgcgaacagaacgagcgtcatcgtcgcgccggcacgatgcagctggcccagcgcctgtgcgagctgctgatgtgccgtcgcaaagccgcgcctgtggccgattacgtgctgctgcagcctagcgaggacgtggagctgcgcgagctgcaggcgtttctggacgagaactttaagcagctggagatcaccccggccgacctgcgaaccttttctcgcgacacggacgtggtgaaccacctgctgaagctgctgccgctctataggcaatgccagagcaagtgcgcgttcctcaagggctatctctcggagggctgtttgcctcacacgcggccggcggccgaggtggagtgcaagaaatcgcagcgtatcctagaggccctggacattctcatcctcaaactggtggtgggcgagtttgccatgtccgaggccgacagcctggagatgttgctggacaagttctccacggatcaggcctcgctggtggaggtgcagcgcgttatgggcctggtggacatggactgcgagaaaagcgcgtacatgctcgaggccggcgcggctgcgacggttgcgccactgacgccaccggcggtcgttcagggggaaagcggcgtccgcgaggacggggaaacggttgccgccgtgtcggcctttgcctgtccctcggtttcggactcgctgatccccgaggaaacgggggtcacgcgtcctatgatgagtttggctcacattaacaccgtctcctgtcctaccgttatgaggttcgaccagcggctgctggaagagggcgacgaggaggatgaagtgaccgtgatgtcgccgtcacccgagcccgtgcaacagcagccgccggtcgagcccgtgcagcagcagccccagggacgcgggtctcaccgtcggcgctacaaggagtcggcgccgcaagagacgctgcctacgaatcacgaacgcgagattttggatctcatgcgacacagccccgacgtgcctcgggaggcggtgatgtcaccgaccatggtcaccatacctcctccccagataccctttgtgggttccgcgcgtgaactcaggggcgtgaagaaaaagaaacccacggcggcggccttgctgtcctccgcgtgaacagcctggcacgttttggaaaacgtacgtgatcacggacacgacgagtacggggtttctcatagacgtactttattaggtcagggatgacggggaggtttcgggccgacgtcaaaaataacgtcattcgtgttgacagggctttctgcgtcggagctcttttcatcttcttctgtctcgtcgacgtcatcgtctaccggcgagggtgtccgttgcagcaacgcgtgctcgggcgtgtgggtgaaaccgatgtcgggggtgggcggcacgatcatctgtcctagggggtgactgcccaccggcagataggtaaagcggtgggtggtaaaaaccgctttggctacggtggtgtgtggggagatgcagacggtggtgtgcgaagtgttgaccaccgtcacgccggccgcggtacccgggagccagatggtgggtcggatgatgagatccgattgactaaactggcgcacgcccactatgagggcgcagataccgggcgcgtgcacgtaggccgcgtcaaaatagacggtttgcgtgtgacccggaccgatcaccagcgtctgacgggtacgtaacgaaaagaaacggtgttcgttgggcggcggcaagttcatgagctgccagggttctggtacaaaacaggggaaaacgccgatatcgccttcgatggtgcccggaaagatggactgaaaagtgtcgttgaggttgacgacatccaactgcgggacttgcagcctggattccagcagctcgggcatgcaaacgaattgcgcgtccaggcatttgtaaaaggtaatgccgaaaaaaccttcggggatatagaggctgacgcccagcgaggtgggcactttgcgctcgcgtgatagccaaatgatgtgtttattgtaaaaggccagctgcgtgtggcattgtttgacgatgaaactggaaggcatccacttgtaaggaactttgagcggtgacggtaatggcgacgacgcttcatcctctcccggatgctgctctttgtcgtatttctcctcggtcgattggggcagcgtaaatgtggtttgaaaatcgctatcgctagcgaaacgcacgcagtaacgcatgttgacggatttctcggctaggatgatggagcctgatgacgatgcggactcttccttcattattaacgtaggggtctcccagaatcgctgaaaacgggagcgcggcagccgcgacagtaccagttgagagtcgattcggtcggtcaacatcgtaagcatcgtggcggtggtgtgatggagtggaacacactagtattaggtcttttagttttatcggtagtggcagagagttctggtaacaattcatccacgtcaacctctgcaactacatcaaagtcttctgctagcgtatcaactaccaaactaacaacagttgcaacaacttctgcaacaactacgacgactacgaccttatcgacaactagcactaaactcagttctaccacccacgatcctaatgtgatgagacgacatgcgaacgatgatttttacaaggcgcattgcacatcgcatatgtatgagctctcactgtccagctttgcggcctggtggactatgcttaatgctctaattctcatgggagctttttgtattgtactacgacattgctgcttccagaactttactgcaaccaccaccaaaggctattgagggtggacagatttacagcccggcggtgttccggcggggtaaggtttacatacgtgggtgaccggaggctaaagttacgaatctcatctagaaacagcagcgagtctagatagtcccacaggggatctataaatgttctctgaaaccccattgatggtgacgtaggtgtagttttgttactatcggaagctgttttgttttccacgaacatggtttcgttgtaatataaggagctcatgtcgagagtaccgtaaatagtgtacggcgtttcgttacggattagtacgtgcgtgtttttcataaattctgacacggcggttcggttgcggcttggttcacaaaaaggattttgccggtaacgtagagtggtatacacccacgttgctaggtcccttaactgtgtggccataatggacttcataaagctgctatcaggacgataagcaattgtagacgtggaaacccgccttgcggcggtagtaatactataagtcacgttagtagtgacgttgagagcggcagacgttgtataggaaaagtatggcgtagtagtactctgagttttcttagcttttttttcgaattgttccttaacgggcgcttgtttacgttttagttttcgcatagtgttttttaacttggtgccgttaatatacttggggacgcgaaatagattccggctcatggcgttaaccaggtagaaactgtgtgtacagttgcgttgtgcgtaacgtaaaagcagggcggttaaacctagaaaataaatcgtttgactatctacgttaaccttagtcggacccacgtacaatttggtgttccaacgcggtacattgaaaaacatggggttgaacgtggtgaaattaccgcaaccttgttcgccagtatcattacgtttggaaacgtttagcatttcggaaagacaagtcatggaaggcacagtaccacaaggtgggggtctgaatgttatcgttttagccgtatgattgtactgtgagtaaacgtattttgcgggttttctaagctgggtactataaaaatcaaaccacagataggttatactataattctgaatggggcccgctaaaatgtagtattgtggaaactctgtcatgttcatagtgagatttttaaccggttgtttacttacattgtattttgtagaaatagtcgtttctagttgtctcaaaatttctaacttaagctgatctaatttatatttgcctatcttagacagtaccaagcccctccaaggacgattataaagcgcttttgacataactttacagtttatgaaagaaacaagcaagaaagatatagatattagaaacaccatcttagggacgtctctcaccatcatctcttttctccccatgacagaggaggagaccccgcaccgtccgtctgccttgtggtttggcttgcctgcgtgtactcactgctgattctggtcgttttgctgctcatctaccgttgttgcatcggcttccaagacgacctagtctcccgcaccttggctgtgtaccaagcttgtatccagggcccgatatgtaaccagacccataacagtacctcgtaaataaagacgcacagacctcacgcatatagtaccatcacaccgtgtggcgtgtactttattacaacgagcaagagtgcccctaagtattggggcccgtaccgttttagaagattttgtgtgaatgtctttaacttttctgtcccttttctcataaactgtcaggttctacagtcagcatgtcttgagcatgcggtagagcagatagatgccgatgatggccgatagcgcgtagacggacatcatgaggagacgactgtcggtggcgtccacgacgacgtcagttacttctaggaccgtaccgtttttcaaaagcatgaggtagtgagttcgcggagatgagaccaccacttcgttgtagggatccagggcgaaaaggacgtcgtccgagtcgtgcatgtacatgatgttgatgacgccttgcgtgtcgtcgtattctagcagggcgctttggcaaaaggcgcagttttctagtgaaatgttgagcgccgctgtgatgctgtgtgtggtgtgcatgttgcgcgttagttcgcatttagtttgactgtccgtttgggtgatgatgaggctctggcctacgacggtggtggagacagggtaggagatacctttgatcaggtactggtttgttacgacataactgacgtgttcggagacggttagcgcggagaaggattcgccgagcggcagacaaaacaggtcggggaaggtttccagcgtgcttggttgcatggtagataggatggagagggcggcgggaacggtagcaggaacggtggcatcggggaagagacgcgtgaggcgttcgagcgagtgatcgcgtcgcccgctactggaacagggtgtgtacaggtcgctgaggtattcgtggtgcggatgagctagcaactgcgtaaagtgtgatagctcggccaatgaacagaggcccgtttctacgatgaagatttcgcgtctctccgtcgtatgtaccaacatggagtggacgaggctgcccatgaggtagagttcttggcgcgcgaaggctgaaagaaaagaggccaggtgcgttttgtgtaattgtagggcaaagtcggcgatctgtcgtagtgcccactggggaatgagatgttgctgattctgtttagaaagtatgtagaccaggcgtacgaggctggtgatgtcggtgatctggtccggcgtccagagggctcgtttggccaggtccacggctgtgggatatagcagcaatgtggtgcgtggtggtgtttgtgagaggcaggtgatcataaattcttgtatttgtaagagtgcggcctggcggtctagggctcgtgggatggagatttcggtgccggcctcttcttgtcgggctgccgcgaacagtgctaatgcgtaggcgaaggccatttctaccgtgcggcggtccaacatttgacatcgaccgcttttgagtacgtctacagcgtaacggtgaaagctgttacgtaacagtgcgctgaggtccaggtagttgaagtcgagtgcggcgtcgagaaagtccgagtctttgagataggagtgacggtttagttgagctttcttaactagtaccaggagctcgtgtttttcagtttgtcgtagtataaagttgtcgcgttgatagggcgctttgaagagtacgcgtggaagatgaccgaagataagcagcatgggtgtgtcgtcgtctatagataccgtaactacgaagaagtcctcggtcagtgtgattttaacgtaacgtagttcgtccatgaggtaaaagccctggtgcagacagggcgtaacggtgctgaaaagcagatcgtgtccatcaaagaggatacaggtctggttaaagtgtggccgatgtagtcccgaggtggtgtgcgatcccttccagtcgtgtggagtggtttggggtggcatccaaacgtgaggtattgacagatcaatgggcggtggcacggtggtgggctgctgacccaggctgtcttgtgccttcagctgctgcgaaaaagatcggtagctggccaggtctttggataccaatgcgtaggtgttaagtctctgttggtatctttctagggtttcggtcagatctacctggttcagaaactgctccgccagaggacccgcaaaaagacatcgaggcatatggaatacatagtattgattatagctttggaaaaagttgaaactgatggcgttttccctgacgaccgtgctgttacggaggctgctgttgtaggtgcactgggtggtgttttcacgcaggaagcggatgggtctcccgtaggtgttgagtagtaggtgaaatgcgtgagggtccagcgcttcggatgcggcgtccgcgccatatcgttgcgaaggtaggtgactgaggaggtagacggtgaagacagtgaggtagggggggaggccgggccgcatagcgcggctgcgccgctgggttcagcggcgtgatccaggtggtggttggcgttacacccgagagaaggagagaaaggatcccaggaaggggcacccgggtgtggcgctacgggttacaaaagtcgcgtctctgtctatttaatacgatgtcattggccgctgcgaaggaagaagaggggacacgcgggtaagccatgccgtccgggcgtggggacgacgctgattcgacggggaacgctctgcggagattgcctcacgtgcgtaagcggatcggtaagcgtaagcacctggacatctaccgtcgcctgttgcgggtctttccctcgtttgtggccctcaaccgcctgttgggaggccttttcccacccgagctgcaaaagtaccgtcgccgtcttttcatcgaagtacgattaagtcggcggattcccgactgcgtgttggtgtttttaccgccggactctgggtcgcgcggcatcgtgtattgctacgtgattgagttcaaaactacgtactcagacgccgacgatcagtccgtgcggtggcacgccacccacagcctgcagtacgccgagggcctgcgccagctcaagggcgccttggtggactttgattttctgcgtctgccgcgcggtggcggtcaagtctggagcgtagtgcccagtctggttttttttcagcaaaaggccgatcgcccatctttttaccgggcttttcgttcgggccgtttcgacttgtgtaccgattctgtcctggactatctgggacggcgtcaggatgagtctgttgcacaccttttggcggctacccgtcgccgtcttcttcgaaccgcacgaggaaaacgtgctgcgctgccccgagcgcgtgcttcggcggttgctggaggacgcggcggtgacaatgcgcggcgggggctggcgcgaggacgtgctcatggaccgggtgcgcaaacggtatctgcgtcaggagctcagggatctgggtcacagggtgcagacttactgcgaggatctcgaagggcgcgtgtccgaggcggaggcgctgttgaaccagcagtgcgagctcgacgaaggaccgtcgccgcggacgctgctacaaccaccgtgtcgtccgcgttcttcgtccccagggaccggcgtggcaggagcttctgccgtcccacacggtctttatagtcggcacgatgccatcacgggacccgccgccgccccgtctgacgtggtcgccccgtctgacgcggtcgccgcgtcagcggccgccggtgcttcttctacctggctggcgcagtgcgccgagcggccgttgcccgggaacgtacctagctactttggaatcacgcagaacgatccctttatccgctttcacaccgattttcgcggcgaggtggtcaacaccatgttcgagaatgcctctacttggactttctcctttggtatctggtactatcggctcaagcgggggttgtacacgcaaccacggtggaaacgagtgtaccatctggcgcagatggacaacttttccatttcgcaggagctgctgctcggcgtggtcaacgctttggaaaacgtgacggtgtatccgacgtacgactgtgtactctccgatttggaagccgccgcctgtctgctggccgcctacggacatgcgctttgggagggccgcgatccgccggactccgtggcgacggtgttgggtgagctccctcagctgttgccgcgtctggccgacgacgtgagtcgtgagattgccgcttgggaaggccccgtcgccgcgggtaacaactattacgcgtatcgcgactcgcccgatctacgctactacatgcccctaagcggtggtcgtcactatcacccgggcacttttgatcgtcacgtgctggtgcggcttttccacaaacgcggcgttattcagcatttgccgggctacgggacgataacggaggagctggtgcaagagcgtctgtcgggccaggtgcgcgacgacgtgctttctctctggagtcgacgtctgctggtcggcaagctgggtcgcgacgtgcccgtctttgtgcacgaacagcaatatctgcgttcgggcctgacctgcctggctggcctgctgttgttgtggaaggtgaccaacgcggatagcgtcttcgctccgcgcacgggcaaatttacgttggccgacctgctgggttcggatgccgtagccggcggcgggttgcccggggggcgcgcgggcggcgaagaggagggctacgggggacggcacgggcgggtacgtaactttgagtttctggtacggtactacatcgggccgtggtacgcgcgcgaccccgcggtcacgctgtcgcagctctttcccggcctggctctgttggccgtgaccgagagcgtgcgcagcggctgggatccctcacgtcgcgaggacagcgccggaggtggcgacggcggcggcgccgtgctcatgcagctcagcaagagcaaccccgtggccgactacatgttcgcgcagagctccaaacagtacggcgatttacgtcgcttagaggtacacgatgccctgctctttcactacgaacacgggctagggcggctgttgtcagtgaccctgccgcgtcaccgtgtgtccactctgggctcgtccctctttaacgtcaacgatatttacgaactgttgtactttttagtgttggggtttcttccgagcgtggcggtgttgtaatttccaccacgtgtcgctcgctgcataaagggcgaacgtcctcggagagggtatattcgttcggcgagagcgggcggcggtggtgggtatgtccccttctgtggaggagactacctcagtcaccgagtccatcatgttcgctattgtgagtttcaaacacatgggcccgttcgaaggctactctatgtcggccgatcgcgccgcctcggatctactcatcggcatgttcggctccgttagcctggtcaacctgctgactatcatcggttgcctctgggtgttgcgtgttacgcggccgcccgtgtccgtgatgatttttacttggaatctggtacttagtcagtttttttccatcctggccaccatgttgtccaagggtatcatgctgcgtggcgctctaaatctcagcctctgtcgcttagtgctctttgtcgacgacgtgggcctatattcgacggcgttgtttttcctctttctgatactggatcgtctgtcggccatatcttacggccgtgatctctggcatcatgagacgcgcgaaaacgccggcgtggcgctctacgcggtcgcctttgcctgggttctttccatcgtagccgctgtgcccaccgccgctacgggttcactggactaccgttggctaggctgtcagatccctatacagtatgccgcggtggacctcaccatcaagatgtggtttttgctgggggcgcccatgatcgccgtactggctaacgtggtagagttggcctacagcgatcggcgcgaccacgtctggtcctacgtgggtcgtgtctgcaccttctacgtgacgtgtctcatgctgtttgtgccctactactgcttcagagtcctacgcggtgtactgcagcccgctagcgcggccggcaccggtttcggcattatggattacgtggaattggctacgcgtacccttctcaccatgcgtcttggcattctgccgctctttatcattgcgttcttctcccgcgagcccaccaaggatctggatgactcctttgattatctggtcgagagatgtcagcaaagctgccacggtcatttcgtacgtcggttggtgcaggcgttgaagcgggctatgtatagcgtggagctggccgtgtgttacttttctacgtccgtccgagacgtcgccgaggcggtgaaaaagtcctccagccgttgttacgccgacgcgacgtcggcggccgttgtggtaacgacaaccacgtcggagaaagccacgttggtggagcacgcggaaggcatggcttccgaaatgtgtcctgggactacgatcgatgtttcggccgaaagttcctccgtcctctgcaccgacggcgaaaacaccgtcgcgtcggacgcgacggtgacggcattatgagcggcggcgctgtacggcagcggggagaaaagtggcagataaatcacgtcaggttcacacgtcgttagccagcgtcggcatatgaagggcgcgggcggccagtacggcctctgggctgagacaggacgaggcagggtgagaaagaggaggatgggggggaccggggtggtggtgctgctgctgttgtgggtgcggacggtgcgggtgccgggacagcgtgccggcgaacgttctgtaatcttccataataaaagtaaaaatgcccgtctcgtgtcgactccgctggatctcgaaggcgtcgggggtaatgcgcatcttgccggtgccgatgagataaaagtaccacattttttgacagatgatgcgaatcaagggttcgtacgcttcggcaccccagtggcgcgtgaagaaggccgccagacgaaacaagcggtgtccgtagagcgtgcctagggagaagaggatgttgccgttgcgcgccaggtcttcggggaaaacgaccggcaggccggtgtggcgctgcacaaagcgcgtcagcagtccgccgctcaagcgcgggtgacacaggcgctggctgagacgggcggcgcgcgtttcatcgaacacggccgcctcaaagtccagccccgggaaggcctggcgcagttcgcggtacagatgaggccagtagggttgcggcgtcttgcgactaagcacggcgtggtccgagacacccaggttgttcatggtttcgcgcagtagcagcgtttcgagaccgcggtgaaagaggaggacgcagatgaggcgtacgatcttgagttcttccaaacgcagcgagctcagcggctgtccgcgcgacatcttctcgctaatctgtaatattagatgattggcgcaagtaaaggagaatttgcccgtgcggacccgcgggacggcggggttctcttcgtcgcgggccatcatcgttcgctcggtgagcgggtagcgacggtgacgacaatgacgatggacgagcagcagtcgcaggctgtggcgccggtctacgtgggcggctttctcgcccgctacgaccagtctccggacgaggccgaattgctgttgccgcgggacgtagtggagcactggttgcacgcgcagggccagggacagccttcgttgtcggtcgcgctcccgctcaacatcaaccacgacgacacggccgttgtaggacacgttgcggcgatgcagagcgtccgcgacggtcttttttgcctgggctgcgtcacttcgcccaggtttctggagattgtacgccgcgcttcggaaaagtccgagctggtttcgcgcgggcccgtcagtccgctgcagccagacaaggtggtggagtttctcagcggcagctacgccggcctctcgctctccagccggcgctgcgacgacgtggaggccgcgacgtcgctttcgggctcggaaaccacgccgttcaaacacgtggctttgtgcagcgtgggtcggcgtcgcggtacgttggccgtgtacgggcgcgatcccgagtgggtcacacagcggtttccagacctcacggcggccgaccgtgacgggctacgtgcacagtggcagcgctgcggcagcactgctgtcgacgcgtcgggcgatccctttcgctcagacagctacggcctgttgggcaacagcgtggacgcgctctacatccgtgagcgactgcccaagctgcgctacgacaagcaactagtcggcgtgacggagcgcgagtcatacgtcaaggcgagcgtttcgcctgaggcggcgtgcgatattaaagcggcgtccgccgagcgttcgggcgacagccgcagtcaggccgccacgccggcggctggggcgcgcgttccctcttcgtccccgtcgcctccagtcgaaccgccatctcctgtacagccgcctgcgcttccagcgtcgccgtccgttcttcccgcggaatcaccgccgtcgctttctccctcggagccggcagaggcggcgtccatgtcgcaccctctgagtgctgcggttcccgccgctacggctcctccaggtgctaccgtggcaggtgcgtcgccggctgtgtcgtctctagcgtggcctcacgacggagtttatttacccaaagacgcttttttctcgctacttggggccagtcgctcggcagtgcccgtcatgtatcccggcgccgtagcggcccctccttctgcttcgccagcaccgctgcctttgccgtcttatcccgcgtcctacggcgcccccgtcgtgggttacgaccagttggcggcacgtcactttgcggactacgtggatccccattatcccgggtggggtcggcgttacgagcccgcgccgtctttgcatccgtcttatcccgtgccgccgccaccatcaccggcctattaccgtcggcgcgactctccgggcggtatggatgaaccaccgtccggatgggagcgttacgacggtggtcaccgtggtcagtcgcagaagcagcaccgtcacgggggcagcggcggacacaacaaacgccgtaaggaaaccgcggcggcgtcgtcgtcgtcctcggacgaagacttgagtttcccaggcgaggccgagcacggccgggcacgaaagcgtctaaaaagtcacgtcaatagcgacggtggaagtggcgggcacgcgggttccaatcagcagcagcaacaacgttacgatgaactgcgggatgccattcacgagctgaaacgcgatctgtttgctgcgcggcagagttctacgttactttcggcggctcttccctctgcggcctcttcctccccaactactactaccgtgtgtactcccaccggcgagctgacgagtggcggaggagaaacacccacggcacttctatccggaggtgccaaggtagctgagcgcgctcaggccggcgtggtgaacgccagttgccgcctcgctaccgcgtcgggttctgaggcggcaacggccgggccctcgacggcaggttcttcttcctgcccggctagtgtcgtgttagccgccgctgctgcccaagccgccgcagcttcccagagcccgcccaaagacatggtagatctgaatcggcggatttttgtggctgcgctcaataagctcgagtaagagagacgctatatttagggcttccctctcttttttttctacaccgtgataccctaataaagcacaccgcggttattatcaacgtctctgtgtttttattatttagaaataaatacagggaatgggaaaaacacgcgggggaaaaacaaagaagtctctctctagatgcggggtcgactgcgtggggtgctggaagtggaagcggtgctgatgggtgagggtcgtggcgcgggcacggaccgcaacgtgctgctgatgtctgccgcggtacgcacgtcgccgtccatgtcgctgcgcagataagaggtaggtcgtagtgcggcgtgctgcacgctcaccgttaatggtaccaagtcgtcaaggctcgcaaagacgtgccacgaggggatgacgagcgtgagagccccgttgttaccgcttcgacgtctttgtccggtcaggatcagtgccggggacagtccggcttgggtgtccgagtcctcgtcgccgctggcttcctcgaagccggcaaacatggcttcggacaggggggtcggcgtcggtgtggaggagaggtcatcttcgtcgtcctcttcctcttcttcctcctcttcctcggtgggtggtaatccgggggactgcgggagaaactcggagacggcgccgcgcatgacgttgctccgtggaaagagaccggcgcgcagctgcacctggggacgcttgattttgtccggtttaccgggtgtgagagtccaaaacccacggcggaaaaagtggatgcggcctagcggctgtcggtgttccaaatgaacggcctgatcgccggtcagcgtgacgcggagggtgattcgcacacgatcgggtagcgggccggcttctatggagacgcccgggatgttttccgggaaaaagatggtgtcgtgagtctgattggtctcgaaagcattctggatctgcacgatgtactcgggatgtatgcgcgtcagcgtaaaacttttgggaatcaacagctggaagccgttgtccggcaagcgtcgtaggtgcgggtacggattgtgtcgcgccaccacctcggcgcgatgcgtgtaaaccgaaaagtgcagaaacacgctggtcggcgggtgcggtgagtcgtgatgcagaaacagcatgatccattggcctcgttcgtccgtctccgttttgtggatgtacgtgttagggtccgaacaggccagctgctccagggcgtctaccagcgtcagcgggatggcgccggcgcgaaaggcgaactggctgacaaagatctgccctgcctccaaactgctgtcggttctgcggcgccagttcggcgttacggtcagtcgcacggcccagtggtgagccgtgcggcggatgatggcgcgcgcttccattcgcggccgattttcttcgccgccgcgccgctggctctgaaagaggtgcagtccgctaacgggcacgcggtccagcggcagcgcaaaggccagtaccgagaccgtgttgttttctgagcctggcgtcaggcgtcgtgggccaaagttgttgaggtccaccagcagtcggtcctgttcgcccaccacgcagcggcccttgatgtttaagtcggtcaggtctacggtgtcgtgcggagatttgttctcctgaaaacagcagagaaccgagggccggctcacctctatgttggtacgcaggtccaggagtcgcagacgaccggcttccagcgagccgccttccacgttggtgatgagccgaagcacctggcagtgcaggcgaccaaagcttccgctggcggcttcggcctcgctgatcgcggccgcttccgacgagggtccctcaccgggcgaggacgatgcctgagacattgcgaaggcgggatggggggagggtcaggggatgcgcaaaggtgaacgggtcttcgtgggaggtcgggaagggttccggcaactgtcgcaaatatagcagcggtgacaggtgtggcggccaaaagttgcgtgtctgagtggacgtgggtttttatagagtcgtcctaagcgcgtgcggcgggtggctcaacctcggtgctttttgggcgtcgaggcgatgcatggcccgggcaaggcgtcttgccggtggcggcgacgtttgggttgcgcagcgggctgccatacgccttccaattcggcgaagatgcggtagatgtcgttggcgtcccagaagaattcctggtacttcagattctgaccctgaaccgtagccaccatgggcaccaggttgcgggccaggatgccggcctgccagggcggccaggtgaacacggccggattgtggatttcgttgtcggaatcctcgtcggtgtcctcttcgggcgcgacggtggactcggccttaaggcggccgcgtgtcataacgcccgacgtgcacgccgtcgccgaggatgctgatttgcgtttgcggcccgcggaagtggaggcgcccgccatggcgccgccgccggtgacgcggggcgtcttgcgctcggtggttacgagttcttcgtcggagtccgatccgctggtccagacgtcgtcgtcgccctgggcggcaccctcgtcgtgccggtcccaggtgtgtcggtactcaagcttgccctggatgcgatactggctggtgaaggtggggtgctcgctgtactgaggcccgcgctgcagcagcaagtcgatatcgaaaaagaagagcgcagccacgggatcgtactgacgcagttccacggtctcgcgtatggcttgtacctccaggaagatctgctgcccgttcatcaacaggttacctgagatgctcaggcccgggatgctcttgggacacagcagcccaaaatgctcgtgtgaggtaaaagccacatccagcatgatgtgcgagatcttgcccggtttgattatcatatttttgggacacaacaccgtaaagccgttgcgctcgtgggggcgcatgaagggttgcgggttgcgggtcatcgtcaggtcctcttccacgtcagagcccagcgtgacgtgcataaagagcttgccggagggcacgtcctcgcagaaggactccaggtacaccttgacgtactggtcacctatcacctgcatcttggttgcgcgcgtgttctccatggagcaaaccagctcgtgcgcgcacaccacgtgccgcagtgccacgtccttggtgggaaacacgaacgctgacgtgtagtagacgtcgggctctttccactggttctgctgacgcgtccaggccagtcccgagaccgtgagacgcgcctgccacatctgcttgcccgacgcgtgaatcacagcgtcagctacgggcaggtgtcggtgtttgcgctcggccgccgacgggtagtggtgcacgttgatgctggggatgttcagcatcttgagcggcagcgcgtacacatagatcgacatgggctcctggctggggcagatgcttcggcccgtggggttgtgcacgttgaccgacacgttctccacctcgctgcccgtaaagtacgtgtgctgcacctgcagctgattgtcgccgcggtggcatggcgtcgagtcgggcgtgtactgcgataccaagatcagcgagggctggctcacgcgtacgtggatacccgtctgcaggagtcgcgtctcgtgcggcagcaccggcgtatcgccgcgactaaacacggctttcagcacgtgccccgaaatgggacccagtacggatatcatttcgggacaacggcgaccgcgcgactccatgctgcctgcgcgtacgggtgtaggcgactgagcggcgcgccctctgcggccgccgccttacataggcaggcgaccaaacgcggaacccgaaataaaaacgttctacacagagacaaccgcggattattgagtgtctttttttattacaaaaaaaagaggcgaagccccaccgtcaccacaccccatcacacaccaccaccgatttttttttgttttaatcccgtatggcgcggacgcctagtgtccgtttcccattatcagggtcctctgtttagagatcgccgcagaccatggctaaagtgacaggactcgtcttctctgtcgtattttccgtaagcttacagtcttgcggttccgtctccggggacgccagtcgcatgggcagcaggtcctccagcgcgatggaagcgcccagcaccgagagctgctgttgcgacggcgaatgggatgtggaccgcgagtgtagcgtggatttgacttggtgcgtcattgctgacaggcaaccccgattcagcgtatgctttgacgagataaaatagaggcgccccaggagcgcgtcccgtgggaacgtggcgccgttctcgtcgctcaccagtacggttaattccaaccaggagcgcggtagccagaccgtaacgggcattttgagtccctgacggttgtgtggtacaaaaacacccagataaggcccgtaaaagcggcggtagatacgtaacgtgtgcgagttcttcagcgtcaattcgtaagggacgcgcacctccagtccctcgtccgccgcgccggagcgtggcggtacaaagtaaggcagtggcgcgtccgaaaagaagggtcgtcgcaccgtttcgcgtcgcagccgcaggcgaaacgccactgggtcggctggcgcctcggtgcggtcgcaggtcacgttgaaacgtaatatgccgtcttggtatagcgtgagtgacgacagcgtcaggtccggcggtgattcgttcgggtctagctccaatcgtccaaagacggagggtcccaatgtcttggccgtggtttccgagaggcgcgccgagatacggctggtgagtccacgcggccccgagatgccgccttccactcgatgccagcacagcgcgtgtcgtacgcgcaccgtcagcgtgggcgtcagatccgcgtccgttgattccgcggtatcagcgacggaagccgcgttctccgttacgttgtttatatccagcgtcggctcgaacgtgagttctggcagatgcagcgccagacagtcgtgtaacgccgtgtgatgcgcggctttacgtcgtagcggtagccgtttcaacagcggcgtgatgatacggagcgcgaagagattgagtgataggcgcacgatggccatgcgcgtcagttgttggtcaattaccgagcgcaggatatggcagcctgggcgtgcgggaaagagagagaaggccgggcgcacgtcagaatcctcgttagagaccacgcatagaatgccgcgttcacgatcgtcgttgcggtcatcctcgtcctcttctttcttctcttgtttttccttttttttctcgggctcgtgggaagccgccgtttcttcttcttgcaacgtcgcgggggcggtttgagactcgtcgttcgcttcccccaattgcagcggcgtagagagcagaatctggaagggatcccgcaattcttcgggtcggaggtcgaggtgcaactggatcagatggtaggtgccgcggtgcacccgaggctgacggatgtcgtgtttatccgtcagtgtgaggatggtctgcggcgagccgctgtacttgtccagctcgtccggcgttttcaggaggagactgtcgtcgtcggtactggcgacgcccatcatggtcgtggtggtagtggtggcgaggaaagtgagcggcggcgccgacagagctcggcgttggcggcggcattttccgctgtgtcggctgctattgctgccaacgccaccgccgccgcctcgtctggctcgtggccggcgggcccgattccgaaggttggggtcgacgcgtggcatgcttggtgtctgcgggcgcgagagggccggctcagcctttaaatatgcaggtcgcggatttgttatcgggtgaaacgtcacacaccgtgaagacgacctgttcgcggatgaggtcatccagctgtcgcagcatgacgaaaagcgccgacagccgcgcgatctcgtcgtcgggcgacacgtgctgcggccgcgcgggcgtgcgcggctcgccgacgctgcgctcgcggtccagccgcatcagcagctcctggcacttgacgagcagcatggagctgtcctctagcgccaacttgcgcacgtaggtcatggtcagctccgaggctaggttggccaccatggacatggagaggcaggcggtcttcatgtcgatcagcaggtgctggtcgatgaccggatcggggatggtgaaggtggcgtcgcgaaaagtaatggtctgcagctgctgcacggcagcctttacctcctcgtacgaacggtcgagcgagaagaggcccatgatgagtagtcgctggttgatttccagcgccagtggcatgggtacgatccagggcagcaccagctcccactggcccagcgtcagcaggttctcgcgcgccagcggtccgtggaagagcggcggcagcacgcatagcgcgtcgcccttctcccaagtcacgggtcccgtgttgaggacggtgtagagcagtccgtgcgtgggtacgtgtaggaggatctggttgccttctacgcgccgcatcaacgtcagcgtcatattgcgcagcaggccgcgcagtcgtacgtagccgcgggtgtgatctacgaactggtgtaggcccagctggtagtgcttgatgagatgtagacgttgcggaatgggcacaacggccgctactagcttggtcagtttgcctacgtcggcgatgctgagcttgtggtcgaaagtgcagaagatgttggcctccatggccgccatagcggcggtgaaatcctggccgcgacggaggagaggcagagacgaacaacgtctgcaccgggcgcggcgtcagagcgagcgtggcgcgtccgggcccgcgtttgcgtctaggtgactcgccgctaacctgcggtcgtcgccgtcctcctcaccggacggcctcacgagttaaataacatggattgctgcagcgggatgatttcgcctacgacgtagttaccaaagtgcgtttcggacgtagcaaaagccccggcgccacccttgagtttggtctccatcagcgccagcgtggtggtgctgaggatcggtagcgcttcctgcgtcagacggcacgggttttcgatgagttgttccgtgccttcgacgcagacgtactgcgtgtccgtgtcgccgcggatgcagtccttggcgcgtagcaggtactcgtcgatggttttgaagagcgttttgttggccgcgataatctcttctgtgttaaagtactgcgcgcaagggctgtagaatttggagttgtagcctagacgttcgcgatgtcgggtgttgtagagtacgtcgctcagacagccggcttgcgaggcccaggggttgtgtgtggccgcgaaagtctgtgcgtccgcttcgcgatggtcgtagatggccttggtggcggcctccgtgtcgtacggatcgacggccagcatgcaggaggcacgcccgcgcgggttgttggggatcttaaagtaattaacgtccatcgtcaccggcgtaaggattagttcgcacgcggccttttgtccgtgcaccgtggcggcggcattgcgctcggacatgctgccgaacgtcagcatagagatggtctccgtgtctaacagttgcggccgttctacgccggccgcgtgccggatccagcggtccacctcgtcgtgccggtacacgttcatagggaagacgcgaaagaggtcctgcacgcggacgcccatgtcggttcgcacgcggtttacgtaggctacgcaggtatttgacgtgtaacccagacccatgtctacggtgttaatgttctgcgtgacgtggtacgtagtgctgatgtcgcgttcctccttggtcacgatagggttgttgatgataactgacgtgcatgatttgccgctgtagagcagcatgtccacctcgaaggtgtcggtgcgtacggccgtgagtgcgaatcccgggtggatgtgcgccttggtctgcagcaccagtgaaactggtgagattttgtataacatggcggccagcgtcatgactgagtgcaacacgttgggacaggtggccgagtaacgcgaaaagggcgagcgcagccagttgtggtactcgtgcgcgaaggctgtgggtagcgggaaaccaccgtcgtgacggtgatagtgcgggaactcggtcacgtagcgtttaatgtcgtcgctcaacgccgcgcagatggtggggtttgagtagaaacggtggaaaggtacgggtaggctgtactcgatcaacgtcttaggcgccgtcacgacgcagcagccgttgtaaagcacgtgctgacgtgagataaagtccggcaggccctgacgctgcgcgtggtccagaggcgcgcgcacttcgagcaccttgacgtgctcgcccacgaattgcacggccaaaaacagttcacgacaggcctgcagcagcggcgtatgtgcgtcggtggcgacgtcctccaccagctcggtcagcatctcgcctacggcttgacgttgcgccgctatcgagtcttcgggggtgacaccgcttgtgctctctttcgacgtcgtacctgacgtggagaccgcggtggcggccggcatcaggagaaacgccggtcggtaaaagaggtctactagcagcgtcttgaggttgagtcccaggccgcaggcccggttgttggtcatggcgggcatgaggcagagataaaagaccttttgtaacgtccattcgtcgtcggtggcacggtaatcgtccacaaacagcggctcgtcggcatccatggcgcccaaacgcggtacgtccgaaacgccgtggtgtcgcgcctcgatgttggccgggttcaacggttgccggtcggccactacctgtacgccttccatgttacgcggcaggtgcgtaacgaaggggggccacagccggtggtcgtgcagcgcgttcacgtaagccgatagcggttcctcagccagttgaccgttgttaagtcccggcagcgctgagatgcgcgttaccagacgcagcacggcgaccagattgcggtagtgaaagagcaactgcggtggtagggcgccatcagccaggtgttcggcgatcaacgtcaccagcgcgtagctgtgcgcaaaaaccagcagctgacgtgtgtgaaacatgttgacgatacaacgtgctacgaaagtgcggattagcaaaaaagcgtcgacgttgccgtgtaccagcacgtcgaccaggtagcaaagctcggggtaattggggcttgtcacggtggttttgaaaagtcgcaacgtctcttcgtagtcgggtggtggccgcagtcgcatgtgttccatgatctcccaggtgcgcagttcgtggaaggggcccggtgccagtccatctggcaaattaccgatgacgatacgcggtgtacacagcgccaccgtttcgctgttttcctggcagtgcgtaaagtcgaagaaggggtgcagctcggtgtagagcgtgatgttgcccaccttgtagaagtcggtgaccacaaagtcctgcttcatttcgttcaccgtgcgcgggacctcgcgtcgtacgcggtaaaaatgcggtatgcggcgcgccgcaccgcccatgggttcctgctgaaaacgacactcgagcagtcgttgcatggcgggttccgagggcggtccgcgttccgtgaaggtctgtagacagggcgcgggctcgtgcagcaccgggtggcacagcgtcttgagcgcgtccacaaagtctattttttgtacggcacggtcccggtttagcaggtaggccgtggtgggcaacgcgttgcgaacggtgtcgttaagcttaactttgctttccaccgtggtgtaaccgcgatcctcgggcagatacagccctacggggaagaaaaacgtcaggtccacgttacgttctagcggatctttggtatcggtgtttttgtagacgcgccgcaagttttccataatcaccgttttttcgcccagtcggatcacgtccatgctcagcggcgttaagctgtgcgccccggcctgcgaaagcgagtcgttgggcaaatgcggttggcccgaagtcagatgagccttgtacgagttgaaatcggccaggatcgagtgataggatatggcagtgacggcattttcgggactgagtacaaaattgccgtaggtggccggcgccgagaccgtttctttggtgatgtggcttgagagcagcgacatgatgatctgcataacgttggccgtgcttaccatcacgccgctgatcttggcccccgagctcgtggtgtacgtggtggggttgtctaggatgctatcggtggccgcttcggccagacgcgtgaggaacttgagcacatagtcgcgatcgcgcgtgcgattcagcaaaaagagcgtggccagcattttggccttgaagctctgcaagatgttgcttcgctggatgcggttcagtgcctgtcgcgccagtgtggcgttttctaccagcgtctgcaccacaaagtacggcggcgccttgcgtagcagtgtctgtaaaaagctgtgaatcaagccgcgctccatggcgtcggccgtgtttttaagcgcgcgcagcaccgtgtgcatggcttccacgttgaggatcttgtccaagatggtgccctcgaatgtctcgcgcagatacgtgaggcaggctgcgctgagctcgaaggggatggtgatgggggatttttcactgtatttggtgaccataatggtggtctgacgactagtgggcaaaccggcgccgctggccacacgcggcacctgcacgtggaacagcattttgcccgtagtcagtttattgaggtcgtggaacttgatggcgtgcgccgccgcggccaagccgctggtcaaaaaataaacccattccaggcgattgcagaaggtgccgaagatggcttcgaagtgaatattgtaacgctcggggtcatcgccgtagtagatgcgtaaggcctcaaacatctcctcgccggcgctggtcttgacgtgcgtcagaaagtcagtgggaatgcctactttaggcaggagctcgagcgccgaccagttctccatcgcggcggcggcgtgagcgcgaggcgtcggagctcggggaaagcagcgcgacccggagaatggccggcgctgcgccgcgccgcctcggctgtgacgctctaatagtcgttggcggctccgctatgccgcgccgggttttacacgtccccgtgcacgttcgcgcctgcaacctcacccaagagctatcgacgggcgaggacgcccgcttttgtcgtccgcgacccgttaacgtcgaacgggtgcgcgctgtttttgcggctctctaccgtgcctgtccgatacacgtgaggaccgagcccgagcgtgtcaagctggtactgggtcgtctgttactgggacccgtggccgtaccctgtttttgcgacggtgaagtggagggccacggtgaacatctggtacctacgacgcagttttgtcgcgggccgctgctctacgtgcaccgacgttgttgttgcggatccgtgaccgccgggcgcgcgctgtcctaccacgttctcgaaaaccacgtggccacgcatgtgctacgcggattgctctcgctgacggaatggaatcgagaattgccgagcctcttttgcgactgtcctggcggcggtggcgcctcgggaaccgaggaacgctacgctatggcctgcctgccgcgcgacctcagcctgcacctggacgactatccttacctgatggtggaaatcggacgcgtactcagtgtcagcgaggtagacgactacgtaaccgccgtctccggctacctgggcgaggccgcggcgccgcgcatccaggttcactacaagctgctctttggactcaacgtgcgtccgcaagcgccgtgcgcgttggacgctacacgcgacttttttctgctggagctgcaaaagctttggctgggcgttgaatatcaccacgaagtcacgtcggagtttttcggtcgcgtactggctcagctgcatcgcgaccgcgcccgcgtcatgatggcgcttcgcttgcccgagcagacggtgtgccacctgagcaccttcgttctcagtcgcttcaagcgacaggtactgtacttcaagctacaggtgagctacggcaagtgccggactggtcacgctgacagaagtgggggaggggggaacggtggaaatcagggacaccacaacctactgtgttatcgacgccttagcgtcacatttgccgacacagacacggtgtggagaaaccttttctacgtttattacgaactagctcgggatctggggtcccatgggacggaggaccgacccgtaagccgcggttacggtgtttcttgcgcttcgaggacgtcgcgactgtcaccgtcagaatcgacggtggtttcggcgaacggacacgcgctgtcttccaccgcgctcccgacgacgagcgcgggtcacaagctgtcactgccgcgcgacccggccgcagatcgcgttcgacgttacgtatgcattatctcgcgtctcatgtacgctcggtacggggagagatggcgtaaacactgtcaacggcggtcggagacgggagaagaggaggaggaagagacgctggaatcgggggagactgacgccacgccgccatttgactttacggggcagcagctgcgccgggcctatcaggaacaccgacgtcgtaaacatctagccgtgcagcgttacgcgccgtgccgtcgtaagctcatcggcgggatggagtttgccgaggtgacgggcgtgagtctagaccgcatcgccgtcaacgctttcaacaccaaccgcgttatcaatatgaaggctgcgctctcgtccatcgccgcgtcgggtctcggcgtacgcgcgccgcggcttcccaagaacatgacccacagttttgtgatgtacaagcacacctttaaggagcccgcttgcaccgtcagcacttttgtttccaacgacgccgtctacatcaactcgctcaacgtcaatattcgcggttcctaccccgagtttctgtactcgctgggcgtgtaccggctgcacgttaatatcgatcacttttttctgccggccgtggtgtgcaacagcaactcctcgctggacgtgcatgggctggaggaccaggcggtgattcgctcggagcgcagcaaggtgtactggaccaccaactttccgtgcatgatctcgcatactaacaacgtcaacgtgggctggttcaaagcggctacggccattgtgccgcgcgtctcgggcgccgacctggaagccattctgctcaaagaactctcgtgcatcaagaacatgcgcgacgtgtgcatcgattacggtctgcaccgtgttttcacgcaactagagctgcgcaattcgtaccagatccccttcctggccaagcagttagtgctgtttctgcgtgcttgcctgctcaagctgcacggtcgagagaagcggctgcagttggaccgcctagtatttgaggcggcacagcggggtctctttgactacagcaagaacctcacggcgcacaccaagatcaagcacacttgtgcgctcatcggcagtcgtctagccaacaacgtgcccaagatcctggcccggaacaaaaaagtcaaattggatcacctgggccggaacgccaacgtgctgacggtgtgtcggcacgtggaagcccacaagatccctcgcacgcgcctcaaagtgttagtcgaggtgctgggcgcgttgcagagtatcagcggtacgccgcacacgcgcgaagtgatccaccagacgttgtttcgattgtgctcggcggccgcagccacatcgggcctgtgttcatcccctcccccattgtgtgtgtcctcatcttcctccgtcccttctgtcccaacctccgtcagcgttgacggcagttctgaacccacgtcgccgcgagcgcggtttgcatcacgatgatggaagccgcggccgctgccgccgcggcgtttcgtccggaggagcgtccgacgccgggttggcacgacgcggcgttgttaatggacgacggtacggtgcgcgagcacgcgtttcgcaacggaccgctgtcgcaactgattcgccgtgtgttaccgccgccgcccgacgccgaagacgacgtggtttttgcttccgagctgtgtttttattgcagcggtcgttttaaccgcaggtcgtccgtcttctccatctattggcagaagcatagcgatctggtgtacgcgcttacgggcattacccattgcgccaagttggtggtggaatgcggtcagttggggagtagtaggctacggtggcgcgacggtgatgcgagtggtgaggagcgccggggagacgacgacagcagggacgagctgtacgacgtgccgggcatttatatgattcgcgtcaacgacggcggcagcaccggccccagacacgttatttggccgggtaccagcgtgctttgggcgccggacgttgtgatcactacggtgcagcgacgaatctcggcggcgcgcgccctggtgaacacgttccgccaatatttttttttgctggaacggcgctcgcacgaggagctggttctttgtccgcccgagatggaggagcgtctagcgccgctgttgcagagtgccacgcgcggtgattcggacatgtttgacggtgtggtggccagcgcttatcaccgtttgcgaatgagtaatattccgcgttcatccgcccgtctgctggaacactgcgtggggctggcgggtgctaagaagctgctcttgctcgacgtgccgcgtctggagaactattttctttgtcaagtctgtctttacgagctggacgaggacgagatgggcgaggagatgctgggcatgttggccggaaagcccgaggatgccgccgtctcgggcgcaagcggcggttttctgctacatcgcaagacgatgaagctggccgcctgtctgtgtttgttgctcaattcgctgcatttgcaccaggaggcgctggaggccttggatcctccgccgccgcgcgtcgaggagaacgaccttgtcaacgtggtgctgcgccgttattatcgcagtcacggcggcgtgcaggcgcggacgctggcggcggcccgggctttgttagccgactacgccgaaacgttttcgcccttggggagttttacgcgcctgggttacgatcgtctcgtttctgccgatgccggcgtcagtcgccggcacctggtggctctgctgcgtgcctagctgaccctgaaacggatggcgtgtatatcgtcacacaggtaggtggccatgatgacggcgatgataagatcgtccgagatacgattctggcgcttggccgagtaacgcgccgtcgtgccttcggccagcgtgacgcggtgcaggttctgaatctgctccagaagatactcgatggggtcgtggctcagcttgatggtgtaggagacgagctcttgcgaggctttgatgtagcccgagttgaaacgcgagatgaactgttccacggccagcgccttgtcgcggcccatgaggtagaagggctgttcgatgtggttctggtcgggcgtgtggtagaagagcacgcggatgagcgtgctgctctgcacgctctgtcggatgaggcaggcgatgcgcacggccgccgcctggttggtgttgccctccacggcgatgcgcagttcgtccaggtaagggtgcaggctcagcaccgagatgatcatgtgcgccgcgcactcggcgatggctacctcagaactctcggagaggtcgcgcaaaaagaaatgctctaggccgtaaatgagaaactggtgtcggtaggcgcctacggccgccacgcccgtgcccgaggccttgcggttggtggtgaaggccgggtccagatacacgtaaagcgtcttgccgaaataatcgtaggcgttggtgttgagcgtgctgtaacgcaaaatatcgaactcttcgcggctctggtccgtgatgagcacggtgttctgcgagattttattggtaccgccgatgatctcgtccatgaaagcgcccggcataaacatgttggccgtcttgcgcacttgcgagttgaggctgatgaaggtgggcttgtgcagtcggtagcaaggacacgccgtggcgtcgcccttctccgtgaagctgtgcaggtgctcttcgcacacgtaagagaccacgttgagcatgtcaaagggcgcattgttaaggcgcgtcaagaaacacgtggagtcactggtagtgttggtggacgatatgaagatgatcttggtggtattctgggccaggaaccccagaatggtgttgaaggcctctttcttgatgaagtgcgcctcgtccaccagcagcaagtggaagttttgtcctcggatgctctgtgtagagaggagacagaaaagggactcttatgattacgcacgctcgactggaagcctacagagtcggggtggggccggacaggtgagccaggtgagccgccaggtgaggcgggatcgccgtgtgccaaccgggctgcgacctgaaaaccggaaccaatccgccgacaccggcgccgcgtgacgcgcgcccataaaaacgaaagtgtcgtcgtcgcgacccgccacagccgccatgaactcgttgctggcggaactcaaccgactaggggtcgcgcacgccactacggaggatgtttttatctttgtcgaccgcctctttcaacacttttccttccttttccaggccgaggagtcaggcccgcgccgcttggaactggtcgcgtccgtgttcgagcacctgacggtggagtgcgttaacgacatcctggacgcctgcagtcacccggacgtgaacgtcgcggagacaagcaacacctgtcgtccctgcccttctcctgttccctccgcccccaaaactgtcagcggcgctcagacgtcatgtgcgacgcctcgggcgcctgtgacatgaggcacgtccagaacgcgtttaccgaggagatccagttacactcgctctacgcgtgcacgcgctgctttcgcacgcacctgtgtgatctgggcagcggctgcgcgctcgtctccacgctcgagggctccgtctgcgtcaagacgggcctggtatacgaggctctctatccggtggcgcgtagccacctgttggaacccatcgaggaggccgcactggacgacgtcaacatcatcagcgccgtgctcagcggcgtgtacagctacctcatgacgcacgccggccgttacgccgacgtgatccaggaggtggtcgagcgcgaccgcctcaaaaagcaggtggaggacagtatttacttcacctttaataaggttttccgttctatgcataacgtcaaccgtatttcggtgcccgtcatcagccaactttttattcagcttatcatcggtatctactcaaagcagaccaagtacgacgcgtgtgtcatcaaggttagtcgtaagaagcgcgaggacgcgcttctgaaacagatgcgttccgaatatggaaacgcacctgtattcggatctggcgtttgaagcgcggttcgctgacgatgagcaattgcctctacacttggtgctcgaccaggaggtgttgagtaacgaggaggccgagacgctgcgctacgtctactatcgtaatgtagacagcgctggccgatccacgggccgcgctccaggcggagatgaggacgacgcaccggcctccgacgacgccgaggacgccgtgggcggcgatcgcgcttttgaccgcgagcggcggacttggcagcgggcctgttttcgtgtactaccgcgcccactggagttgctcgattacctacgtcaaagcggtctcactgtgacgttagagaaagagcagcgcgtgcgcatgttctatgccgtcttcactacgttgggtctgcgctgccccgataatcggctctcaggcgcgcagacgctacacctgagactggtctggcccgacggcagctatcgtgactgggagtttttagcgcgtgacctgttacgagaagaaatggaagcgaataagcgcgaccggcagcaccagttggccacgaccacgaatcaccgtcggcggggcggactgcgtaataacttagacaatgggtcggatcgccgtttgcccgaagcggctgtggcttctctggagacggccgtcagtactccattttttgaaattccgaacggagcaggaacctcctccgcgaacggcgacggcagattcagtaacctggagcagcgggtagcgcgtttgttgcgcggcgacgaggaattcatctatcacgcgggtccattggagccgccttccaagatacgcggtcatgagttggtgcagctgcgcctggacgtaaatccagacctcatgtacgccaccgatccgcacgaccgcgacgaggtcgcgcgtacggacgagtggaagggtgccggtgtctcgcgtcttcgcgaggtctgggatgtgcagcatcgcgtgcgcctccgtgtgctgtggtacgtcaattccttttggcgcagtcgcgagctgagctacgatgaccacgaagtcgaactataccgggcgttggacgcttatcgggcgcgcatcgccgtcgagtacgtgctgattcgcgccgtgcgcgacgagatctacgctgtactacgacgggacggcggcgcgttgccacagcgtttcgcctgccacgtgtcacggaacatgtcctggcgcgttgtttgggaactttgccgtcatgccttggcgctctggatggattgggcggacgtgcgtagctgtattattaaggcgctaacgcctcgtctgagccggggtgccgccgctgccgctcagcgagctcgtcgccagcgcgagcgctcggcgcccaaaccgcaggagctgcttttcgggccgcggaacgagagcggtccgcccgccgaacagacttggtacgctgacgtggtgcgctgcgttcgcgcgcaagtggatttgggcgtggaagtgcgcgcggcgcgttgtcctcgcaccgggctttggatcgtccgtgatcgccgcggacgcctgcgacgttggctctcgcagcccgaggtgtgcgtgctgtacgtcacgccagacttggacttttactgggtgctgccgggcggctttgccgtctcttcgcgcgtcactcttcatggcttggcgcagcgggctttgcgagaccgattccagaactttgaagcagttcttgcaagaggaatgcatgtggaagctggtcggcaagagccggaaacaccgcgagtatcgggccgtcgcttgccgttcgacgatctttagtccggaggacgacagctcgtgtatcttatgccagttgctgttgctctaccgcgacggcgaatggatcatctgtttttgctgcaacggccgttatcaaggccactatggcgtgaaccacgtacatcggcgtcgtcgacgcatctgtcatctacctaccttgtaccaactgagcttcggaggtcctttgggtccagccagcatcgatttcttgccaagctttagccaggtgaccagcagtatgacgtgcgatggtattacgcccgacgtgatttacgaggtctgcatgttggtgccccaggatgaagccaagcgtatcctggtcaagggtcacggtgccatggacctgacctgtcagaaggcagtgacgctaggcggcgccggcgcctggttgctgccgcgtcccgaaggctacacgcttttcttttacattctgtgttacgacctgtttacctcatgcggcaatcggtgcgatatcccttccatgacgcgcctcatggcggcggccacggcctgcgggcaggcgggttgcagcttttgcacggatcacgagggacacgtagatcccactggcaattacgtgggttgcacccccgatatgggccgctgtctttgttacgtgccctgtgggcccatgacgcagtcgctcatccacaacgaggaacccgcgacttttttctgtgagagcgatgacgccaagtacctatgcgccgtaggttctaagaccgcggcgcaggtcacactgggagacggcctggattatcacatcggtgttaaggattctgagggccgatggctgcccgtcaagaccgatgtgtgggacctggtcaaggtagaggaacctgtgtcacgtatgatagtgtgttcctgtccggtgcttaagaacctagtgcactaacggggtctgacagttcacggggagaagaaacaagaaacaacaaaaaaaaggaggacatggactcgccacggtttgtggcaaggcgtatgttatcatcatggagctactcacgttggtgttgtagcaactggcaaaaagcgccgtgctcttggcgccgcggtggtcgatgctgatcacgttgtccttgttctcgaccacgtagtcgcgcgcgaaggtgtggcggcagcggaactcgacctctttgagcacaaactgcgacacgtgcttttggtgcgccacgtagccgatgctgatgccgatcatgtgcttaagcagaaacgagataatggggatgatgaaccaagtcttgccgtgacgtcgcggcaccaggaacacggtggctttctgcttaaagatgtcgatggaggtctgcgagaggaagtcgatctggaaggcgtggatgaggtactgcagcacgcgattggccagcacggggatcttggtcacggctataaaaaagatgacgtgtatcaataaattcttttgaaacggttcgagtcggatggcttttgcgtcgccctcgacggcggtactgaagccgccgtcgagccactttttaaagtcggtcatgaagttgttgatctgctgaaactgcggatcgcggtagagctcggtcaacgcgtccagcttctggtaggaggcgcgctgctcctcggagcacgggcgaaacgtcagtttatcgagcgcgctcttgaggcgctcgtgaaacagcagctcgcgctggctttcctcgggcgagttgtagtcgcggtggcggccgcagaaggccatgagcggcaggaaggcctcgttgcacgagtgggccagcccgagttcggggtgcatcatctggtagcgcttgcggcacagcgtcgccacattggtgaaggccgtggagatgcaggaggtggggtggctcttgcgcttctgcagctccgcgtagcgctcctggatcttggcggccgagtctccgcgcaacatgatggcggcggcggtggtgcgagcggaggttaggcggcagcggcgagaggagaggaaaaagatggcggccgcgaggacgacggaggatccacccgaaaaccacgttgttgcggacgtggctcgtgggacgggcgccgtcactcgttcgtcttcgtcgtccctagtggtgtcgtcttcctcggcgtcaggctcggacgaatcttcctccgcctctcctctcagtttccccgtctcctccccctcaactgccgtcaggtctccggggtccgccggggtttcaacgtccctgtgctcggtggaacggatggtcgagctgtcggcgcagtctccggccgccgatttctcggtctccgaggcttggcgcttcgaggaggccgtaaatatggcgctggtggcctgcgaggccgtgtcaccttacgatcgctttcgcctaattgaaacgcccgacgagaatttcttgttggtcaccaacgtaattccgcgcgaatcggccgaggtgccggtgttggatagcagtagcagcggtggcgatagcgggccggaggacaaaaagaaaaacgtcgggaataaaaccgcgggggaaaagaacggcggtgggtctcgggccaaacgccgtcgtagacgacgcgctccgaaaaacgacgccgccacgccgtcttttctacgtcgacacgacgtgctggagcgtttcgcggccgcggctaagcctttgccgtcgctttgtgtgcgtgattatgcgttacgcaatgctgaccgtgttacctacgacggcgaattaatctacggcagttacctgttgtatcgcaaggctcacgtggagctgtcactctccagcaacaaggtgcaacacgtggaagccgtgctgcgacaggtgtacacgccgggcttgttagatcatcacaacgtgtgcgacgtggaggccctgctgtggctgctgtactgtggaccgcgcagcttttgcgcgcgtgacacttgtttcggtcgcgaaaagaacggttgtcctttccccgcgttgttgcccaaactcttttacgaacccgtgcgggactatatgacctacatgaatctggctgagctgtacgtctttgtttggtatcgcggctacgaattccctgcgccgacgccgcaggcgacgacggcgggtggtggtggtggtagtggtggcggcggcggggccggcgcttgtgcggtcgagacgagcgcgtcagcaggccgggtcgatgacgccggcgacgaggtgcatttgcctttaaagcccgtctcgctggaccgtctcagagaggtgttgcaggcggtgcgcggccgcttctcggggcgcgaggtgcccgcctggccggcctcgtcgcgcacctgtttgttgtgcgcgctctacagtcagaaccgtctctgtttagatctcgcgcgtgacgaggcgcggaccgtgagttatagccccatcgttatccaagactgcgccgcggctgtcaccgacgtcactttgagccacatcttgcccggccagagcaccgtctcgcttttccccgtctaccacgtcggcaagttgctggacgctctctcgctgaacgacgcgggtctcatcacgttgaatctatgacgtcggtcaacaaacagctcttaaaggacgtgatgcgcgtcgaccttgagcgacagcagcatcagtttctgcggcgtacctacggaccgcagcaccggctcaccacgcagcaggctttgacggtgatgcgtgtggccgctcgggaacagacccgatacagtcagcgaacgacgcagtgcgtggccgcacacctgttggagcaacgggcggccgtgcagcaagagttgcaacgcgcccgacagctgcaatccggtaacgtggacgacgcgctggactctttaaccgagctgaaggacacggtagacgatgtgagagccaccttggtggactcggtttcggcgacgtgcgatttggacctggaggtcgacgacgccgtctaacaggtatagcaatctccgtcacgcctctgttcagattttattaaaaaaaaaacacaacataacgacagtgtcggtgtggtagctagtgcagccttaggaacagggaagactgtcgccactatgtcctccgcacttcggtctcgggctcgctcggcctcgctcggaacgacgactcagggctgggatccgccgccattgcgtcgtcccagcagggcgcgccggcgccagtggatgcgcgaagctgcgcaggccgccgctcaagccgcggtgcaggccgcgcaggccgccgccgctcaggtcgcccaggctcacgttgatgaaaacgaggtcgtggatctgatggccgacgaggccggcggcggcgtcaccactttgaccaccctgagttccgtcagcacaaccaccgtgcttggacacgcgactttttccgcatgcgttcgaagtgacgtgatgcgtgacggagaaaaagaggacgcggcttcggacaaggagaacctgcgtcggcccgtagtgccgtccacgtcgtctcgcggcagcgccgccagcggcgacggttaccacggcttgcgctgccgcgaaacttcggccatgtggtcgttcgagtacgatcgcgacggcgacgtgaccagcgtacgccgcgctctcttcaccggcggcagcgacccctcggacagcgtgagcggcgtccgcggtggacgcaaacgcccgttgcgtccgccgttggtgtcgctggcccgcaccccgctgtgccgacgtcgtgtgggcggtgtggacgcggtgctcgaagaaaacgacgtggagctgcgcgcggaaagtcaggacagcgccgtggcatcgggcccgggccgcattccgcagccgctcagcggtagttccggggaggaatccgccacggcggtggaggccgactccacgtcacacgacgacgtgcattgcacctgttccaacgaccagatcatcaccacgtccatccgcggccttacgtgcgacccgcgtatgttcttgcgccttacgcatcccgagctctgcgagctctctatctcctacctgctggtctacgtgcccaaagaggacgatttttgccacaagatttgttatgccgtggacatgagcgacgagagctaccgcctgggccagggctccttcggcgaggtctggccgctcgatcgctatcgcgtggtcaaggtggcgcgtaagcacagcgagacggtgctcacggtctggatgtcgggcctgatccgcacgcgcgccgctggcgagcaacagcagccgccgtcgctggtgggcacgggcgtgcaccgcggtctgctcacggccacgggctgctgtctgctgcacaacgtcacggtacatcgacgtttccacacagacatgtttcatcacgaccagtggaagctggcgtgcatcgacagctaccgacgtgccttttgcacgttggccgacgctatcaaatttctcaatcaccagtgtcgtgtatgccactttgacattacacccatgaacgtgctcatcgacgtgaacccgcacaaccccagcgagatcgtgcgcgccgcgctgtgcgattacagcctcagcgagccctatccggattacaacgagcgctgtgtggccgtctttcaggagacgggtacggcgcgccgcatccccaactgctcgcaccgtctgcgcgaatgttaccaccctgctttccgacccatgccgctgcagaagctgctcatctgcgacccgcacgcgcgtttccccgtagccggcctacggcgttattgcatgtcggagctgtcggcgctgggtaacgtgctgggcttttgcctcatgcggctgttggaccggcgcggtctggacgaggtgcgcatgggcacggaggcgttgctctttaagcacgccggcgcggcctgccgcgcgttggagaacggtaagctcacgcactgctccgacgcctgtctgctcattctggcggcgcaaatgagctacggcgcctgtctcctgggcgagcatggcgccgcgctggtgtcgcacacgctgcgctttgtggaggccaagatgtcctcgtgtcgcgtacgcgcctttcgccgcttctaccacgaatgctcgcagaccatgctgcacgaatacgtcagaaagaacgtggagcgtctgttggccacgagcgacgggctgtatttatataacgcctttcggcgcaccaccagcataatctgcgaggaggaccttgacggtgactgccgccaactgttccccgagtaaccgggacgcggaacgtgacggttgctgaggggaaaggcaacagagaaggtacaaacccaccggcggggaaaataccgaggcgccgccatcatcatgtggggcgtctcgagtttggactacgacgacgatgaggagctcacccggctgctggcggtttgggacgatgagcccctcagtctgtttctcatgaacacctttttgctgcaccaggagggcttccgtaatctgccctttacggtgctgcgtctgtcttacgcctaccgcatcttcgccaagatgctgcgggcccacggtacgccagtagccgaggactttatgacgcgcgtggccgcgctggctcgcgacgagggtctgcgcgacattttgggtcagcggcacgccgccgaagcttcgcgcgccgagatcgccgaggccctggagcgcgtggccgagcggtgcgacgaccggcacggcggctcggacgactacgtgtggctcagccggttgctggatttagcgcccaactatcggcaggtcgagctcttccagttgctggaaaaggaatcgcgcggacagtcgcgcaactcggtgtggcatctgttgcgtatggacacggtctcggccaccaagttctacgaggccttcgtcagcggctgtctgccgggcgccgcggcggcggacggttcgggtggcggcggctcgcactacacgggttcgcgcgccggcgtctcgccgggcatccagttcggtatcaaacacgagggcttagtcaaaacgctggtggaatgttacgtgatgcacggacgcgagccggtgcgcgacggcctcggtctgctcatcgaccccacgtcggggctgctgggcgcttccatggacctgtgcttcggcgtgctcaagcagggtagcggtcgcaccttgctggtggaaccgtgtgcgcgcgtctacgagatcaagtgccgctacaaatatttgcgcaaaaaggaggacccctttgtgcagaacgtgctgcggaggcacgacgcggcggccgtggcctcgctgttgcagtcacacccggtgccgggcgtggagtttcgcggtgaacgcgagaccccgtcggcacgcgagtttctgctttcgcacgacgcggcgctcttcagggccacgctcaagcgcgcgcgcccgctcaagccgcccgaaccgctgcgcgagtacctggccgatctgctgtatctcaataaggccgagtgttcggaagtgatcgtgtttgacgccaagcacctgagtgacgacaacagcgacggggacgccacgatcactattaacgcgagtctcggcctagccgcgggcgacggcgctggcggcggcgctgatcaccacctgcggggcagcccgggcgattcgccgccgccgatacctttcgaggacgaaaacacgcccgagctgctgggccggctcaacgtgtacgaggtagcgcgcttttcactgccggcttttgtcaatccgcgtcaccagtattactttcagatgctcattcagcagtacgtgctcagccaatactatataaagaagcatccggacccggagcggatcgatttccgcgacctgcctaccgtctacctggtctcggccatcttccgcgagcgcgaggaaagcgaactgggctgcgagttgctggccggcggtcgcgttttccactgcgaccacatcccgctcctgctcatcgtcacgcccgtggtctttgaccctcagtttacgcgccatgccgtctctaccgtgctagaccgttggagtcgcgacctgtcccgcaagacgaacctaccgatatgggtgccgaactctgcaaacgaatatgttgtgagttcggtaccacgcccggtgagcccctgaaagatgctctgggtcgccaggtgtctctacgctcctacgacaacatccctccgacttcctcctcggacgaaggggaggacgatgacgacggggaggatgacgataacgaggagcggcaacagaagctgcggctctgcggtagtggctgcgggggaaacgacagtagtagcggcagccaccgcgaggccacccacgacggctccaagaaaaacgcggtgcgctcgacgtttcgcgaggacaaggctccgaaaccgagcaagcagtcaaaaaagaaaaagaaaccctcaaaacatcaccaccatcagcaaagctccattatgcaggagacggacgacctagacgaagaggacacctcaatttacctgtccccgcccccggtcccccccgtccaggtggtggctaagcgactgccgcggcccgacacacccaggactccgcgccaaaagaagatttcacaacgtccacccacccccgggacaaaaaagcccgccgcctccttgcccttttaactcataaactttcaggtctcgcgtacgattcgcgagtcgggaatgggacacccgtgggtgtttctccgtgtgtatattattttttttttttgtgtgtgtttgcgcccccgtgtgtctaatgtgctgtttgaaacacgtaaagtagctggtggaagaacagataaacctttaataaaaaaaaaagtatgtgctcccgacccacggtctgcgtgtctcttttttatgtccatgtctccaagtctggtgcgggtggcggcggggttaagcgtcctcgaagtcttcatcatcgtcgtcgtcctcttcttcgcggaggcgacggctttccaagctgtcgtggtgactgagcacagcgacttcttcgccggaggctgtggccagcgcctggtacttgacactgccgctaccgcgtccgcgaaagtagcggacggcgcgacacgtcgtaaacatggcccatatgaaaaagagcatgccgaacgaccagctgatgccggtgcggtattcgttgctgaggaaggtatcgtactgcacgatggggtagatgaggccgcagagtccaaagaaggcgcccaggtggtagccgaattgcaccttgacgtattgaaaaaagacggcctcgatcagtaaaaagtagatgatggagatgatagcgtagaccacgaagacggctaacaccatgtggcctgtacgcacgaaaaagttgtttccgaagccgtagcacagggccatggctaccacggtggtgttgaaaccaagcgctacctctaccaggttgacgatgagcgtgcggaactgcaccgtacctttgagcttggggtgcagacgcgagaagaaaaagagtgagcgtttgtagctgcggtactgcgtgaccatgctcacgttgaaaatggtcaggcagaaaaagtgcacggcggccatgaaggcgatcatgctgggcagccgaaatgacatggtcagtgtgaatagttggaacgtgtccatgctgagaatgaagaggaaggctgtgaggctgtcgcccatgtacgaaatgtcgcgtgtcgactggtttaggctcatgcctttgtccttgcgcatgctgatcttgatccagcataccaggtagtagatggtcacggctaaaaagacgagctgcatgaacacggcgtagcacaccaactgcaccgagtctaagaaaagcataggcgtgtgcaggtgcattacgttgtaggccgacatgttgagcctttcaaagtccacgacgtgatagtagacgcaggggtagcccaggtgcggaaaattgctcagcactagatgcacgctgacgttgacaaaagtcagcaccatgaaaacgatagaagcgctccatgtccgtgtattcaccttatccacgtgcgagggggccatggcgatagcggcggcccgctcgctcgggaggcgatgggggcgcgccgatgacgacaggctcgcgggtcgttaaatactacgatgggagccgccgcggctcacgacgcggtttgagcacgtccgggcggtcggtgaaaaaagaccccgcgggccttcgcgactctcttctgtccgaggatgaccgctcagccgccgctgcaccaccgccaccacccgtacaccctgttcgggaccagctgtcatctcagctggtacggccttctagaggcctcggtgcctatcgtacaatgtctgtttttggatctgggtggcggccgtgccgagccgcggcttcacacgttcgtggtgcgcggtgaccgtctaccgccggctgaggtgcgtgctgtgcatcgcgccagctacgctgcgctggcctcggccgtgactacggacgccgatgagcgtcggcgcggcctagagcagcgtagcgccgtgttggcgcgcgtgttgctagaaggcagcgcgttaatccgcgtgttggcgcgcaccttcacgccggtgcagattcagacggacgctagtggcgtggagattttggaggccgcaccggcactgggcgtggaaaccgcagcgctgtcgaacgcgcttagtcttttccacgtagccaagctagtggtcatcggctcgtatcccgaagtgcacgagccgcgtgtggtcacgcataccgcggaacgcgtctccgaagagtatggcacccacgcgcacaaaaaattgcgtcgcggttactacgcctacgatttggccatgtcgtttcgcgtcggcactcacaagtatgtgctggagcgcgacgacgaggccgtcctggcacgcctctttgaggtgcgcgaggtgtgttttttgcgcacctgtctgcgtctggtcacgcctgtcggtttcgtggccgtggcagtgaccgacgagcagtgttgtttattgctgcagtcggcctggactcacctttacgacgtgcttttccgtggtttcgctgggcagccgccgctacgcgactacctggggccggacctctttgagacgggcgccgcccgttctttcttttttcccggtttcccgcccgtgcccgtctacgcggtccacggtctgcacacgttaatgcgcgagacggcgttggacgcggcggctgaggtgctctcgtggtgcggcctgcccgacatcgtgggctcggccggcaagctggaggtggaaccctgcgcgctctcgctcggcgtgcccgaggatgagtggcaggtcttcggtaccgaggccggcggcggcgccgtgcgtctcaatgccacggcttttcgcgagcgaccggccggcggcgatcgtcgctggctgttgccgccgctgccacgtgacgacggcgacggtgaaaacaacgtcgtggaagtcagcagcagcaccggcggtgcgcacccgccgagcgacgacgccactttcaccgtgcacgttcgcgacgccacgctacatcgagtgctcatcgtggatttggtcgagcgcgtgctggccaagtgtgtacgcgcgcgcgacttcaatccctacgtgcgttatagtcatcgactccacacttatgcggtttgtgaaaagtttattgagaatctgcgttttcgctcgcgacgcgctttctggcagatccagagtctgctgggctacatctccgagcacgttacgtcagcctgcgcttcggccggccttttgtgggttctgtcgcgcggccaccgcgagttttatgtctacgacggctattcgggtcacggacccgtctcggccgaagtgtgcgtgcggactgtggtcgactgttattggcgcaaactttttggcggcgacgatccgggtcccacctgtcgtgttcaagagagcgcgcccggcgtgctgttggtctggggcgacgagcggttggtgggtcccttcaacttcttctacggcaacggcggcgccggtggtagtccgctccacggggtggtgggtggtttcgcggcgggacattgcggtggcgcttgttgcgcgggctgcgtcgtcactcaccgccattctagcggcggcggtggtagtggcgtgggcgacgcggaccacgcgagtggcggcggtctagatgccgctgccgggagtggtcataacggcggtagtgatcgggtttctccctccacgccgcccgcggcgttaggtggctgttgctgcgcagccggtggcgactggctctcggccgtgggtcatgtcctgggccggctgccggcgctgttacgggagcgcgtgagcgtgtccgagctggaagccgtgtaccgcgagatcctctttcgtttcgtggctcgccgcaacgacgtggacttttggttactgcgcttccagcccggtgaaaacgaagtaaggccgcacgctggggtgattgactgcgcgcccttccacggcgtgtgggccgagcagggccagatcatcgtacagtcacgcgatacggcgttggcggccgatatcggctacggcgtctatgtggacaaggcctttgccatgctcacggcttgcgtggaggtctgggcgcgagagttattgtcgtcctccaccgcttccaccaccgcttgttcttcttcttccgttctctcctccgccttgccgtccgtcacttcgtcctcttcgggcacggcgacggtgtctcctccgtcttgttcttcttcgtcggcgacttggctcgaggagcgcgacgagtgggtgcgctcgctggcggttgacgcgcaacacgctgctaagcgggtggcttccgagggcctgcggtttttccggctcaacgcttaacgagtcacgtaggggaactacgtgggtaagtgacgtggatactagtaaaaaaagtgcgtcaaagctcttagcgtgtgacgtggatactagtaaaagggacgtcaaagctcactacgtgttgcgtgttttttttttttctatgatatgcgtgtctagttcgcttctcactcttcctctcctcgttcccagcgcggcggcagcttggggggtgagggcaaattggggtagttggcgttgagcacgtctagcaggcccaggcccacgggccaaccgtccacggtcttgcgctcggtcagcttgaggctgaacgagtgtgcctcgtcctgaccggtaaggcggaaaaagaagcgtgctaccagctgcaggcaggtatgccgcgtctgctggaagagcacgaaggtagcgggcacgtactgcacaatgtgcggctctttttcctcaaagagcaggtagagcgcgctgcagatcagccgcctggcgctgtggtgcagcagccggccgaagctttcgcgcacgttcaccgcgtccaggtactggagcaggtcgtgcaggcacttgcgcgttaagttgcaattttccacgcacgaaataacggtacagagcgcgaagtgcagcaggttgtcggctttgacgatgccgcagcggtgtttgagccgcagatccgagagcctcacctgcgtgacggcgtcttcggtctcgagcaaaaacacggcggagtagcctagaaaggccgaggtgcacagcaactcgctgcggtactcggccatggagaccagcagcccgtgctccgtgtgcagccacagcttgtcgccgcgcaccgtaaagtcgagcacttgcggctccatgatcatcacattctgtctagtgaaatccgtatggacctccagcacgccgcggatcatcagggcctccatttcgaaatcggccgacacgctctgggccgcgccgctcctcgtctgccgtgatcaagcggcgcggcgcggacctttcaagtgttcctgggccgccgctcgaggcagttcccctttctggcactccgcccgccgcttcgcggctcatttggcgccgacgcgccttctcgcggctgcaaatcagctccacgtatcggcaaaacttgctgtcgtcgtaggcggcggccacgatctcgccgaaggagagctgcaggtaggcctcgggtacggggtccagcgtgcccagcgccaggatgtgacacagatagggcagggtcacgcgctctaccgtgtaattggagtagacgatggcctcttcggccccttgatgcgtgaccagacgccgtaggcgaaaggtacggaaatactcgttttcccacaactgcgtgaggaagcgttccagcgactcggtgccgggcacgaactgcgagaagaagctgttggccaccaggcggttgtcttccaccgccagcggacggaagggcgccgcgtcgcgcgccttgcgcacggcctccaacacgggcaggtggtagagttcggcgtcgcgcgcgcccaggctcatggagtcctcgcgccgcgaggcgtagcgcgtgagcaggtcgcgcagttcgcgcacgcgattctcccaggtctggttaagcgtgcgcaggtcctggatctcgtccacctgcgactggatctgctcctccaggcacttgataacctgcttcttaaacaggtcgcggatgtcccgctcgggcgccgccgggccgggtggcggcggcagcagcccgacgtggcccgcgggtcctcccaccacggcgccgccgggtcccaccacgccgggtccgcccggaccacgcgcgggtagtagacggttttggtccaccagcgagggggtcaggtcctgcagaaaggactcgacgctgtcctcgatgccgatgcgcgatttgctgtccgagacgttaagcaaaaacttcataatggactttttggcgtcgctgccccggtcgtgctgctccatcatctccaccagcttcttgcagttgagctcgtggcggctggcggtcaccactttcacaggaaaggtattgagcaactggcagatcttttggtggcggcagagcccgtcgtagcgcagaatctcctcgtgcaggtgtgccaccggcgtggtgaacagcagcttgtcgcgctcataagccagcggttcggccgccacgtacaagcggatgtgcttgccgcgcagctgcgcctccagccgctccgagcgcaccttcttgaagacgcgtacctcgggcgcgttggctacgcgcacggcgcccaggcgctcggccacctgcagcagcagcgccaggttagcctgcagcaggtcctgcgccagcgggtgtgtctcggtggcccgctgcacggccgcgcgtacaaattgcgcccgctcggccgcctcgctcggcttggtcttcacgtccagcagcggtaccagtcccaccgttacgcaccaatccacgtagagaccatagtcgtcgttatcggcgtactgatataaaatgtcgcggaggccgcccagcacgcccgtttgcacgctctggcgcaacgaggcgctccacaccaacagatactgctccaggtcctcttcgtccagcgcgcggtagggaaatagcgccgcgtgcaacttccactcctcggccacgcgccgcaccgtgatggtgtcaaagagcgttttgcacactccgtagagcagctgcttgcgcagcacgcacgggtcgcgcagcacctggtgcatgctttggccgcgacacgtccccagaaagccgtgcagcaaccgcaggaagctcatcgtctgccccgtggggaaaatgtcgatgacggcctcgtcatccacgccgcggcccacgcccaagtacgacgacgccttgatcctcaacctctcgtcggccgccaagatcgaacggatcgtcgacaaggtcaagtccctctcgcgcgagcgctttgcgcccgaggatttttcgttccagtggtttcgctccatcagtcgcgttgaacgaacgacagataacaacccctctgccgcaactaccgccgcggcaacgacgaccgttcactcctccgcctcctcttctgccgccgctgccgcttcgtccgaggccggcggcacgcgcgtgccctgcgtcgaccgttggcccttctttcccttccgcgcgctgctcgtcaccggcacggcgggcgccggcaagacttccagcatccaggtgctggcggccaatctagattgcgtgatcaccggtaccacggtgatcgccgcgcagaacctcagcgcgatcctcaaccgcactcgctcggcgcaggtcaagaccatctaccgcgtcttcggcttcgtcagcaagcacgtgccgctggctgacagcgccgttagccacgagacgctggaacgctaccgcgtgtgcgagccgcacgaggagaccaccatccagcgcctgcagatcaacgatctgctcgcctactggccggtcatcgccgacatcgtggacaaatgcttaaatatgtgggagcgcaaggccgcttcggcctccgccgcggccgcagccgccgcctgcgaggacctctcggagctgtgcgagagcaatatcatcgtcatcgacgagtgcggccttatgctgcgctacatgctgcaggtggtggtgtttttttactacttttacaacgccctgggcgacacgcgactttaccgcgaacgccgcgtgccctgcatcatctgcgtcggttcgcccacgcagaccgaggcgctggagagccgctacgaccactacacgcaaaacaagagcgtgcgcaagggcgttgacgtgctctcggcgctgattcagaacgaggtgctcatcaactactgcgacatcgccgacaactgggtcatgtttattcacaacaagcgttgcaccgacctggactttggcgacctgctcaagtacatggagttcggtatcccgctcaaggaggagcacgtggcctacgtggatcgcttcgtgcggccgcccagctccatccgcaacccctcgtacgccgccgagatgacgcggctttttctctcacacgtcgaggtgcaggcttacttcaagcggctgcacgagcagatccgcctgagcgagcgccaccgtctctttgatctgcccgtctactgcgtggtcaacaaccgcgcgtaccaggagctctgcgagctggccgacccgctgggcgactcgccgcagcccgtcgagctctggttccgccagaacttggcgcgcatcattaactactcgcagtttgtcgaccacaacctctccagcgagatcaccaaggaggcgctgcgccccgcggccgacgtcgttgccaccaacaactcctccgtccaggctcacggagggggaggatctgtaatcgggagcaccggcggcaacgacgagacggcgtttttccaggacgatgataccaccactgcgcccgatagccgtgagacgctgctcaccttgcgcattacctacatcaagggcagttcggtgggagtcaactctaaggtgcgggcctgtgttatcggataccagggcacggtcgaacgtttcgtggacatcttgcaaaaggacacgtttatcgaacgcacgccctgcgagcaggcggcctacgcctactcgttagtttcgggcctgctcttctcggccatgtactacttctacgtgtcgccctacacgaccgaggagatgttgcgtgagctggcgcgcgttgagctgcccgacgtgagttcgctctgcgccgctgccgccgccacggccgccgctcccgcttggagcgggggagagaatccgataaataatcacgtcgacgcggattcttctcagggcggccagagcgtgccggtatctcaacggatggaacatggccaagaggagacccacgacatcccctgcctgtccaaccaccatgacgactcggacgccatcacggacgccgaactcatggatcacaccagtctgtacgcggatcccttttttctcaaatacgtcaagccacctagcctggcgctgctttctttcgaggagacggtgcacatgtacactaccttccgcgacatttttctcaagcgctaccagctcatgcagcgtctcacgggcggtcgcttcgccacgttgccgctcgttacctacaatcgccgtaacgtggtgttcaaggccaactgtcagatcagctcgcagaccggctccttcgtgggcatgctttcgcatgtgtcgccggcgcagacgtacacgctcgagggctacaccagcgacaacgtgctcagtctgcccagtgaccgccaccgcatccaccccgaggtggtgcagcgcggcctttcgcggctggtgctacgcgatgcgcttgggttcctctttgtgctcgacgttaacgtttcgcgcttcgtcgagtcggcgcagggcaagagtctgcacgtgtgcaccaccgtggactacggcctcacttcgcgcacggccatgaccatcgccaagagtcagggcctgtcgctcgagaaggtggccgtggactttggggaccatcccaagaacctcaagatgagccacatctacgtggccatgtcgcgagtcacggaccccgaacacctcatgatgaacgttaacccgttgcgactgccctatgagaagaacaccgctatcaccccctatatctgtcgcgcgctcaaagacaaacgcaccacgcttattttttgacacaacaccgtgtaaggaaaacgtgactttattgagcagggtaaaaaccacgtacaagaaccacgttgtctatccccaaaaaaacacacaccgtcagggaacacatcgcctatagatagcggcactttacataaaaccaccgtacctgcatcacggtggctcgatacactggaaattcaataaaaaccaccgtgtctccgtgacggtacttatcgggtcagcgtcttttgagatttctgttcgtaaacttatccgtttccccggtccgcggtgtctcctcgcgaggctgacagtcgacgggtggtacctgcaagagaagaaacccgggtgggagcgacgccgtcgctgggtatcaaccccgcggctgaccgtcgtccggtaaaggaacaacccgtcgtcgcaagccgggttcgaccaagagaaaaaacccgggtgcggggggagacgggtcgtcctttggttgttcgcggacggcgtacatgccgcgtgggtcagtcgacggcgtcgctccgtgcggtcggtcatcattctgcttcacatatatgggttgtttgtgtttttttttataatgaatacgcactgatcctatccgtgactgcgcgtgtggcagagaggatgccttataacatgtattttgaaaaattgccaacagctataatttctctcatgtagcagaatagagaccttttgtcgtctttttgtttgtcattacttgttttccagggaattagagagagggaaccgcgcctccggcggcggtgcccgcggaccccggccccttctcgcgtgcgcggtgtgactggttgagcgaatgagcagctaggcttggtggtgctccgcgtgcgggggagaagacgattaacaacaaaaaataagtggaagtggccggtgggtctttgtccgcgtgcgcgcccatccgtcgccgggaccgagcagaaagtgatgtggtggtacattgattttttccttgacaggaaagaaaaaaaagagttttgttttcctatgtgagaggagaaaggtatgtgaggagatgttcgatgatcgtatgttacagttatgctgtaaggaagcttttatcgtgcgtcctgtttttcatttgatgtatatgacacaattgaaacctatcgataggcgtatatcgaggattcatcaattcttagaatcgtcgtctttttggctaattggactttgcccatgttggttgtcattcgtggcctgaggtcatcgtcgtccacgacgacgtgtctatagcgtgcggtgtgatcattgtgtcgagccagagaaagcgcgcctcgcacgacgtttgcggatcggctcgcgggtgtgtggaattcctaagaacataatcagctggtcgtctttctttgatgtgttgttgtcgtcgaggtcttgcttcgttttcttttttctttttagtcgatggaacttttcttcggtacgggttcttgttatggaagcttgtgttttcgaacatgaattcgaaaaaataaaaaggcctatcttcgtttcaaaaaaaggacagatatcaatcttcttaacttatatcatggtaaattcagaatcctatggtgtcttattatctctaaagtagtcaacattatggtctaacttgtatttccctgacgagatatatatgatccttataacctggctactatcatgaacaacaatatccttacttacagtcatcttcgtgagttaatgaagtataatatcggtcatctatcaacttatctgctatgtaacgtacccttttaggtattttgcgtttcttaacgagtgtacccgcctgtgtgaggcgaaactctgagaagtctaccgagtcgagttacaagtcactaaaacacttacacgagttatctatactaaaatcactatctatgttgtttgcttacctaattattatcctacatgacgaagctacctcccaacgtaaggtagggggagaggagacagaacaataaaaagtaactaatgtttcttagaacttacccgctaaggacttaccaaactatattcaccaaaaaacaacagctacgtgtttcatttgttttaatctaccgaagtaaaaaaaaaaagatgattagctatccagaacctacttacttcttaatgttttaactaaggatgcctatgggattggaaaaaaaatcacagcaacttgctactaatcagttgacagcgaagagactcataacaaagatttctgggtaatacggttataataatgcttatggactaaaggatacttggaaaaaaagaacgggctatgactatagagattcgtcgagatatcaaacttcaaataggcggctatcattcatggttgtggtgactatatcgtggagaaaaaatgtgatcgttagttagctaggtgagacttacagctatccatccgtctagtttttcgttgtaatgatgatagtacgtctatggtggtgatcgattttggttaacaatttgttcgtttaaaggcttaatgtacttatgctacatgatgtattattctttgattcatcgttcctcctaagggggtgtatgtatgtatgtactagtcgtatagtgttcctaacatcatgactattcagactatggcttcatctatcgtgtctaaagttcacttattctactattactatatatatgcactactatgtaactaggatatggtcctataaggtgtcttctatcacggtggcttgtttatcgcttggcggttacgagcaagagttcatcacggaccagccgtgaggcagggcacacgcgggtcggcggcgatgatgtcccccgcgaaggggacaacgaaaacaagaggccgccggccgcggccacggatgcgtagcggttacacaatgtttggttgagcgttttgtttcatcgtcgtggtggttttgttgttctctgtatatatcgtgtggtggctttatcgtcatcattattatcatcattcttgtttccatcatcacgatgagttttctccgttttcctctcctccagtggtagtcgtgtatcatcatcaatcatcgtagtgacgtcgttgctgctgctgctcttgccttcatggcggtatttctcttcctcccccctaaccccatattaactcgtgagtgtgatggttagagtggctgcttgttttttttttcttttctctttggaacaacaaaagaggataaagatggtcggtgaatgtattattattatcatcattatgatacggtcgcggtcttcttctccgatgacgaaacctgcgcacatcgaagaaaagacgagcgcgcgaaccgatagccgtccgtctgggacgaaggagaagatgatggggagaggaggagagccccagaagccagagcgagaagggagacgacagacatacgtcgtcaccgtcctctggaggaggcacggcggcgctgtttgttgtttggatgcttgattatatcctgttctatggggtagattattatcaataggcttggttttcaaaggtcagcctgtgtattgtcgtgtctttttttttcgttctcatgatcgcggagaccacacagacgtgcgcgtctcccaatggctaggcgttctttttaggtagtaattttttgatcttttttttttcttaacaagtctggcttgatttcttttatctatgatcgattcttctttttctcgggggttgcatcttccgtgaaagtaaagtgacactactctaaatggtaaccatattatctgttgattaggagaaaaaataattttttcgcacgaaatcgatcctaagtgaggtgatttacttgctatcacacgaaatgattatcttttgctgctaacgtactgaattttttaacagaattgcttctccgtaactatttccgcagattcagacagattgtcaaaaaagaatacggcacagaaatagtgggtctgtggcttttggttcgtgtacattcgcgtttgcgtgtcgagatttctacggtatgtttattcttcctgcgatgatgtagggtccttggtgtaagtaggatttcgagtatctctcttagagcgaacaaaataatcaaaaaacaacagctaggaaatcgagggttactctacgataaagtgtctctacaaagtgaagaatgttacgttgtggtggaataataagactcgcgtgatcgatgagtgatcgagagcggctcgaaccttctttaagagctttgtttagtgcaactttaaattacaaggagtagaaagctgaaatgaatctatgaaggtgctattctttgaatatcttactttgtacgcttcacattcgttatttggatagagagttgtctagagaaaatctgtgattctctatgagtgttatttttattatccttttggggactacgatttttcttcttgttctacataccactactactcgtaatcacatacatggacgaaaaaaaaattcgtcaggcagtagataccagattctccgacgttacggcgtcttttttttcttttgagagagtatctgctgagattgtccgtggtgtatctagtcgctatttttgttgttactagtagttttgcacacagtttattcagtatagtttttcttcttgccatgatcaattaagcccaccacctttttttttagagaggaggaatttcgtcttgatctccagccggagacaacggcggtggtggtggtggcgggagagacttcaaggcaatgaaaaaaaaaatttcgttttgccatcaagtggtgacgataacccgtcagattgataattggttcctacagaaactattctaaccgcggaagaaagaaattgaaaaaaaaaattgacaaaaacatcataacataaaggaccacctacctgggacgcgcagttgggcggcggactgggacggcatgctgcggcgatgctgtcggtgatggtctcttcctctctggtcctgatcgtcttttttctaggcgcttccgaggaggcgaagccggcgacgacgacgataaagaatacaaagccgcagtgtcgtccagaggattacgcgaccagattgcaagatctccgcgtcacctttcatcgagtaaaacctacgttggtaggtcacgtaggtacggtttattgcgacggtctttcttttccgcgtgtcgggtgacgtagttttcctcttgtagcaacgtgaggacgactactccgtgtggctcgacggtacggtggtcaaaggctgttggggatgcagcgtcatggactggttgttgaggcggtatctggagatcgtgtttcccgcaggcgaccacgtctatcccggactcaagacggaattgcatagtatgcgctcgacgctagaatccatctacaaagacatgcggcaatgtgtaagtgtctctgtggcggcgctgtccgcacagaggtaacaacgtgttcatagcacgctgttttacttttgtcgggctcccagcctctgttaggttgcggagataagtccgtgattagtcggctgtctcaggaggcggaaaggaaatcggataacggcacgcggaaaggtctcagcgagttggacacgttgtttagccgtctcgaagagtatctgcactcgagaaagtagcgttgcgatttgcagtccgctccggtgtcgttcacccagttactttaataaacgtactgtttaaccacgttgcgtcgtgacgttgtttgtgggtgttgctaggcgggctggaaagatgatgtataaatagagtctgcgacggggttcggcgctctgccggctgcggcggcactcgctccacggcctccgacgagcgttgcgctcgcgctttgcgccgccgcgtcatggatctccctactaccgtcgtgcgaaaatactggacttttgcgaatcctaatcgcatcctgcatcaaagcgtcaatcagactttcgacgtgcgccagttcgtcttcgataccgcgcgtctggtcaactgcgtggacggcgatggcaaggtgctgcacctcaacaagggctggctctgcgctaccattatgcagcacggcgaggcttcggccggcgccaagacgcagcagggcttcatgtctattgacattacgggcgacggggagctgcaggagcacctctttgtacgcggcggtatcgtcttcaacaaatccgtctcctcggtggtgggctccagcggacccaatgagagcgcgctgctcaccatgatttccgagaacggtaatttgcaagtgacttacgtgcggcattacctgaaaaaccacggcgaatcctccagcggaggcggtggttgcggcgccgcgtctaccgcttccgccgtctgcgtgtcctcgctgggtggcagcggcgggactcgcgacggcccttctgcggaggaacagcaacggcgaaggcaggaacagcgtcacgaagaacggcgcaaaaagtcgtcctcgtctgccggtggtggtggaggcggcggcgctggtggtggcggtggcggcggcgggagcggcggtcagcactcctcggactccgccaacggactgctgcgggatccccggttgatgaaccggcagaaggagcggcggccgcctccctcctccgagaacgacggtgagtcccggccctcctcgcgtcacggtgctttccgagtggactcgtgagcctcccgtagcgcacgagcgagcaggcgagcggtgttggtgcgctggtggttgtgtggatgataaccatgtgctttttcgtgcgctatgtgtcgtcccgtctgtaggctctcctcccctccgggaggcgaagagacaaaagaccaccgcacagcacgaaggccatggcggcggcggcaagaacgagacggagcagcagtccggtggtgctggcggtggtggtggcggcggcagcggccgcatgtcgctgccgctggacacgtctgaagcggtggcctttctcaattactcgtcctcatcctccgcggtctcttcttcctccaacaaccaccaccaccatcatcaccaccataacgccgtgacggacgtggccgccggcaccgacggtgcgttacttctacccattgagcgcggagcggtggtttcgtcgccgtcgtcgacgtcgccgtcgtcacttctttcgctccctcgacccagcagcgcccacagcgcgggcgagacggtgcaggagtccgaggcggcggcgacggcggcggctgcggggttaatgatgatgaggaggatgaggagggctccggctgaggcggcggaggcaccaccgcagtcggaggaggagaatgattccaccactccagtctctaactgccgtgttcctccgaattcgcaggaatccgcggcgcctcagcctcctcgcagtccgcgttttgatgacattatacagtcattgaccaaaatgctcaatgattgtaaggagaaaagattgtgcgatctccccctggtttccagcagactcttgccagagacgtcgggcgggactgtcgtcgtcaaccacagcagcgtcgcgaggaccgccgcagctgtctccgcagccggcgttggccccccagcagccgcatgtccgccactcgtcaccaccggtgttgtaccctcaggttccgtcgccggtgtcgcgcccgttgccgccgcaatcgaaacaccagctgctcctccccggcccgtgtgtgaaatcaagccctacgtggtaaaccccgttgtcgccaccgccgcggctgccagtaactcttcctcgtcttcttcggctccactgccgccgccgccaccaccgtcgggcggacgtcggggtcgggcccggaacaatactcgaggaggcggcggtggtggcggtggtagaaacagccggcggcaggctgcatcgtcgtcgtcctcctcctctcggagatcgcgacggagaaacaaccgccacgaggacgaggaggacaacgaccctctgctccggttgtcgcaagttgccggcaacggccgccggcgagggccctcgttcctcgaggacggactcgaaattatcgatcccagcgaggaggctgcgatcgccgccgcctcgatcgcggcgtttttcgacgattaaaaaaccgagccgagaccggaaaaaatatgaaacaggacgcgcttggacatttgggtttccaccccttttggtgtgtgtctatatatattggtcactgattttttttacaataaagagatagacatcacagttcaccaccttgtctccccggtgtgtctattatcatcaatcacccacagagtcgccagtccatggtctctcggtaatgcgtgtccagatacgcgttggccagtataaaatggtcgttgcccacgaaggcgcgggtggtgttgcgcggcgacgggtggcaggacttgagtaccaagtgccgccgtcggtcgatcaggtactcgcaggtgtgcgcgtcggcgccccacagcatgaacaccagatgctcccggcgctctgacagcctccggatcacatggttactcagcgtctgccagcctaagtgacggtgagatccaggctgtccgtgcaccacggtgaacacggtgttgagcagcagcacgccgcgtcgcgcccaggcgtccaggcaacccgaggccggacgctgaaacccgtccaccgtacgcgccagttcgcgaaacacgttgttgagggagggcggcggcggtcggcccgccagcgtgccgaaggccaggccgctggcgctgccgtcgcagtacgggtcctggcccacgatcaccacgcgcacctgctcgggcggacacagatagctccagcggtgtacgtgctcgggtgccgggtacaccatctcgagttgccgcgcgccctccaccgccgccaccgtgtcgcgcagcagcaccgtgtcgtggtcgggcaagctgaggaagcggatccagtcggcgctcagacaaaacacgcgagcctgctcgtcgggggttaacagagagcctttattatcagcaatgttagcgagcatccactgcttgagggccatagcgcgagtgagccggcaggttgacgcgcgtctgcttcagctcgggcggcagtccggcgtagtatttatctaggtggcgtagtagcggcgggtccagctggtgacgcaggcagaattccttcactgcgttgtacaggccgtaaaagagtgtgatgccctcgggcgcggcagcggtgctcacgggcagacgcacggcgcggttggtacgcgtggcttcgttgcgtatggccaccaccacgttaaagagagacggtggcaccagctcgaagcctaacacgtgttccgtgaagatgctgcgcccgtatgacagtcgcgtgaggtcgtagccgcggcacaggtcgtccacgcacgtgtacacggccggcgagccatcgccgcactcgctgtagccgcgcatcaccgtcatccagcgcggcgctgtgtccgagctcaacagcgtcagcagggcccgcaattgatccggattgttgtacagcagggccagagtgtccaggaaagcatcgtccaacagcacggagttggcggcctccggcgtaacgggacggtaacgaataagttgcgatagcgggccatcgcgtctggtaacattcaccaacgggcgcagccaactttcatacttgtcaccctgaaacacctcacccaacaggcatcgacgcgttagttcggggcactccgcggggactttctcggcggcggtaggagcgacgctgacggcgactgaggaaacaatgggcagcagaaggcaacaccacagcagtaccaccggtccaggtgagaaagagaagccgcaatccgggcggcggcacatcaagtctgcggcacgatgagagtgtgacggtaaggagccagttggcgccgaaagttggcgctcaggtcttcgatccctaaaacgttatatattgcatccagcaggtgagccaggctaaacggattcacgtaccaggtttggttacccgcgacgatgacggccagaccgtgggcgctacagttggagaggttcctgggtacgaaggtaactgagtcgatgtcgcgccacggggggaatgagacagacgactggcgcacgctgtaatcacaactgtgattgacgtgtagcgtgtaatttcggttgcactcagcctcgaagtagagggggaaccacagttcgtcgtactcgtcgtcgtcctccagttctggctcttcttcatccaccgcaatgtctacgctgctctgagattcctcttcgtacaggatgattgacaggttatggctacacaggtcctgggcgggaggacgcgtgggagcgcgggtggtggtaatgttttccagatcgtcaaaagtcggagtgtagtctgacgccgtgacgacaccgtcgacggagatggtagaagttgcggccggtgtcacggtggtaagtatggatacagaaggggagggggaagtagcgttcgtaccgatggttgtggtattattattccctgtgtttcttgttccagaaaccgttgacgttgagatgggaatcgacgtggtgctggacgtcagattgctgaccgaggaaaccgtggtgggagtggtgacggtgttactcgtggttgaagtgacgttaggggaggtagtagtggtaccggtggtggcgacggtagtgtttgtcgtggcggcggcagcggtggtactggtaacggtggtcgcgttggtttccaccgcttcacacagtaagcaaaagcacagggccgggaaaagcaaccagccccgccatcgccgccgccgcttcatgaggtgggcaggcgaaagctggtgaattcgttgtacagcggcaagtggggcgccgcgatcgaagggtacgtcaacaagctgacgttgatattaaatacgtctggctgcttttctacgatggaagcgcacagggttacggcgtcaaacaggtctttcttggtggcgcccgagacccacatctggtatacacccgtctcgtggtacgaagtagagcgcggcaccaccggacggatgcagtccagaacgcggttgggatcctggtgaaagaatttgaacgtggctacggcctgtggcgtgtgcggcatcgtctgcgtgatgagctgctggcccgctaacacggtgacgttgtgcaacttgagcagggcactcttgagggcctggaaagcgttgccgcacgaggcgctgatctgcagctgcacggccgtggagtcgtgcagccgcatgagacgtgatacctcttcgaagacgtacttgtatttgctggcaaaaagtggcgcgtaccgacagtcggccggcaaaatgtaggtggcgttaccgccgttggtggccacggcgggcgcagcggccgcggaggccggcgtaaacagcgtcagcggccggtggtggctggtaaggtcgatcatgggcggcgtggtgaccgtggcggtggcgggcatgacggggtttgcggcgacgggcactccggccacagcggcggccgcggcggccacggcggcacttgccgagcccacacccgccggcagtcctccgccacccatgacgccgccgggcagagcgtcgcccagacagacttccgcagtggcgggcgcgctctcagcggtcagtacggtttgccgatcgacctcgcgacgaaagctggtgaggaactcactgtgatccatggccgcagggcccgagatcccgggattctgcgggtgctgaccgagtgcggggcgagttatatggaagacgattagcttggagcggagttttgcgtccctagctgacctgcggatcagcgacgtgccatagggatagactgtgagcggcggccgcaacggcggggtcggccgccgctcgtcgtcacggggcggcgcgagggaggaggaggtggtgggtacgatcttgacgtggttgacgtcctgcccgtccgggggaatacgcaaaaaaccccgtcgcggcgctaccacgatggtgcgatgggtctttctcttgttggccggggccagggacttgcagatgcgtgtggagccgtagacgatctggacgtggtcctgggagaacatgaccatcgccgccaacgctcagcggggggacgtgttgggaacacagaggctgagggaaaactccgtagaagtcagcgaaataaagacaacacagcagccactcctctcgtctcgggccctaccactgcttgaagtagggcaccgggtgtttcttttcctcaacgggctcctccagtctcttataggaccagtcccgccggcgcgccagcatgtaggtcacgtacaaaagaataatcaccatgaacaccaggaaagccagcacgccgtaggccagcagccggtcctcgaacagcgggtcgctcttgataaacacgtaggtggtggtaaaacttcggcccgcaatctgaacgtggagacgcacgacagtatacgtgccgttgaggtagaagacaaactcgcgtaaccgttgtccgttatacgtcacgttactaatattccacggcggaatgagctggttgccctgatgcagatgcacggtgctgttggggtgatagaggctgctaccgttgagcaagcagtgttcgtgttcctgaagcagcacgcggacccgcatcgtggtggcgttcaggcgagtcccgtacacggcgtagatgggataggtgaaaaggtcccaagtggcgttgtgatggcggccccagctgaagaaagagcacgtgtactcagtggtctcctgcggcctgagtcccgagataagcagctcttgagcagtagcgttgtaggagagatgtagttttcctgtggataaaattcataagttgtttattttgttggcaggttggcgggggaggaaaaggggttgaacagaaaggtaggtgctacttaccttcattatcgggggggaaggcgctaagataccccacctgagtgaagggacccttgcagtctgtccgtgcataacaagtaactgataaaatgtctggatttttggtgttattcaacaggataactttgcaggtggcgtttagagacacttggtcgtggctgtagctggcttcgcaattcacagtatacaggtgcccctctttctgcgtcgtggctatcacggaagtggaggcggacgaggtagaggtttgtaccgtggtggtgacagcagaagtgacgttgttagaggtacttattgacgtagtagacgtgacggtggtattactaggggaagtgacggcgcttgtggtgctacttttcacccccgggtgcatgtcgcccaagagcgcaactacgagcgcgatcgccagtacggaacacatgttgccgtgtgacgagacggcgtgtggacgagctatatgtggcaggaggtcgcgtcacctcttgtgacgcctaaacgtccagctccagataaaagaggcgttaataatgaagaccacaaaaaccacttgcgtcagtatgacaatcataaaggctcggtgattgctacgcctaaagtacgcgggattatccaccagttcatcctgctgaacaaagtggatgattgacgtattggtgttactatccgtgttgttgaccatggatttgactaagaaagtcttggcgccaaaagtcccgttagagccccagcaggtgacgctgctattcacataagttcccggtgcccccgctagcatgtatttcagttggtgggtataattttttctgtcgttatccatgtcattgctgtagttgaccttgctggtgagaaagcgtgttttcaacggggcacttatcatcatccctgaggccaaaaagggcgaattgcaagctgtagtgttacaaaaaatagtcaagttagtgtcattgtattgataaatgtaagccatgcttacttcaggctcataccacccgattccaatcgcggccgccatcgttaccacgtcccatcttcccagacttaccaccgccaccactaacagcgtcacccccgcacggtacatagttaccctctcgacgtcgccggctgtcaatgacgtgcctgcgtcagtggctatgatttatagcttttgggcccaaccgcaacggatctgtcgtaatctaccttccacagggccgccgcgacgatgctgaacgacaggatcagacagacggcgtacaaaagtcctaggtcggcgtcgacgcggcaggtgcggatgtctcgcagggtgggtagatgggcgatgcacaactctttctccccccgcccgtacatcccatcttgtatcagcagccgtagcgtggcattgatggtcagcggggtaaccaaagaaatcacatagggatgtgtacaggaagtgcagtgacgggtatccgtgagatgtaagtcaccaccctcctcaccgtcatcatgaaagaccaggactcgggtgagacgacccgatgaatactggatctcccaccacagtctttggtccaacaccgagagggcgcaagagattctaagtctccctgggttgggggagcagatgtaagtcccgtatgtgcctctcgccatcagggccatacacatgagggggagaaggacaattatccgggaccacccgcacccccacatcacgagaccagagacggagatgtataaaaaaagctacttttattaaacagcattctcaccacacgttaatactgtcacggggaatcactatgtacaagagtccatgtctctctttccagtttttcacttactgagacttgttcctcaggtcctggatggctgcctcgatggccaggctcagggtgtccaggtcttcgggaggggtctcggtgggctgctcaaactgccccacggcgtaggccttcgcggccgtctcgtagataggcagcatgaacccaccctggttggtggagaagatgcgcaccatgacctgtttgggaaacttttgcatcaggggcaggcacaggttgagagcgcccaacaggtccacgggggtggcagcgtggatgatcatgttgcggtaatcggaggaacgggggcataattggtgggtgtgcaattctttgaggctccacgcggccttgacgccttcgttacaagcatcggctgtgcgctgcgccacttcgggtggatgtgtcacgggcatggtgtgctccatgaggaagggagtggagagggccaggttgcacatggtgcccaggcgacaccgcaccgcatccacctcactcttcacctcatgattgcgggtgtagataatctggatgcccttgttgttcacctgcatggttttgcaggctttgatggcctcatctaacacctggtgcatactgggaatcgtgaagggcaggttcttgtactcaagagagcgattggtgttgcggaacatgcggctcacctcgtcaatcttgacgcgaccccgccgagtctgcacgttgggtgtgcagaagggggtgttcttatctttcatgatattgcgcaccttctcgttgtccaactcggagatgcgtttgctcttcttcttgcggggtccggtgctcgccccgccgctgctctgatggccgcagctcagcagagaggaggaggccgcgccaccaaaaccgccgcgcccatggtggctcgaggtcacggatgctcctccgccactgctgcatttcatctcctcggactcactctccgagtccgaagccgaactgcaggaggaggaagacgaagaggaactatcttcatcgggccggcccaagggatcgggaagaggagggtggttcatctgggagagcgggtgcgtgggagaggtcactcgcggcgtgccgctgccggtggaaggggaagacgcggtagcaccgcgggtttcgacttcttcaccctgttcttcctcgctatcagagatcacgatacagccggcggtatcgataatcttgttgcggtactggatggtaaagtcgggctcgggcttgatgtcttcctgtttgatgaggggcagcatgataggcgcgggaggcacgggcggtttaataatcaccttgaaaggacgcgtggttttgcgcggtttcttacgcgggctgagctcgggagtagcggatgccccggggagaggagtgttagtaaccgcgacgctggtgggggtcggcttgttaagaggggcgctgctaacgctgcaagagtgggttgtcagcgtggggccggtgctactggaatcgataccggcatgattgacagcctgggcgaggatgtcacctgatggtgataagaagacacgggagacttagtacggtttcacaggcgtgacacgtttattgagtaggattacagagtataacatagagtataatatagagtatacaatagtgacgtgggatccataacagtaactgatatatatatacaatagtttactggtcagccttgcttctagtcaccatagggtgggtgctcttgcctccagaggcggtgggttcctcagcaccatcctcctcttcctctggggcaacttcctctatctcagacactggctcagacttgacagacacagtgtcctcccgctcctcctgagcaccctcctcctcttcctcatcactctgctcactttcttcctgatcactgttctcagccacaattactgaggacagagggatagtcgcgggtacaggggactctgggggtgacaccagagaatcagaggagctgacaccagcggtggccaaagtgtaggctacaatagcctcttcctcatctgactcctcggcgatggcccgtaggtcatccacactaggagagcagactctcagaggatcggcccccagaatgtactgggcaaagaccttcatgcagatctcctcaatgcggcgcttcattacactgataacctcaggcttggttatcagaggccgcttggccagcatcacactagtctcctctaagacatagcagcacagcacccgacagaactcacttaagagagagatgcccccgtacatggtcatcatacaagcgtcactagtgaccttgtactcattacacattgtttccacacatgtagtgaggatatccataaatatgtgatcaatgtgcgtgagcaccttgtctctctcctcatccaaaatcttaaatattttctgggcataagccataatctcatcaggggagcactgaggcaagttctgcagtgccgccatggcctgactgcagccattggtggtcttagggaaggctgagttcttggtaaagaactctatattcctgtagcacatatacatcatctttctcctaagttcatcctttttagcacgggccttagcctgcagtgcaccccccaacttgttagcggcgcccttgctcacatcatgcagctccttaatacaagccatccacatctcccgcttatcctcaggtacaatgtagttctcatacatgctctgcatagttagcccaatacacttcatctcctcgaaaggctcatgaaccttatctaagatatctaaggcattctgcaaacatcctcccatcatattaaaggcgccagtgaatttctcttccgtctgggtatattttttcagcatgtgctccttgattctatgccgcaccatgtccactcgaaccttaatctgtttgactgtagaggaggataacaacacatataagtatccgtcctcctgactcatttatcgctatctcgatgccccgctcacatgcaagagttaatctttactctatctgacatacacaagtaaatccacgtcccatgcaggttagtatacatcacatacatgtcaacagacttaccgagttctgccaggacatctttctcggggttctcgttgcaatcctcggtcacttgttcaaaagttttgagggattcttcggccaactctggaaacagcgggtctcccagactcagctgactgttaacctccttcctcaacatagtctgcaggaacgtcgtggccttggtcacgggtgtctcgggcctaaacacatgagaaatagagtcataagcacatgggtcacatacaggagatatgtatataacattaatacaattttattaaaaaaaaagggggggcacaaaccccgacacgtaccgtggcaccttggaggaagggccctcgtcaggattatcagggtccatctttctcttggcagaggactccatcgtgtcaaggacggtgactgcagaaaagacccatggaaaggaacagtctgttagtctgtcagctattatgtctggtggcgcgcgcggcagcaacgagtactgctcagactacactgccctccaccgttaacagcaccgcaacgggagttacctctgactcttatcagaacacaacaactcagctgcctgcatcttcttctgccgctgccttaagtcttccaaatgcgtcagcggtgcaagcccgctccccgagctcattttcagacacataccctaccgccacggccttgtgcggcacactggtggtggtgggcatcgtgctgtgcctaagtctggcctccactgttaggagcaaggagctgccgagcgaccatgagtcgctggaggcatgggagcagggctcggatgtagaagctccgccgctaccggagaagagcccatgtccggaacacgtacccgagattcgcgtggagatcccacgttatgtttaataaaaactgcgggcactggggacggtggtgttgtatatgtgaatttgtaaataataaatgagaccccatcctgtaaaaatacagagtccgtgtcagtctctgaaggacagtgtattggcatatagccaataaagagagttgtggcaaagagccatgttatggattagtaatggaaagtatcgtcaccaataggggagtggtcaataatggtcaataacccacacctataggctaagctataccatcacctataacatgaggaagcgggggtgtatagaccccaagccaaaaacagtatagcatgcataagaagccaagggggtgggcctatagactctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacatggcggtaatgttggacatgagccaatataaatgtacatattatgatatggatacaacgtatgcaatggccaatagccaatattgatttatgctatataaccaatgaataatatggctaatggccaatattgattcaatgtatagatcgatatgcattggccatgtgccagcttgatgtcgcctctatcggcgatatagcctcatatcgtctgtcacctatatcgaaactgcgatatttgcgacacacagaatcgcccaagtcaccaaagtcgtctatcgccatcccccgtaaacgatataagcgctatcgccagatatcgcgtatgcccaaaaatcacttttggaaaaatggcgatatcagttacacagaaactcacatcggcgacattttcaatatgccatattttcaaatatcgatttttccaatatcgccatctctatcggcgataaacaccactatcgcgcgacatgaatttagtcggcgacagaaatctcaaaacgcgtatttcggacaaacacacattttattattcactgcagcatatagcccattttagcgcggcacacatccagccgtttgtgttttttaacgctctccaggtactgatccaggcccacgatccgggttatcttgtcgtattccaggttgatccatcgatagggaacgctgccagcggcgcccagcaggtactgcgccttgtcgttcactttgccgcagcgtattcgcccgtcagcttcgaggtataacctacaacacggaggggaagggggggtacaaaacgtgaaattagactttttttttaatgatgttttgtccctctgtcttactttcccataggctgtaaggccctcgaggaagagacttacggattgtagttgcagctcgtcagtttgttgtgtacgacctggcgtgtcaatgaatgggtcatggtggtgacgatcccgcgaatctcagccgttttctcgggactgtagcagacttcgccgtccggacaccgcagcctgtggattcatgaaaatctactctggcattcccgaggatcgtcgatggaacatggctatcagaaacgtcgagagacaaatccagacgcaccacagaacgcagacaatcataaaaatacgtacgcgacggtgaagcgattgcacattttgaaatcgtaacagcgttccggcgggtggttgacgtttatgaattcgcaacattcttctgcgcgcacccgcggcacgcggctgtgacccaatagcagccacaacgtcgtcaagaacggcgtcaggtctttgggactcatgacgcgcggttttcaaaattccctgcgcgcgcgacgggctcaaacgatgagattgggatgggtacagaaggtgtaagtctggttattggcctcggtgaacgtcaatcgcacctgaaaagacacgctgtagtcccggaagacgtgggcccagctctccagcttcatcacacacatctgataacgcgtgccatcgttgacgacgaagcgtagcagcttggtctgcttgggcaccatgtgcgctccaaaaatcttggcgtcttccacgctgatctgcacgtttccgtcgctcggtttcgaagccgtttggggcatccgttggaggatggtctggttgcgaccgctcagataccagatcacctttttcacccaggtggagcttctctccaccaaggtctggccttcccggttgtacagcagatacagggtctcgttgcgacactcgggacccgttgatacctgctggaaccccgagaattgcaagggggaccgtgggggcgagggatagagaaaaggacagtaaaacgtcgccgcgtcatgcggtttggaatacgtcagtttagaccatggcggggacggattctggtttgccgttagcgtcgaccacggagacgccagacagggcgttgcccaaaccgcgcacagaagcaggcagtgaaagtggtgacgaagcagaagccgcagcatattatttcccgtgacgcaggctagttggcaaagagccgcacgctgaactcgaggctccgggcgtgtggcgccagcgaaccggcggcgttgaacgtggtccttttgttggtgccgccgcgacggttctgacgtctaaagtcgctgatgagcaacgacacctcggtcacgttgattctgcaagcacaggttccaaacgtcatttcataccccatgcggttacttagccgttacccgttcgcccttaccttcccgttgtcatgcacctttagcgcgtaccctcacctcttgagcacgtcaaagttgtccaagccgtggctcgcatcgtagtggtagttcaacgtgaggtccacgagctgttccacatacttgtaacgggtttggtcgggcagcgcgcgagagcacgcgtcccagtaatgcggtactcggtaataatcgttttttttccgcggtttcccgctggcactgacccagcaccacggcgcacagacaaacagacagccacacccgacacagccgcatgttgcagactgagaaagaaagctttattatgagacatcatacacatagtataggcgaggtgatggggcggggaaagagttggaaccgaaagacaaaaaaaaaagcctagtcgtactcgggatctctgagcgagacgggttgcatggcaactttcattagtttgggaatctgccagctggtgctgttcgaaggttcttccatttccgaggcggtcagttcatcgtacaccgaaacgtagtacctgatggggtcctcctcattgtccgagaggtgagattcgatggtcaaaggcgagcctctcccataattgggattcacgaacgacgtgtccaagttgccatcctttctgaaatagatgacgttctcaggatcatgtttcatgcgctcgcgggccgcggacgcctcctcctcctcgtcccagtcccgagtttccaaccgctgataagggctcgaggaacaaaatccggcggggatctgagaacctcgtcgggaaccgctgccaaacgggctgctgccgccactgtcgtccgtgtcgtccaacaggttgacggcctcttcgtcggcgaaacgaaagcggcccgggtgcttgcaacacgaggagtaaactaccgcgatcagtaccgctatgaagctgaaaatggaggtgcctgtcacgatgtagaagaggatagccagcactttcatgatttcgtcattgcgcgcgtcgtgaacggaagattcgcgggcagtggtcatgttggtttcggttgtaggttcgctactcgtggtgctctcgacggtatttctgctgctggtgctagtagggacgtttgtgctgctggtcatatttgtagcgtcgctgaagtcgatgtgaagcagcaacccgaacgcgaccaggaccaggaatgttgcgcgaaggagaccccgcggggccggcattcttgagacgtggcgacgtggatttcttgttatgtccgcgaacgacgtgtaacgaggacgtggtttccgcaagcctctaccgacgccgcgacaccaggtaggttatcaaaacgcgagcccatatcgccgccatcattgtaatcagcaatgtgttgaggtactgcacgatgaatctgtctagtgacaccagccaaccctctgcttttgcgggcaagcgcgctttcggtgacagggtgtatcgtacgtagccgcgggtcaggcgcgcgttgtagcggtacacgcagaaatctatccacaggccaacgcccggctgtagcttcggatggtggataatagcgcggtgacgtacgccgcgtggctttagaatctccacctgtaaggccatctcctccaggtagtgggtctgactgcgacgcagcgtccagttcatgtaaaagtcggtctcgccgtgtccggccacgaagaggctgcttactaatccagtctacattgtgccatttctcagtctgattgcattttttagagttatgttgccaccaacgtatcctgttacgttgattacctcgtaactgcggtcgcatcttttatggactgtataattgaaaccatcacaagtaacggtcgtggtggtgttggtacatgtggtagtctcaacgtttgtatttgtcgttgtggatatctgtgtggttgttttcgacggttttgtagaaacggtggttgctggtgcagttgcagtagagcaatttatagattctgaagtgcttttattgctgataactgttgtactgtatgttgatgtggctgtctcagtactagtggaatagttaacggtagtactacagggacattgacaggaacaggtttgattgcagctttctgataacgcggatattagtatcgtccacataaccgtaaatcgccagtccattgcaatattagttctcgctcaatgggcattaatattcctttgaacgctgagccttacagaatgttttagtttattgttcagcttcataagatgtctgcccggaaacgtagctcaatcttcatgttctgtgtgatatcgaacaatgaattctgattcactgacggtgtcttgcaacatatggtactttttgttaaaggctcgtcgtgcaaaaaacagaactatgcaggccatacaaaccaacacgatggtccatacggtgcggcttctttgcgagctatgatagagattacgtttgtggtgatgtgtattgttagtatgttgacttcctttctctctatcttcattttcgatatcggtgttgtatctagggcaaacgaaagtagcattaatagcttcagtatgattttttggtgttactaataggtagaaattttcatcttcgtgatgtcctgtgaagtaattttctttaaaacaacgtctgctgtacctgccggaattggtgatatttagatcgtacagatgtagttctgtgttgttgcacgaacgacataagtcatggtacagtgaaggtctttcatgttgagaatgacatacagtatgagaggtaaggatgcgtaaccaataccaagattgggtatgtgcgttcttacgatgacctagatgatgtccgtgtgtggatcgattgtaatgtcgtatccaggcgactgaaagacaatcccacgtagaattaccttttatggtgacattactcccttctattcctgttgtattagtttctttgaaacgtatgattgttgtctctgtgtgacaagcgttggaagagttagtacggttgtacgtggtgtacgttgtggcgctgcaatttgtaagccatggcgtgcttataagtgcagtattagtggatacgttgtgcgaagtttcatctgacgtgatagttacggtgattgttgtgttataagatgatgtagcgtttgctgttacgttggtaaaagataatatagtgttggtatttgttgaaatcaattctgtagtggcagccgtattggatatattagcatatgatgtattgaatgtagaatatacggttgtgaaagtactcaagtcggaggtaacgttggtgatgttgccaatggttgacgcttgtgaggtgacagatgtgtgtggcgtcgttgatgtgttgttattcggagtagaaaatacgctggtcacaaaggtggtagaagcagtgttgggtgatgtgatggatgcagtattggtagtagtactgttgcatgtaactctatgcagaatatagaatattatgattgtatacgccgtatgcctgtacgtgagatggtgaggtcttcggcaggcgacacgcatcttttactgtaaatccccgtccaccgtcaacaacaaaggttccgtatctaggtccgtccgcagatgttcagcgtcctgttccccgattcgttgcgatcgcaggaagcagatgaccagcgcgccaacaaagatcatcattcccgaaacccaggcgcaatggagtgagaggccggaccactggcgttttaaatccgagataattgcccggtctgcctcttgggaatccgtaaccacaactctccctggtcccggataaaagcatcgacgcgtttccaaggctcggcagaagctacgtgggtggatgatgaggtagaaagcctcgacatcgccggtatactgatcctgcaggaggtagactcccgtatctttaaccgtgagattgtacagcgtcagattttggcgcgtgcacgcgaacgccgcaccgccctgacgcgtggtttctttataggcgtctgtaatgatacaaagtggcggcatacgacgcatgtatctgctgtagatatcataacgctgccagactacgctgtgatggctagtgttaagcctggtaaccagcgtgcgtgtacggtcctcgcaggtggcacggtagttggcgagctttaggggttttttggttggttcgacggcgttcgatgaacttccctgagttgtgaacaaaaacagcgacgtgactatgacaagcgtgaggggggtgctgtaggtctgcatggtgcaaaacacgttctcgccttccttatcagacgttgtcgtcctcgtcctcttcgtcgtctgtgcccgtcggttcgatcaacggggagttatctttctgtctggagggtcggtatggaatccgttcgtagatgttctgctttttagccgcgtgttgttccagctttttgcgtgtcaggctccgataggccagacattgatctacctcggtgcccgtgttgtttttctcctcctcgcgcgcgtaaattacaaagaagaccaccagcaggactatcagcgtagccacgaacgagcccgcgccccaggccgagtatgcgcctagcatggtaatgggttctgtgatccggcatttgcacatcgcgtggcacttgctgccattgccggtattagatgatgtgttattcggactgcacttgcacgtcaaatgggtattttctgatttcacgagacagttggtggcgactttggtttcggcgcagacggccacatagcttaccaagctgagtgccagaaagcacaccgcgtgcattacacgcggatacatattaaaacaccgtgttccacaagcaccgcacacgtcaatcctccccgcacggtcttcagcccgcccatgacatgatctccctcacgttacccttcaacaccctgtagtactctgtctcggcttccggtccccatgtcctaattataacaaaacaccgtgacactgtccatctccctgtctttttgcgccgccggtcccccccaaatcatgtctctagatgccgccggccaccaaccggaggcacggcggctattggattcggcattggtgcgccgcgtcttggcctgcatgatcatcgtcatcatgattgccattagcatctggatcctgacctacgtgctgtttctctaataagaaccccggcccctgacggtaattttcctttcttctccgtttctcctcagctgccgtacgtgatgcctcacggccatctccgacaggccctctccccgacctcctggacatgtgagggcttgttgctcctcctgggattgctggtgctcttctttcaccaccacaaccagtcggccgtggagaggcgtcgccgcgtctcgttcgtcgaggccgatcgactgccgcatgagagcgggtggtattcttccgatgacgacggagaccgggacggtgatgaggaaactggagagagccacaacagaaacagcgtgggactgtccgctgtttttagctgactggcgtgcgacctgtaaaccgttactcgggtctcaagatggtttggaagttgtgactcatcttcctgtgggtgatacccaaccggacgcgagtgttccataaaagccgggcgctccggcgagaccatgccatcctcgccttcggacgccccgctcctcttctctctcctctcctccccgctgccgcggccattgccgccgccgcccataccatcggcatgtcggccgacaaatcgcagctgtcttcgccgccgcagctgtagcagttaacgtcgccggcctccaggaggagatggcgctgtgcgtcgtctcttcgtcccgtctccctctgtggtcgtgggtggtgcgagagtacacgatgggtggctctcgtctcgggggaccacagggggaggggggtaatttattattcgtattactgtaattttgtatcgcttaatttgtttagagccgcacgcttgacaacgccttgtatagccttatttatcccgatgacttttttctccgtacaagaaatggacgtcacttgagcagacacagtttcatcgaccacgacagtctcatgatctgactacctctgacccgccaacgagaaaaccgaaaagtaaaagatgaccgcgccctcggagtccttttttccttttcaatcatgaaagcaagaggcagccgagagaatgccagtaagagacgaccatcgcagacacagtacgatactcatcttagaacgaaccagcgaataaccatcacacgtacagcagaatctcatgaactagtcaaccaacgtcataaaatcttcacacaatcgtttttgcgaacttttaggaaccagcaagtcaacaaaagactaacaaagaaaaaccatcttggaattaaaaaaagtagcatcgttaccttatgaaccagcagcattcagtatatacaccagatataatatatttattaatgtatcctctctttctcctgatgtaattttgtttttgtaaattcaattgttgaaagtctctccctgggggaattgcatatcttattgatgaagaagaaatccctgccatatgtgttgtcaaactatcattatttctctatatgggtattttttttctaagaagcaaaagactagcagcagccaaaataaacctgatgaaatctttaactgaactcccagtggtctgtgtgtatatttctgttggtggtcggttgtctgaacccgggtgggttgttcggaaacggcgggacggggaaacggatggaaacagcgtcgctatatacgtgacttttgatctaaacggacgtcgctaggctgacagtttacgaattgctaaacaagataggaacaaaacaagcggggctttgcctggtaggatttcctgtggaaacaataaccggatgtgattgtggctggtacataagctggttctggctgcaagcgcttttcactgcattaggtttggcgtttgcttttgcctgggaacgctatggctataacgggaaagaaccggtttggcaacattccattgtggggggggggtacttatagcgtgcctagctatgacgttgatatatgtggatgcggataatactcgtaatgagctaaaagcgacgactggtagtaattttaccattacgcataggaaagatccgttgacaactaagtggaaaaccgtttttggtaacaatggtgatcagtggttgtgcaacgttacgggtataggtaatgctactgtgaatagtaacgcaactatttgtgtgtcgagctgtggtcataatacgttggatttatgtaatttaaagtcgggagattctggcttcttcgatctgtctcgttggttcggtgaaaacatggatgaatacagtggtgatgtgtggcacttggaagtcagctaaatgttgtatcgcttagtgaattggtgttcttacagttttcatgtaataaactacgtgtaattcgttaaatttgtgtgtttttttgttagtattctgcgtaacggtggaataaaattgcgttgacctagttagatttcctgtgtagaacaatgaccggacgtgcttggactggtacatacgcaggggctggacgtggttaccggtcactggactcggtttcgctgtagctgtggttcaacctgaacatggctcccagagctgctaggaaccggtccagtcacattttttggtgggtggggggtactaaaaaagtgtttaatatttgggtttaatgataaaatccaggttatggatatgaggaaactgaatacctcgcagggtcgaaatcttaccacagttgatgatagaagacggttttccatcgggtgggaaacatgggataacggtggtgactaataatggtacaacggtcgtcaatacaacagcctgtgtttcaagttgttcgcatacgtcgcttgtgctttgcaatatgacgcagcagactgattcgttgtacggagtgggtcatcggttgaatgacgaagaagatggtgaactgtggagagtttcggtttcttaataatcccatacgacatgtgttcatttatatctgaattttaggatgatgactatagtataactctggggaacaaatatcatacgttaatcactttaagttacgccgttaggaaaagaaaatcagtccgaatgaagcatagtcagccgaatgatacagcaatagcttgtttacaacgtgttcttttttacattatgaacgtgccttgctttttatacacacatggagacagaggtccctcagcccttgtcacgacaactccctttttctaaaccgtatgtgctccaaaccgtatctcctcatcgtcacgtgaaataccatgggaccccttttcgtcacacacgtctttccgcttacccaacgcgtcagcccgcgctcggcagagctaccatataaaaacgcaggggtttagcagcttccccagatcgctgctgccccggcgttctccagaagccccggcgggcgaatcggccggctggtcggtcggcgctcggacggatggggagaacggcggtgacttagccgcccgtggccgggagaagacggaggagccgagatgacaacagcagtcgtggaagggtcgccaagccccggtccttctcttctgtctggtcgaatcttgttttcttttttcaaccgctctttttgtcacctttttatgtgagtttctcttccgcgtctcccggccgtaccatccacccatgcagcatgcacgcgtgtatgtatgcatcgcctctcctccgtcccgactaccatcagcagtaccactgccgccacccccagcgccaccaccgctgccgtcgccaccgcgttatccgttcctcgtaggctggtcctggggaacgggtcggcggccggtcggcttctgttttattatttttttttattttttatcttctcctttccttaatctcggattatcatttccctctcctacctaccacgaatcgcagatgataaacaagagggtaaaaagaaaaaagctacagacatttgggtacctcagctttccgataactcgaagaattcaaagtcgacgattcccaacaagagaaaacagaacaaaaacaaggtcatttttatttatcctcatcgtcaacaacaactaccgacaacaacgaaacaccaccaagaatgtcaatccgcaagggtgttcctgccccctcgacgcgcctgtcgcgatcctcatggcgaggaccgcgatctccgtataggtagatgaaattatcccgtgtccggtcctgattccccgcatgccctgcacatcctgacgcgtcggtcagcagccaaacaatcataggaaatgaaccagaagaacaaaaagatcatctctctcggtgtatagcaacaccaacaacaaccgcatcgcaacatcttcatccgcaagacggaaagaaaacaacaataatgagaatgaaatcaccacaaccaagccagatttcacgtccatgagtttttattatattattatcaaaacgaaaaacagaaaaactgtcatagataaatataaaaaaaaatagaaaccacaaacgactactagtactccaatcttagatgtatatgctcctagataagatttagtattaccataatcatcgaagaatgaaagacgacgatgattccttaccgctcctgccacccggtctgtatgtagagagagaagagagaaaacggtgaatccaagatccccgggtcggcgtcggcatgccgctgatcgcagtggccccacctcggcatgccggcgccgggcgaggaattgctcatgaaaaaaagtatctttctgtaaaaaaagaaaacaatacatgattaaccgaaaagaaaccaacaaaaagaacccgagatcagtcgatttcgatcactacgataaacacatggaagatttcttgaaaaaagaaaagagaaagagaccaccttcccggcggcggacacgctcctctccgtcgccgttctgcaccatgattcgatcaataacaacatcatcatcggagaccatcttttaatcaatcagcgttgcagtagtcgactccctggacacgaaggagtcatccatttttatcctcgcacttcttcgctctcaaagccgcctttaaagttgaaatgaaaggatggaaacatggaatacagttttaattgcacgtatcaccattttactacaaaaagaaaaaaaaacaacttacacatagtattaccttaggtttacggataagtagagtgtaggcgtttttgaaacagttcagccaatgcaatcttgtctcggcataatcactctttctgcatataatagtagtagtagatttattcacatcaacacagcgaaaaactccagcatcaaagtacacctagagacagcccttaaaatatagtttgcagcttttagatgtacttacaccaaagaagattaccgtccttacgagaaaacagatactcggatataggaatcaagacagctctgcactgaaaacacactctcctgtcacgacaccgcgccacaccagaggcgtacgcgtgacttcatcgcaacgatccatcgtgatgtccctcgcagaacctaaaaagaccaaaaaaaaatcttggaccacagttgtcgatacttgaagacaatattctcgtgagaactttgagattcgcacttgaaacctcttaggatccacaaaaacaacaacctctgtatggaaaatgcgctattttatctcagcttttctcccaaacctcggtttcttcctattcttatgttttccctagtatatttgcctccttataagaaaagaagcacaagctcggtcgcacggattattccttctgctaatctattattttgttccttttttttttctttgccttcaccctcttcactccctgtagcaacacagagtagtagacacaataaatgagaagtttgcatgcatttgtcgtgtccgtggtttgttatggcgtgtggagtgctcgggatgggtggacgtggggacggattcttgaggctacaaagatacgcggagacgtcgtggcgaggggatgggtttattggatatcggtgaagcagcgtggcggcgaaagacgcgatccctgggctggtagatccccctaccccgtctaccagggacgtttatcctttggacacgtaaatgtctcggccggcatccacgcgccacgttcaccgcgttgtgcccagcgccatgtgcgggtcgtttcggcgtgaagttggacggcgtagtttcggggattgtgaaccgtggctgagggtgtagatgggacaggaaaaagcgtgtgatctgaccgaggcgaagcatgtgggtggtgcgatgcggtggatgtggcggggtgcggcggtttccgacgtggagatgtggagatgggggtgatccggatgcgtggcaagaggcctcgagcttgggcttctcccgcggatggacgttctaactgtacacggcggccgtggcctccgagtaaaaaaaccaggtgctgacgccagacagagacgccgtcctcggaatcgtgtgcgcgaaagcctgtgccgcggcagcgtacgacgttccagtcagcgaggccgtcgcgttggcgcgccaacagtaaggtgacgacaggttggcggcccatggttccgaagcgtccccacatgcaccagcagtcggcgtcaaagtcgcttgcgctgtcggcccagtcgccaccgccgcggcggatttccgcgcgggggacggggtagccgagtgctgcgccctcgccaatgttgtgaagtggatgcgtgagttgatgttgattctctgtgggaaaatgagcgctgtcctgtgggttggtgttggggtatgcgagtagtaggggttgtgtttgatcgtagaggtgttggcgggcctgtgcgcaagcagcgtagtctgcggcgtcgagctccatctgtgtgcggtgttcttcgtcggcgtgtttgtccgaggtttggacatgcggttgtgtgttgctgtggtgtaagggtaacgtgtgttgggcgtctgggtgaagcggcgtggtgtgggtgctgtttgtgtctgtggctggcatgattgtgcggcatgtgtgtgttgtagtgggtggaggttaaataggtgaggtgggttccctggtccgcgccgcaaactgtccccgtccccaacgtaacctcccctacgcggcgcgaacagccccggccccagcgcaacccccgtccccggccccaacaccgtcccgcacaccccccgtctccgcaacaccccggcatcgccggcggccagaacgctcgaaaacccccgacaagcgcagcgccgaaacgacacaggcaaggaccgtggaacgcaccggcagcgcgccgaaacaccgtcccgaagcccggtgccgacaacaaataccgtgggacgacacgcaccggcagtgcgcaggcagcgtcggacacaacacgcttacggccctcaacactccctcgaggacccaccacgcggccccgcaccggcggtgttttgggtgtgtcggggcgcggccgggtgggtgtgtgccgggtgtgtcgcgggcgtgtgttgggtgtgtcgggggtgtgttggcagggtgtgtcagggtgtgtcgcgggcgtgtgccgggtgtgtcgtgccgggtgtgtcgcgggcgtgtggcgggtgtgccggcggggtgtggtggcggggtgtgtcggcggtgtgcgcggcctcggggtgtgcggcttcgcaggaacgagtgtgtggcctcgcggccgttatttcccccgcggtccccagggccgtcgtccctcgcccccgggcgttgcttttcgtgtgtccccagggacccatgctgccgtcccccgggaacttcctcttttccccggggaatcacacagacacagacacgcgtcttcttttcgccgtgcgcgccgcacgtcgcttttattcgccgtcgccgtcctccgcaccacacgcaactagtcgccgtccacacacgcaactccaagtttcacccccccgctaaaaacacccccccgcccctcgaggacccaccacgcggcccggaatggatgtcgggcgtccacctagatgggtgcgcgcccgggaggcggctgtgcgctccagtggtacgcgcctgccgcgcgtcttccttcgggtagctgcctttcccagtccacggccttccagactgcgtggcgccaaggcggcgccagcacgcgccgtgcacgtcgctgcctataaaagccagctgcgtgtcgcccgcggcacacgggcgacgaaggcgtccgcgtgtctaaaccgcgtgctcgctgacgcgggtttgcttcctatatagtggacgtcggaggtgtccggcgcccatggcccagcgcaacggcatgtcgccgcgccccccgccccttggtcgcggccgcggggccggagggccttcgggggttggttcctctcctccttcttcttgtgtgccgatgggagcgccgtcaacagcgggcactggtgcgagtgctgcggctacgacgacgccgggccacggcgtccaccgggtagaaccccgcgggccgccgggcgcccctccgagtagcggcaacaatagcaacttttggcacggcccggagcgcctgttgctgtctcagattccggtggagcgccaggcgctgacggagctggaataccaggccatgggcgccgtgtggcgcgcggcgtttttggccaacagcacgggccgcgccatgcgcaagtggtcgcagcgcgacgcgggcacgctgctgccgctcggacggccgtacggattctacgcgcgggtgacgccgcgcagccagatgaacggcgtgggcgcgacggacctgcgtcaactgtcgccgcgggacgcgtggatcgtactggtggctaccgtggtgcacgaggtggaccccgcagccgacccgacggtgggcgacaaggccggccatcccgagggtctgtgcgcgcaggacggactgtacctggcgctgggcgccgggttccgcgtgttcgtgtacgacctggcaaacaacacgctgatcctagcggcgcgcgacgcggacgagtggtttcggcacggcgcgggcgaggtggtgcggctgtaccgctgcaaccggctgggcgtgggcaccccgcgcgcgacgctgctgcctcagccggcgctccgacagacgttgctgcgcgccgaggaggcgacggcgctcggacgggagctgcgccggcggtgggccggcacgacggtggcgctgcagacgccgggcaggcgactgcagccgatggtactgctgggcgcgtggcaggagctggcgcagtacgagccgttcgcgtcggcgccgcaccccgcgtcgctgctgacggccgtgcgtcggcacctgaaccagcgtctgtgctgcggctggctggcgctgggcgcggtgctgcccgcgcggtggctgggctgcgcggcggggccggcgacggggacggcggcggggacgacgtcgccgccagcggcgagcggcacggagacggaggccgccggcggggacgcgccgtgcgcgatagcgggagccgtggggtccgctgtacctgtgcctccgcagccgtacggcgccgccggcgggggcgcgatttgcgtgcctaacgcggacgcgcacgcggtggtcggggcggacgcggcagcagcagcggcgccgacggtgatggtgggttcgacagcgatggcgggtccggcggcgtcggggaccgtgccgcgcgccatgctggtggtgctgctggacgagctgggcgccgtgttcgggtactgcccgctggacgggcacgtgtacccgctggcggcggagctgtcgcactttctgcgcgcgggcgtgctgggcgcgctggcgctgggacgcgagtcggcgcccgccgccgaggccgcgcggcggctgctgcccgagctggaccgcgagcagtgggagcggccgcgctgggacgcgctgcacctgcacccgcgcgccgcgctgtgggcgcgcgagccgcacgggcagtgggagttcatgtttcgcgaacaacgcggtgaccccataaatgatcccctcgcatttcgtctttcggacgctcgaactctcggtctcgacctcaccaccgtcatgacagagcgtcaaagtcaattgcccgaaaagtatatcggtttctatcagattaggaaacctccttggctcatggaacaacctccacccccatctcgccaaaccaaaccggacgctgcaacgatgcccccaccgctcagtgctcaggcaagcgtcagctacgcgctccgatacgatgacgagtcctggcgcccgctcagcacagttgacgaccacaaagcctggttggatctcgacgaatcacattgggtcctcggggacagccgacccgacgatataaaacaacgcagactgctgaaggccactcaacgacgaggcgccgaaatcgacagacccatgcctgtcgtgcctgaagaatgttacgaccaacgcttcactaccgaaggccaccaggtcatcccgttgtgcgcgtccgaacccgaggatgacgacgaagatcctacctacgacgaattgccgtcgcgcccaccccagaaacataagccgccagacaaacctccgcgcttatgcaaaacgggccccggcccacctccgctgccgccaaagcaacggcacggttccaccgacggaaaagtttctgcgccccgacagtcggagcatcataaaagacagacccgaccgccaaggccgccaccgcccaaattcggggatagaaccgcggcccatctctcgcaaaatatgcgggacatgtacctcgatatgtgtacatcttcgggccacaggccacggccgccagcacctccgcggccgaaaaaatgtcaaacacacgcccctcaccacgttcatcattgaaagtctctccagtccatatgttgtcaggacgtgctgtcgttctccgcttgctgcgaagcccgttcttccgagtcgtgtcgctgcgtccagcgtcgcgcccaagatgggaatttgggtcttttcacgcgtagcctcctccaccacggctgctgatcgccgtcactaaggaccgacacggaggatgacgaggagcttctccccgactccgcggtccgcgaccggctacgtagcgcgtgtccctgccagtctccgcagttacaccacacgtcgtgagcagcgtgcacctgctgccgccactgggcctcggcgtgctcaggccacccgccggagcccggtctgagctccgacgcaggatgcgcgtactcaacgtgcgccttccagtccatacagcaacaccataggtcgtgcgagtcgtcggctacccgccgccaggccagttcccgcatgggaaggctggacacgccgaccgagaggtcaccgagcccggacgccatctcttcttcctctccgtcgctgtcattaagcagccaggtcacctcctccgctccgcgtccgccggtctcgacggaccgcgccgccgtcggcaacacggaaaacagcacgccagcccgagccgctaaggccgcatgcccctgccgcccaactgaacacgcataccccgctcaactgcgttttgccacccctgtcagtgctctcgctcgagcaccaccccgcatctcccaacctttttccaataaacgaaaccgacatgacacacgtaatgggtactcgtggctagatttattgaaataaaccgcgatcccgggcgtctcagcacacgaaaaaccgcatccacatcatagacaagttacagtccacagtcacatacacgataaacaataccaacagggtaatgtttatggagtaaaacactattgtccaggccacatgcgtgtatgacttccgcaccatcccgtactgcatgttccacatgtacgcgctagacgtgtaatccactcgcagttcggggacgcaacgcagccagatcacatccccttgcagtaccagacgcagggctagcgtctcgaagatcggcatcacatctaagttccgcacgttccactttaacgactccccgggaacgaactccacgtcgtcggcgtgtacgtacaggttctctcccacgccgccataatcggccttcggatcgaagacgaaccgactcatgttgcccacgatgctcccccgagcaaacaacttgccgttgtcaatgtagcaccggttgtcctcgatttgaaaccagggatgcttggccgtggacttccagggccggagcgcgtcttccccggctttagtgattccatcgggcaggcggatcaagggacccatggaggtccaaagacccacccaggctttccagagattgttcatggtgaaacagcgtgtggactgtacgctctttcccaatttatatcccagagtagtgacgtgagcccagccacctcccagattcctgacgttttggttgtctttcctgccaattcctcccgtaaacttatgattatcctagcccattcccgataaaaatacacggagacagtagatagagttacgaataaaccggtttatttattcaagtgtctcaggagattattgaacgagcgtggataccacgccgtcgtcagttcatggtggcattgagcagccatagcaccagagtcccggcgcccggtatcagacacgctgacctaccgggcgccttcgagtccgtaccccgcggcctgggtgttagagtccgtaccttgcagcccaggtaggtttcaggtaccagctggttcgtacctgttaaataaatcgcagacgggcgctcacccctacggtcaggagcacaagaacaaccagagagaacagatatacgagcagggttctgaacagcagaccccaattgtcgtctctcatgcttcgctgaaggtaccagttgatggtctgagagctatagtccatcctcacctgaggaacacacgcggcatatttcttggggtctccccacctcgtagacaacgtgatgtccaccatatccacggtgtgcgtcaccgggtgcccaccgatgttccactcgaaataggctccgcgctcatcatggtggtactgctcaccggacacctgcagtctgtccatgtaagattgagagacgatacccacgttcacaaagtgtttctcggtgaagttgcccgacatcctccccttgaagtacagcatgcccatatggaaccagcattggttctcctccactcgaaagtgggccgatctgatctccgataccaccacatccaggggccggggcaccgagtccgcgagtctcaggaacaagacggccaggatcgcgagcaccaacaccggcttcatggctccgaaggtccgctgctcggctccgctcaccgctccggtctggctgcagcagtgcttcgctgagaagtagcgtgtggactgaacggtgtttttgaatatatagcgtttcttggtgacgttgtttcccctacgtagtaggcaactacgtgccaaaagaggcgttacggtactttccgtactgggatttccaaaccgggactttccacacggcggtttcaacaccgggacttttcacacggtgatttcggcaccgggactttccgcacggcggtttcgccaccgctgacgttctcatcgccgcccacgtcaacggtggcgacaccgtactttcccatgcggtttataaacgtcaagagtcacgtcagtcgcccacccccattacacggcgatatcccgatagggcatgaggggacccgggtgtcgcgacatgtcgacgacaggtgcggattagtggtcgtgtcgcgacatggacgtgcagggggatgtctgtcgcgatagagttgatgtgacagcccgctacacctctctgtcgcgacatgcatacacaacgggccggcttgtcggcgattgtcgcgacatatcgttatcagttagcgaccggagttgtctatcgcgacatatcgtcgactatcgcgacagaaaaaataccgttcgtagagaatgccgtgttgaaggaacgcgcttttattgagacgataaaacagcatcaggagccacaacgtcgaatcccacgtccagtcgattcgtatgttatgctgcacagcaatgctagaataacaaccagcagggtaatcccgcaacataaatacaaagtcacagcgaagaatccgtgtcgttctatcaagcgaaacgcgttccaaacggccccgtcacagacgcagttattcataagcgttaacaaccggtggctaggatgaatatccaaatcacagggcagtagccgacggactcgttgacaggtcagcctaccctcaaggttcctatcgttcggacgggatttgtgcgttttaggcctctttttcgccgcctgcaagcattggtgcgcaaagtcctcacccagctgtttccagctatcatctgcatctgtgcagtcccctgtatcgttgtaacaaacgggtctgtgcgacttcgttctcggaacacaagcttgttgtcgcggagacagagagagaagggttttcgggtcacgcgaagaccgctcaccgggggtcggcaacgcacacatcaacagaaaaccgagacgaatcaagagatccatagtgaaggagtgatatcgacgtgcttacgaaacggcgattatatatgttctcaacaataccgccctacgttgtatgatgtaacgtgtgacgtgagtctgatccaacactgaacgctttcgtcgtgtttttcatgcagcttttacagaccatgacaagcctgacgagagcgttcatcggggcatgaagtacgcattacacaaactccatatatttgttacgatagaatacggaacggaggaggctttcgccacacctatcctgaaagcgttgcattctttatgataggtgtgacgatgtctttaccattcccacggctgctttgcgtgatgatgacattcatcatgtatttccattcacacataccttttgtgcatacggtttatatatgaccatccacgcttataacgaacctaacagtttattagcccttgacaggataggtcaaaagattatatgtaggttttccggtaaaccgaattgtgatatttctctgcaggaaatagaacagcctggtacctataaaacggacaatgcagtactgtagcagcgtaaccaagtaggtccacatgaacacgtacaaaattatggtaagccatcgtttttcataccacagcctgtagctgtcgtacatgaatgaggacggtcgaggaacccagggtagttgtaattgggggcgacattcgtactgtccagaagacaattgcacgggtttcagtgagatgagtactttagcgatgtcggcgggggcgctacgtttcaccgtgacggtgagaacttgaccgtcgttttgtatttcatgaggcacgttatacaagccactggtatcatgaaggatgacctctgatgcgatgtgaggattaaattgtccctcaaaccgccaaacgctggtcatgtttccaccgtcaattacgcagctgacggtgtgagataccacgatgttggacttaggtttgggggctaattgcctttttacaaattcccttctgtattgcaggtcctgctgccactgcttttccgtgcggaaagtcgccatgtcttccacacgtgtggcgacgatagacgccaccaaggtagctaccagaagcagctggatccgcatggcattaccgtatgtcaattagaaagttgagcggacacggttatcgttcctggcggatataagtatataaacgcgagttagcctttcccgtccgttttgtacacccgttccccacacaaatgacgaatacgacctttttttttataaaaataaaccacgtgtattatataaaaacatttacatagaaaagagacacacggatcaacataaggacttttcacacttttggggtacacaggcgtgccaccgcagatagtaagcgctggatacacggtacacagtcctggccagcacgtatcccaacagcagcaccatcgccatacagatggcgatcacgaccccgagctctaagtgtctgtattcatagtgtagtcgccgcaggttatccactgaattcccgtaactgaaataacgtatatggtaccgaggctggcaccacatgggtttgcatttggtgcacggcaccaaatgcagagtgagatggtccaagtccgtgggcacccactggcgcaaacggaatacggcttcggtggtctccacgaggcactccggggcgtgcagacggccccactttcgtccgcgacggcccgaccagccgacccgagccactatccctttctcgggatagaacgtaccctgtacacgccacacagcgtccaacacgccgtccttgacgacgcagctggcctgatagctggacacgttgttaagcggcggaaagcgaaactgacgtgccggcggagccacatagttcggttcaccgtgttgtcgcggttcgtcctccctatagtaatagtagtcgtcgtcctcataggggttgccggcgtgagccagcgttacccaacagcagcccaggccgacgaggaggcgcagccaccgcctcatggcggcttcgccagtcaatcgtctttagcctcttcttcccgtgaggtccttccggtggcgcggtgccgacctcggacccagggacgtatccacctcaggtacacacagcaggctacctggacaccgaagctgaacaaggctacgtgtttcacaaactgcaccagtaccacatagaggaatgtcaggtagcgtctctccgcaaacagccgttccaagtctgagggcgttacccgcagcggcaaccagggcagcctggacgccggccggcaatggagcacgctccggttacaggcactgcaggggtaaacggttaacatcacgtaagagagtcgtgcgtccacctgtgggagctcagtttcgtaacgtagagccccgtcattttccagctggggtgcgccgaccttgaaatgggtcgcgctccgctcgttaccccaggtgccgtaggctctcggggccgtatcggagaagttgccacgcacaagccaggcggccacgagtaccccgtgctggacgtaacattcggacacggaactggagacacggtagccggacacgtccccaaacccgcgagggtactggggcagacggacggacttgctatttgacaacggacagatacgagacgacgaggacgcagacgactcgtcgctggaccacgacaaccggagcgactccttggagcggctcgagagtacacttactgcgatcagacaccagtgccagaagaaggaacaggtggacggggaccacaggatcatagccgccggcaccgcggccggccgcaggaagccgcccggcgcgtcgtctgtgtgcgggagccgaaacaccgtgcctctttatatcgtcccgacgtgacgcgagtattacgtgtcaggggaaacccccgtcacgacgaacgtgatttgtaagtgacgcggggtgctgacggggttcggcccgagaggtgacggagcgcctcacgtcagtatgatgtccgatccgcgtcagccccgacgtggttgtggtcaccgaaacccacgtttatatggacgttgagagcagcgcctgaccacatgattcatcataccatttctcggaatcgggcccatgccgggaaagcacattccttttcagtaaacaacaatgacatcataacaaatcattttattcgcgaggtggataataaccgcatatcaggaggagggatcgggtgatgacgcaggccccgcagaacagtccgaaataaatttttagtattgccccatagtcgcctagataccagaggtacgttaagttcatcaaaacgcccatcggcgtcccggaatcgtataccgggcacacgaagcgttcataacaatcccgggaggcgagtgttagggtagcagagtagtttcggggtcggtttccttccggcgacgacagttccgtgggcagcagaatgtacagcgcctcggtagctgtcgcggtgccttccacgaggatgggctgccggtgcctttcgtgattttccccgtcgtgtagccaagccgaggcccgcaaagtcttaggcgaggggaattgtccatagagtttcaccgcacccttcagtacatggttctgaataacacagccgcacgtgaagtaggtaggttctctcgtctcctccgtggctgccgccaccactcccagccaccacaacaggcagatcgccagagggttccggaggcttccccggcgtagcatggttttgggttaaagcaaaaagtctggtgagtcgtttccgagcgactcgagatgcactccgcttcagtctatatatcaccactggtccgaaaacatccagggaaaatgtcggtgcagccaacctttcacatacagcccccaaaacacttgaatcactgccaccatcatcagcgtatactgcgccgacttaatcgtgagcgcgtagtacgccattagacggcgatcttcgaacaatagtcgttcgatgtcctctaacgagctccacaggggaacccaaggcacgaggcaccggggttcgcactctacataataagtttggcattggtggcagggggaaaagtagaacaacacgagttttgtgcgttggggaacacgatagtcccggagccagtagcgttttgcgacgaggctttcggagacgtcctccaccggcgtcggcactcgatccgcgtagccctccagcgtctggtagtacacccggggtgtcggcgtgggcacggacaggttcccgcgcagggtccacagagcctccagtcgaccgcccgatcggagcacgcagcgcgcctcggaatactctactcggtactccgaaacatcggacagaggcggtaacggctccgtctccaccaagggcggaggttcatcgaaaagagtcaaggataattcaggcatactacccgcgaccggggcccagagggctagaataagcattacaaggttcattctgtcttacaagggaaggctgttaccctgtctagactcaaaagctgtaaggctgtcttatagcatgtagtcttgcacgtcacggggaacagggtggtgatctagtgacgtcgggagaacacggtgttttagggtgcgggggacaaaggacagtacgacagattaggtgatagaaacgtttttttttatttatgaaaaagccagtgtgccgtgcggcctagggccccggcgtagtttggataccagatgggggccgtcaggggtactaccacgagcagaaacataatgacttggtccatgtatagcagcatagcggtgcgcagcaggtcgccgtccgtgtagcaatttgacggtgagcgataaagcaccgttaatgtgtcgcggataagcacgatcttgaggccgtagatgaagctcacagtcagtgctaaaatgatgcgttggtatggttcccaggactgcacggcgatgaagagccagagtatgggaagcatgaagcttagcaaacagaggatggctaaccgtcgttgcatgttccaggccatgagccaggctaggcccgtacaccagacgcagagcatggatgacaggacataggcctggattaccacggtgcgatcgaaacacagcccgatggtggacacggatatcgtagtgagggtggtatataccatgaccagcatcagggtcccgggtcggcgccgacgttccagccagtacgcgtggcaacgcagagcgcagggtagcagtgtgctccagaagggcaatgtatcgcgcaggtagggggccgtcacgcgccacggtatgagcatgaaaaggatggtagtggctatggtggcgctggtctggaacacgacagtgccgtagagacgtaccatccagagaaagtgttgaacgctccgcagggtgtcttcatctttggtgattacggtgactcgacggatcggcggtggtgacggcggcgacacgggtgggggtttctctttcttatggccgagtggctcgccttggtgaaactggatctgtaccatgacgggtgctcgacgaacagtcgtgggggctttaggtacccggcaagttttatagagaaagggggacgatgggtggtggctacgagccaccgccaccttcgcaatacgaggatctgaaggcggcaaagacggtcgtccagggcaggcgccagaggttgggactgagcacgatcagcgtgattttaaacatggtcaccagtcctacgtagatcagcagcgagccgcgtaacgtctgagcagccggcagttcgtcgcggatgtaacgcgtgccgtagaaagtcacggtcatcataaggaagacgatggcgccgtagccgtagagtagaatacgctgatgatggaacacggtctggtcgccgataacccagagcgtgatgaaaaaaacgctggtgagtacccgtgagcatatgagctcccaacgcttagcgcgaaagctgtccccaaccatgacagcgccggtgcaagctatccacagcgtgaggaccagtgtgtagtcgatgaggatggcgggcaggtcggagcaccaggtgtagaaaaccgtggtaacggagaggaggcctacgtagcccatggtcaataccacgtcgtcggggtgcctttcgccctgtatcaagaccaaacaccagagaagggagggggcaaaaaccagcagcagaggggaagattcatgttgacatatgttgtgggaatcggggatacccagccaaatcattccgcagaaagccgtactgatggcgatgtgaaagaccactagggcgtagacccggacgaggacagcaaaacggcgcagccacataaggccgtggtgcagctgcaggagggaagcccattgcggcgaatgtagcgacggtagcggcgggtccatgaggcgggtgatgcgcccgagtgaacgggtgagcgtctcggtggagtcttcttataaaccagcggagctcaggcagccttgctctggaacgtcgcagtggtggtgttgaggatgacgctgagcgtgccgttgtcaatcaggtaatgatgataggtgccgagcttggccaggtagctgaacatttggtcccagcgtgccgaccacaccacgggcgtgagcatcaggagtgtggtgtgatagattagtgtttcggtggcgtaaagtatcagcgagctgcggatgacgtggctcacgggcattttggtggcgatgtagcgcacgtcttggaaaaggacggccaggatgcagcccacgaacacggtgtagagacacagcaaagtcttatgtaaccaggtgtaagtagaagccaggacgctgaccatcaccgtcaaaagtgtggaggtaaaaagcgcgtcacgccacacggagctgagacggtgctcccaagccacgccgttgcaggccacgaacaacgtccacgttaggatgaggctagaaatgccgatgggcgctgtggcgcacaggttgagcccggcggtggtgaacgagagaagcgccacatacagcgcaaacaccaggccgttgctggggtgtctgtgatcggtgagctccagcgcgcccagaaccaatactggtgtgcagctaagcaatagcggcgagggatcgtcgctgcacttgtagcccagcgaggggtaacccagccaaaccagcgcgctaatgagtacgctgaaagcggtttccagcgtcagcaatccgtagacacgcatgacaatcgcggtccgccgtagccaacacacggcatcttcggaaactgtggacgctgtttccgaataccgggaggagatcgtgcttccctcttccaaggatcggaaagtagcgtccgtcgtttccgcggacgcggcttccctggtacgctccgtttccgacgacgcggtttcccgctgcgtggaaactgtctccatgtcgggaccgcagcgcccggcggcgtatccgcaaggtctcgaagctacagcttgtcagaggaaaagtaggtttgcaaaaaggtgcgcagggtcatgattctcagcaccatcagcagagtgaaaaccagactgagaaacaccttgacggccgccaaaagcgcgcgttccagcggcgtctcgtagcgtacagccagggccgcttcgtggaaatgcgagacggctagacaggtaatgagcacgctgaaggacaagacgatcttaaagcaccaggaccaaccacgcctcaagatgaccaccacgattgccgtgaaggtcaacgtgatcaaagcatggacgaccacgatctgacggcggacggtacgttcgggagccaacaacgctacgccggtgcagctgagaaaggccagtaaggtgaacaacgcggccgagatgaccaacgtaccgtccaggcagagacatatcacgatcaacggcggcacgtgaagcagcgtgtaaaagagcagaacgccgatattgctgggatgcgatgtttcgtaacagtgaatgaagatcactgacgtgacgggtatgacaaagacgaggctgggcgaggactccgtgagacacagacgagaatggtgaaaccacgtcgcgggcgccgcgtagcagaaggcgctcaacaacgcggtcaagccggccagctgccaacccacggcgccataggtgtgcagcgccacgcggcaacagtcgacccaagccagactgcgggtcgccagccgggtctcttggatcccggggggcacgtagatgaccgtgccatcggtgggtacttgaaaccctttttctcttctcatggtgcgctgcgttctctggaaacggctgctctgtccgaaaaccagttccgaacgaaaatctagggcgagagggtggacaacggcgtcgacgacgaagcatgggacaggtcgttcggcgttaacgtcatcgcgtcggacgacggtagttctaagagacgtagatcgctcagcaggtcctgacagttgcggattcgcaagatcagaaaaaaaagggaaatgaacgtaataaagagctgtagcgacgtatgcgccacatcgcgtggcataagaacgtgacggacgaaaaggacctgctgcgaaaagtgaccggcgaagataaggcccaccgtgctgtagaagcccaaaagcagccgcaggggccaagtccagggccgcgtgaagacgatgagaacgttgaccagaaagaccacgacccagacgccgttgatgagggtaaattgatcggacagggtgcagttgtcgcgacagatgaagactacttccgcgcagagcaaggtgatgaccaacgtgagcacaaacgacgtcaacacctcgcggggctcctggcaggcacacgtgacacctagcgccgggatgtgcgccaggaggccggcgagtaatagcaccagctgtcggaacggacgacggcagcgcgggtgccggtttcgctgagcgagaaccggtcgctcatagcggaaatacacgaagagcgcggaggccacaggcaccaggaggagcacctcgggcgcccagacaacgtgacaaggaaagcccggacgcgacttgagagtcgctgtagggaagaccagagagaagctacccaagacggccaccgccgcggagatttggaagaggagcaagccggcgattcggacgacaacctcgaagcgatgcacccagcccagcacggccaccacggccgcttcatcatagtcgtcgttgttgccgctgtcgaacagccgccgaaacacgatctgtcgctgggtcgcggtgggaaagcgcagacccatgacagccggaggctatatgaccgcgcgtctaagacgcgagatccgtggggggacttttagatgtttgggcggcccgcggttctaacaggcttgattggtggagacggccggcgcggcgggtgggggaaacgacgagtttttccgttacgccatggttcgcgtgaggtttctctgtacctcccgcaaaaggtcacagcccgaaatggaggccgcgttggtggccccggtggcgcgtgacgataaccaggtcatccaagcgatgagtttgtctaatgagtcctcggtggtgaagaggatgagaatgagcaggtacaggtacaccaggttctcatagagacacaaggtgagcaggtcagcctcggaccacgcgatctcaaacaggcgcgtggtgtcaaagaccgtgacgaccagcatgaagctgagcgccatggcgtaatagcccaaaaaaagtttgtgccccaacggtacgggctgcaggtaaagtgcgatcaagaacgcgataacgccgatcacaaacagcgtgacgatgacctgccatcgacggtgattatggccggctagacccgtgacgcagctgcagaggctaaaaagcacgcaagccaagaggcccgagaaggtcactagcgtagaggaggagcaggcgctggccacgatcaccgaaagcgtcgtgagcacgctataaatggtgagcaggccagggctcggtggcgacgtgaacgatccttcatcgcgtttgccgtgcagcagggccaaacagatggtgggcaccatcaaacttaagggcggcataaagccggtgcaacagagaaagacggtgcctttaagatgcggaaaagccagcaccaggcccagacagagcaagaaggtgcaggtgccctgcacggccacggtgctgtagacccgcatacaaagtaaaaagcgacgtacgtcgttcgtcgacacggaggaaatcataatgactccgcgcgagggtcgcgggggtgggggcgcccaggccgtcccggtggcctctgagttcggagacatgacggcggtggcgatcaaaaggcgcgtatgagaaaccgtttatagagtgtaatagaatcaccgtcattcccacacggcgttcccccataaagtcacgtaacactcgagtaagcgtgaaaaagctttattgttgaataaaaaacacgagtacaacaccgagttgcggtgtcctgtctgtctactgggtggggaaggttcatcgtctgtctctagagggaaggtggggaatgtctaagcgagcgggagcgtgtcatctcccccatctttttacaacaagctgaggagactcacgccgtcgatgcgtccgccgtgtttctcggcgtactgctgcacccagacgtggccgctaaatatggcgacgctcatgtttaggagactcatgacgatggtgtacaacacgacgctgacacagacgctgtttttagacaacgttccacgctggtagatgagatccagggtctcgtaaataagcacggccgaagcggcggtcaccaccaggacgtagagtccgctgtagatcttgctgacccacagcacgggcgaaaagtaaagcaataggtaaaagacgatgacggaccagccgtagccaatcccgatgactttccagcgcgtgggattgttgccggccaggtaggtgagaccgctgcagagaacgaaaaagaccatcaccagggcaaacgacagaccgatgacgcgcctttctccgcaaaagcccgtgcacacggtgatgccggtgttgatcagcaagcacgccaccgtgagatgagcaaaattggtggtgtgtgggcgaaactcggcgaaaccgcgtagcatagccagcgtggacacgggtacgatggaggatagggctggcactatgccgttggcgcactgtccctgcacatcggggaaggcgagccaagccagcaagcagaccgtgagggtacaagccagctgccacacgagcccgtgatagacctccatgagcagcttaaagcgtttcaaccattggaagagctgctgttcggccaccagcgcgtggctgcgatggagcggcacgatggtgaccgtcggcgactcatggtgttcggaaaccgaggcggtgtcgcccatgctgccgcttacgaccgctgtcggtctaaggtaggcgtcgatgaaacagtccgtcttatcagcacccggttaccgcggatttgattgacgtcacgagtgtggtcaaaccgtggcggcaccctgtatccgacccgtcgtcatgggctccacaaccagagcctcagaagatggtacatgccgatgaataaagccacattttcgacatagaggcgtagcgagggctgaaaactctccgggaaagaactctgacaggtgatcagggacagatcgtgaattagcatcagcgtcaccgtcaacagcgtcgtcgcgtgtaaaccgagaaagaacggggccgcggcccgcagcagccaaagtcccagcgccgtagcgcagagcagagacaggaccgacggtagccacagccgccggagagacgcgccaggatcgcaacccaaaagcgaggcccccaggcagctgagatctaccgccagggcgagaagagccgcgccgacaaaggcctgcggcgacggctggcacatcagcaaggtcagaaaggctagcgcgtgcggcaggcagtaagccaacaggagtgggagtttgcggggacaacggtcgatcgacggaccgcgtagcagcaggaacaggcagccgacgggcacgacgaggctgagatgagaaagcggcggtgggtcgtcgtcccgtccccgctcgcatagctcggccaccggtggcggcatgagccaccagctgagcacgctgagggcgacggtggcggtaagctggaaggcgacgaggacggaggcgcgcagccataccgccagcctctctaggtaggggactacctcctcgacggtccattctagcgggacgacatgaagcatggcgacaagcgcggctgctgtgaaaacgggcacggttttataggcattaggacttccccgtcgtactggcggctgtcaaagtcccgttgtccaaaggcgcgccgtccgaaagactaatccaacggggacccgagagcatgagcaacaacgtgagaaagatggccatgctgtccaggtagagacagacggcgtgacggatgcattggttaggtgggcagaaaaagatgaccataagactgtcgtaggccagaatacccaaaaagaagctgatagagaaggcgcacaacgtcaccactatcttctgcagccaatcggcgtcgcttagcagagcgagcgtgaggaacgaaagcagcattaccacgtagacgcagctgatgcatttccagcgacgtcggtcacggccacctagaaacgccagccccgtaaaggagataaacaacgccagggtcatcacgtaggaacctactagtacgcggctttcagagcacatttggaagatggccgccgtcaggctgttggccaacagatagatgaaaagcaccgtggcgttactagggtgttcgttgcccaacgtgtacgtgatgaacatgcagacgatgggcacgagcacggtgagaaagaagctgtagttctcgacgcaaaagttgcggttttgtgggaaccccaaccaaaaaacgcttcccaagccgaagctgaaagccagctgaaagatgaagatggcgtacacgcgcagccatacggtgaactttttgaaccactcgagagcctccatgcgggagagcagcagcgcgttagcctcctgcgcctgcatggtggcgacggtctcggcacaaagccgctgcggcgcacctacccttctcttatacacaagcgagcgagtggggcacggtgacgtggtcacgccgcggacacgtcgattaggagacgaactggggcgacgccgctgctgtggcagcgaccgtcgtctgagcagtgtgggcgctgccgggctcggagggcatgaagtagagcacggagacaaagaggtacatgaggtccatgtacaagcagagcgcgcccgggatataactctcatactcgatgtcgtgcaggatgtcctgcgtatcgcacaccaccgaggtcacgatgacggccaaaccggctatcatcaccaggatctcacttaccgcctcgggaaaaagagaaaatacggcgaacagtaagagaatcagcgtggatgcgcccgtcaatagggaacgctgtaattccacgtcgcgggcaaacagatacgtagcgagcgtgaggaaacaaaatagcgtcactgtggccaccatggcataaatgactgaacgatgactaaagtggaagcctgacgccgtgacagccacgctggtaagcaacgtgtacgtcagtaagatccatacgtttttgggaaagttgggctcggcccaacgcaacagacctaggcacacgatggagatcattaagcaagacagcgtcagacgcacgctggaaaagagctgctccaaccggtgcggcaacaccagccagcaaaaggcgcagacgctcataaggatgaggcattgcacccagataaggatgtagatgcgcagcaggaagaccgaccgggctatctggacctgaccgcggagcgacatggcggcaacgccggcggttatcgccgagattcgtctaaatacacgaagcgaactagaaaacgcacacacgtgatttgcaaaaagaaagcagctgccggcttattattttattaaaaatttatctgtgcagaatcataagtttatgatgaataaaaacggggaaagggaatctgcttttagggacccgggtctggtccgtcgtctcccatctggtcgggttcggggatggggacctgtttcagcgtgtgtccgcgggcgtgcatggcttttgctcgccggccgcgctgtaaccaggcctctttctctgtggtcggcgagtcttccgacgggtagggagcctgggagtccatcgcttcaggcccaccgctcgttccctcgaccgtcgtgtcgtcctcgttttcgctattacacggggtttctggagtatcgcctatacggttggcgattctccgggggcggccgctctcgtcctcgtcgctgctatcgccgcccggtaattcgacgccgcattcgttgtacggaacgcggcacatgggcggcggaaagaacttgggcatgcgaaagcagcgttgtccatccacggtctgcgtggtttcatcgttatcctcccataatcccccctgtagcgccggcagcgtttcgacgctgtgagaggggaaggcccagttctggttgtcttgcagcgcgcccgtgggcagtaggtccgtgcggccccatgcgctgctgttgttgggtaccttgtcagtgccgcgagtaggtcgcagaaaccagtccagagcgctctctagctgcgagcgtgtgatggtgcccagtgcgccgtgccagcgcagcacgtctcttttcagcgtgtggtgacagacgggcagctcctccaaccgacactcgccgcgcaatccgcggtcgaagcggcagagaccacgcagtttaagcagaccgcacttgagaaacatgtgaaaattatcggcaatgcgatataggtccgagtcctcgatcttgtgtaggtagaccacgccaaacttgtcgagcagcaccaggccgctgggcacaaaaggcccgtaggccaggtaatagcccacgaggccgacgacgtaccactcgcagcacaagcgttgacgaataaagttcagaagatcgcgaaagtccgcggccggcatgtggtcaaaaggccggcaggcgcgcaggccctcgatggagcccagcatgagcaacggctccacctcggtgcgacccggcgtgcggatgaccaggttgagaccgctcatttcgcgggccgtcttggccacggccgcagcgtcagtggggtcggtgcagaggaatttttgcacatgatagcgcggttcggtggtggcgaacggcgtttgtgggtgccgatacacatattcgcaccagagtaggccgttcttggaaaaggctttgatatcactggccacctcgtagagcccgtcggtctcccagtcgtagacgtagacggtgccgtaatgacttagcatgagcacgcagggcagttcctgcgcctgcttggtgtttcgtgttagatcgctgtcgggtggacgcacggctagtacaccgacggcttccagggtgtcatcgcagcagagatagtcggcggccagagaacgtgcgtaaatctgcgggatggcggcctgttcgcgcatcactaggaaccagttggcggggttgcgcagtgctacggtggttccttggtggcgttgcacgtaggttctcagcgccggaggatcgtactggcgcagatagaggccttgcagcatcgataacgtcttttgaaagacggtgtttctaaattgaaaaacgccgtagtcgcagcggatagcatcttcgcagcgctcgtcgcgctgtcggagataggtgccccaggcttcggcggcggctttggtgagtagggacatgccggcggagccgtctcgacagcgagtcggataaagcgcgctgcgcgaaagcttaatataggagcagcgtcagacgaatcgcggctggtggcccggggggtgggacgcgccgcctacacaaagtgctcccgaaaatcgaaactcttgacccactccggagacaaatccgtattcagattgatgcgtcgagcttccacttcggcttccgaaacctcggcctccgtccggtaggcgttaacaatacgctgacccaggtgccaacgctctttctctgccaaacgccgttgctcaaaccattcgtctacgtccttgaggtcaaagacagtgtcctcctcaaggtcaaagcctaggtcttcccactcgtcgtcatcgctctcgtggccggcggccatacgcgcggcaaccgcgtcttcccctcctcttctttcaacgttgggtaccacgttgttttcttcgggttccataggttctgcgccgctgtcgtcatcatcctctccctgctcctcatcgtccgccaaggcgtcgtggattacctccaggttctgattgtcgggtacgacgtggttatcttcgtcgtcgtcgcgtggcatgggcggcggccgacggcggacgaccggcatggcgcggccgtcgtttccttcgtcttcctcttcaccgtctcccaaggaacgcggtcgacgacgttccgcgaagtcgccgcggaccacgcgcgcctgccaaatggtaaacgcgtcccaaccgtcccagttattgagcatttcggcgcgaaaacggtcgcctcgacagagccagcgaaactgccgcgcgtagtcgcggtctacgccgctgtcgaacatggtaaagtgcagacgcgccgcctcgcccatgtgtacgcagcctccgttgcgttccagcctggccgcgcgccgtagaccgtgttcgtagcggcgacgcacgtacaccttcatgaggccggcgcgaaaaagttcctctaggctgtcggccagccggtagatttcaccggctagacgctgcaggggcggcgagcggtccagatgcgacttgacaatcaccacgtaaaaacgacagaaacggtcgaagatgatgaggaaggacgtgtcaaaaaaaccaccggcgcggtaagagcccacggcacccagcaggtaccagcggcaacgcagttgcagcgtgacgtacatttcgcactcggccaagcgggcggctggcgctacctcgaagggccagcagtccgtcaagcagccgaaactggtcaggagtttcaacgttttggcatggcgtccaggtgtatgaaagttcacgtcgcgtccgtggtgttcgccaacgcaggcggccaacgcgtcggcgtcatgaccgtgacgcagcagcatcgctaccacgtcgtgcggtacccgcgtagcaaatggcgtctgtggctgacggtatacggcttcggtgtacatcataccgtaacgcgccagctcgtccagatgacgcgcgcacagcagcagaatctcttgcgagggttcgtagatgtagaggcgcgtaccgccacccatgcagagcaccagctccgtctcttcgtagtgatcttccaccatgatcacgcacttgcctagcacgataaggcgttcggggcaacaaatcacgtcgtccagcagctggtcgcgtagctccggcatggtgctgccgggccgtacctgcaggaaccagttgtgcggaatgccgagcgacagcacctggtcgacgtggttacggacccagtcgcgaagcacgtcggcgctgtactggcactcgaagatgccctgaaagtcgcccatgacccgcagaaaagtttcgtagcgcgtgtggcaatagaggaattcatcgtttcgcgtaaacgtgggagctccgtcttcccaacgtgtacgccacatgtcaaaagaggccgccagctagacaccccagaaaagaagcagagaaagagacttctttgtgcgacacgttttattctgcgtcctccgctcgacgttcaaatctggatgtactcgcgcacacccgtcaggctctttaagggaaaagggtccgagtacgtcactaaccgcgactgatgcaccagggcggtaatcacccgctccgcgccctcgcgcgtcgacgaacgcgtcgtcaccaggcaatgcagccgcgggcccgtatcgtcctgatgaccagcggcctcgcgctcggctgcttccacaccgacaatgtcgggatccaacacgtagctctgcgagttggtgtcgtagcggtgtagcaccaacgtgttggggtccagacgctcccacgcgccctcgtgcgggtcaaaacgctccgttaaacagagccagtcatactgctgctgcagaatacgccgctcgcgctcgcgtcgctcatcgggcaacgcggcgtcttcgttgaagagaatgtcccgcttgtggtctacggcacgctcgtggtggtgcgggcacaggtgacggtgttccatacgcgtctgacgttgacgctcgcgctcaaaacgccggtgtcgaaagaccattttcagcaaccccatgcggaaaaactccgtgatggtgttggcaacgcgccgcacatagtggttggggtcgtccatctggatggcgtacacggcaccgaaccagtccagcagtaccagcacttcggccacaaaactgcgtcccggtcgcggacgtcccgtcacgcctagcacataccacggcgtggccagattagcacggacagcccaccaccaacgacggctctccacctcggtgagcgcacaaaagggccaaatgcggtgtaactgctgtaccgttttcatcaaccgcataatcaccgtaccgtaacccggtgtatgcaactttacgtcgcaacccaggattcgttcggccgtggcgtacgagccctcgggcgtggtgtcattgagaaacaaaacatgcatggtacgcgcgcccttaggatatcgtcgcggaacgggtaccgtcattctccgcagagtggtgtgaatcacgtcgcgatacgcaatctccgaacgtgacacaccgtaacgtgccagttcgtccaggttgtgcgataccaacaccatgtacttttcacgagtgtcgtaggcgtagacgcgagaaaagcgacccataaaaaccacgtacggagtagccaccatgccatcatggtgatcgcgacgtggctcgggcaacaaaataacagcgtatcccaacggcgtcaacggctcgcggcaacagatgagctttgacgccgcctgtttggcggcggtaatgatcccgtcctccgtacgtaacatcacatgccagcccttggggggacccaaggacagacagcgtccctcgttacgatgaacgtaacgcgtgatttccattggctccaggcaaaagaacagttccttaaaatcccgcaacacttgtcggtataacgccatgggatcctcggccgccacaggcagcgcggggagctccggcggcataactgcagcgccgtcagggccagaacccgcagccggatccatcattgagcgacactctcagccggacaaccggcgtcactgacagaagccgagccaaatacagagaaagcaacgctacaccgtcaccccgctcccaagcgccgcggaaagtgctccgatttttcaccgtcgttcgcgacgttgatttgcctcggtctgagaaccgacctagcgttcggaccggtgcgcagaaacagccggcggtccgagccactgagcggttcacagccccggccgccgatagttaccggagagacgttcgagctgcaggtacatcagcgcttcccgcttcgccaccccgcgcccgccccagtttatactctccgacgccccgtccaacgcgcctgtggagggccaatcggaccgcgggagctctccaagtggatgacaggcacagccgagtgcccgaccgtgaagagccctcatccacctgaacagaccgctaaccgaaggaccccgagtcgcgtccgtcggtcccgacgtccgtcgccatctggctccctgctgttggctacctctcggatttcaaaaaagagcacgtgccgatgacggtgcacaggaaagagccaaagtgtcacggcgtctttttttatttgtattcctttcctgttttgtactcgtaaactgttgatgttgtttttacatccaaaagggcaagtaagaaacaggatgaggcatggtaggtttgggcgtggggcggccctccagcacggcggcccgggccgcccggcgggtgagcacccggcgttgcgccgtgtctatcttgtgtttcttctgtgtctttttcctatcttgttccgcgacggcctctttcatcacgttcagcatgcgttcctcgacgccctccagggatcctggggaggagggagtcctagtgaggcttccaatgttgttttgtggattttcggtttccttttcttggtcgtcatcgtcggacgtgtcgtcttcctcttgatcctcttcttcgtccgagtagtagacgcatagtccttggttcatcaggctgggattcatcaggttctgacggggaatccgctgttgtagacgtttaaccgcccgttccaggcgagagctcatgccgcaccagacgctgtaacgccgcacgggcccgtagcgggctgtttgttcgcgtacatgatcgttgagctcttgccaatattgtttggcacactccagatcggaggtttgtggatagtcgggtcggatccgcggatcccaactgacatcggcggtgccggagacttcgtccagactgttacgcatagagcaccagtcgggtcggacgataaacctgtccttgcggattaaccatttataacgtagttcgtgatggcgtgtagaggcccgtacacgctccacggtcccaaagcggtcccagaagggaaagttttcgtgggggcagcgacccggcacttccagacgttcggcgtcgtccacggcgtagtgaaaacgccggccggcctggtaaattttgagcagacccactgttaacaacatatccacgctgtcagccaaccgccagatctcgcggcgagacacgtcaaaatagaaaaattcgcaggctcggtcgaccaggatcacgaaatcggcgtgaaagacgccggagggtagcgattcgcccaccacacccattatcatggtttcacagcataagcggtccacaaagaacttcaacaggtcgttgaattgctccgtctccatacagatgaagggccagacgcctttgaggttctcggcctggccgcagagcagtagcggacgtgtcatctcgcccggagtgcgcagaggcacgcattcgccgcgataacgacaggtcacacgctgtagttcgctgatgctgttgtcgtgcaggcgaaggtcgcagataatatgatccggttgcgtggttagcagcggcgtgcgcatttgctcgccgtagatggcctcgcagtgcaacagcccgtgtcgcgcaaaatcgtccaaactgtgcgccaggtagtaaagcaccccgcgatcgcggtctagacaccacacggtttcgtaacgtcctaacaggagcaccagacgggcctggctaggtggctcaatttcctctacatacacgaaaaagtcgtcatcgtccgagtcctcgtcctcagaagaggaccgcggcccgtgtactctgggcaacacggtggtagagaactgcaggacgcccagagactcgagcgattcttcgcagcagatgagctgaccccagggcgtttcgggcccgtcggtgacagccgcgctgccaaagatgtcctcaaactctacaaaatctagacgccatccgggtggcgctgaaatgggaaggctaatgttcatatcagcatagctacgaactaagtggcggatgtcctgccgcaagtcttggcagagaatgagctttcgtaaacccttgagggtcctccgaacaacggccccagacgcgtagcgataggactggcgcatggtgccgcggcgtggagcggcacttggcagcctattttatggagtttcttcagtgacgtggcttgttcacgtcgttcgtgggctgcggttggcagctccggtctgtaaaccacccgaaaagactgacatcgacgtcaaagactcacgtaatttggaacatgtgcgaccgcaaagtgcgtcagaatagcacgtggctttaggacataaaaagtaccgtgaggtctagacgtgggttttgtgattgacacttacaccaggtaagccaagggacggtgaaactgtatgtgaggaatctgggtgcttagacgactaacgtgtaatgctttttacaggactgttcgacaggtgatagtacctgtaaggtgatgaccacctctacaaataatcaaaccttaacgcaggtgagcaacatgacaaaccacaccttaaacagcaccgaaatttatcagttgttcgagtacactcggttgggggtatggttgatgtgcatcgtgggcacgtttctgaacgtgctggtgattaccaccatcctgtactaccgtcgtaagaaaaaatctccgagcgatacctacatctgcaacctggctgtagccgatctgttgattgtcgtcggcctgccgttttttctagaatatgccaagcatcaccctaaactcagccgagaggtggtttgttcgggactcaacgcttgtttctacatctgtctttttgccggcgtttgttttctcatcaacctgtcgatggatcgctactgcgtcatcgtttggggtgtagaattgaaccgcgtgcgaaataacaagcgggccacctgttgggtggtgattttttggatactagccgtgctcatggggatgccacattacctgatgtacagccataccaacaacgagtgtgttggtgaattcgctaacgagacgtcgggttggttccccgtgtttttgaacaccaaagttaacatttgcggctacctggcgcccatcgcgctgatggcgtacacgtacaaccgtatggtgcggtttatcattaactacgttggtaaatggcacatgcagacgctccacgttcttttggttgtggttgtgtcttttgccagcttttggtttcctttcaacctggcgctatttttagaatccatccgtcttctggcgggagtgtacaatgacacacttcaaaacgttattatcttctgtctatacgtcggtcagtttttggcctacgttcgcgcttgtctgaatcctgggatctacatcctagtaggcactcaaatgaggaaggacatgtggacaaccctaagggtattcgcctgttgctgcgtgaagcaggagataccttaccaggacattgatattgagctacaaaaggacatacaaagaagggccaaacacaccaaacgtacccattatgacagaaaaaatgcacctatggagtccggggaggaggaatttctgttgtaattcgatcctctctcacgcgtccgccgcacatctatttttgctaattgcacgtttcttcgtggtcacgtcggctcgaagaggttggtgtgaaaacgtcatctcgccgacgtggtgaaccgctcatatagaccaaaccggacgctgcctcagtctctcggtgcgtggaccagacggcgtccatgcaccgagggcagaactggtgctatcatgacaccgacgacgacgaccgcggaactcacgacggagtttgactacgatgaagacgcgactccttgtgttttcaccgacgtgcttaatcagtcaaagccagttacgttgtttctgtacggcgttgtctttctcttcggttccatcggcaacttcttggtgatcttcaccatcacctggcgacgtcggattcaatgctccggcgatgtttactttatcaacctcgcggccgccgatttgcttttcgtttgtacactacctctgtggatgcaatacctcctagatcacaactccctagccagcgtgccgtgtacgttactcactgcctgtttctacgtggctatgtttgccagtttgtgttttatcacggagattgcactcgatcgctactacgctattgtttacatgagatatcggcctgtaaaacaggcctgccttttcagtattttttggtggatctttgccgtgatcatcgccattccacactttatggtggtgaccaaaaaagacaatcaatgtatgaccgactacgactacttagaggtcagttacccgatcatcctcaacgtagaactcatgcttggtgctttcgtgatcccgctcagtgttatcagctactgctactaccgcatttccagaatcgttgcggtgtctcagtcgcgccacaaaggtcgcattgtacgggtacttatagcggtcgtgcttgtctttatcatcttttggctgccgtaccacctaacgctgtttgtggacacgttaaaactcctcaaatggatctccagcagctgcgagttcgaaagatcgctcaaacgtgcgctcatcttgaccgagtcgctcgccttttgtcactgttgtctcaatccgctgctgtacgtcttcgtgggcaccaagtttcggcaagaactacactgtctgctggccgagtttcgccagcgactcttttcccgcgatgtatcctggtaccacagcatgagcttttcgcgtcggagctcgccgagtcgaagagagacatcttccgacacgctgtccgacgaggtgtgtcgcgtctcacaaattataccgtaataaaaaagcgctacctcggccttttcatacaaaccccgtgtccgcccctcttttccccgtgcccgatatacacgatattaaacccacgaccatttccgtgcgattagcgaaccggaaaagtttatggggaaaaagacgtaggaaaggatcatgtagaaaaacatgcggtgtttccgatggtggctctacagtgggtggtggtggctcacgtttggatgtgctcggaccgtgacggtgggtttcgtcgcgcccacggtccgggcacaatcaaccgtggtccgctctgagccggctccgccgtcggaaacccgacgagacaacaatgacacgtcttacttcagcagcacctctttccattcttccgtgtcccctgccacctcagtggaccgtcaatttcgacggaccacgtacgaccgttgggacggtcgacgttggctgcgcacccgctacgggaacgccagcgcctgcgtgacgggcacccaatggagcaccaacttttttttctctcagtgtgagcactaccctagtttcgtgaaactcaacggggtgcagcgctggacacctgttcggagacctatgggcgaggttgcctactacgggggttgttgtatggtgggcgggggtaatcgtgcgtacgtgatactcgtgagcggttacgggaccgccagctacggcaacgctttacgcgtgaattttgggcgcggcaactgcacggcgccgaaacgcacctaccctcggcgcttggaactgcacgatggccgcacagaccctagccgttgcgatccctaccaagtgtatttctacggtctgcagtgtcctgagcaactggttatcaccgcccacggcggcgtgggtatgcgccgctgtcctaccggctctcgtcccaccccgtcccggccccaccggcatgacttggagaacgagctacatggtctgtgtgtggatcttctggtgtgcgtccttttattagctctgctgctgttggagctcgttcccatggaagccgtgcgtcacccgctgcttttctggcgacgcgtggcgttatcgccgtccacttccaaggtggatcgcgccgtcaagctgtgtcttcggcgcatgtttggtctgccgccgccaccgtcagtcgcaccacctggggaaaagaaggagctaccggctcaggcggccttgtcgccgccactgaccacctggtcactaccgccgtttccgtccacgcggatacctgacagtccgccgccaccgtaccagcttcgtcacgccacgtcactagtgacggtacccacgctgctgttatatacgtcatccgacatcggtgacacagcttcagaaacaacgtgtgtggcgcacgctacttatggggaacccccggagcccgctcgatcgacggctacggttcaggaatgtaccgttcttaccgccccgaattgcggcatcgtcaacaacgacggcgcggtctctgaaggccaagaccatggagatgcggttcaccatagcctggatgtggtttcccagtgtgctgctgatactggggttgttgacacctccgagtaacgggtgcaccgtcgatgttggacgaaacgtatccattggagaacagtgccgccttcgaaacggtgcgacgttctccaagggagacatcgaaggtaacttcagtgggcccgtcgtcgtggagttggactacgaagatatcgatattactggcgaacggcagcgacttcggttccatctcagcggactcgggtgtcctacaaaggaaaatataagaaaagacaatgaaagcgacgtcaacggtggaattcgctgggctctatatatacaaaccggcgacgccaagtacggtattcgtaaccagcatttgagtatacggttaatgtatcctggggaaaaaaatacacaacagctgttggattctgatttcagttgcgaacgtcaccggagaccgtccacgccgttgggaaagaacgccgaagtgcctcccgcgacccgcacgtcttctacatacagcgtcctcagcgcttttgtagtgtggatcggatccggcctcaatatcatctggtggaccggcatcgtgcttctggcggtggacgctctcggacttggcgagcgttggctgaggttagcactgtctcaccgggacaaacatcacgcatcgcgaaccgcggcgctccagtgtcaacgcgacatgttacttcggcaacgtcgacgggctcggcggctgcacgccgtttctgaaggcaaactgcaggaagagaagaaacgacagtctgctctggtctggaacgttgaggcgcgaccctttccgtccacacatcagctgattgtgctgccccctcctgtagcgtcagctcctcctgcggttccctcgcagccccccgagtattcgtctgtgtttccgcctgtataaaaataaagagacgggaggctgatcgcggccttcagcgtctcatttgtctttactctcgagtgcggtcggtgtctcgtcggtgagacgaggccgccgcccgacaagttcgatctcatgtcgctcttggagcgcgaagagagttggcgtcgcgtagtcgactactcgcacaacctgtggtgtacgtgcggtaactggcagagccacgttgagattcaggacgaggagccaaactgcgagcagccggagcccgcacactggctggaatacgtggcggtccagtggcaggcccgggttcgcgattctcacgatcgctggtgtctctgcaacgcctggcgtgatcacgccttgcgcggccgttggggtacggcgtattcctcgggttcctcggcctcttcctccggtttcgtcgcggagagcaagttcacctggtggaaacgactgcgccacagtacccggcgctggttgtttcgccgccggcgagctcgatacactccgtctaactgtggggaaagtagcactagcagcggccagagtagcggtgacgagagtaactgcagtctacgcacccacggcgtgtacacacggggtgaacaacactaatcgataagtcgcgtgtaggcgactggctacatcaaccggatatctgcggggatttaaaaagacgacccgttgtcatccggcttagaccaaaccgtccttttatcatcttccgtcgccatggctatgtacacatccgaatccgaacgcgactggcgtcgtgtaatccacgactcgcacggcctgtggtgcgactgcggcgactggcgagagcacctctattgtgtgtacgacagccattttcagcgacgacccacgacccgagccgaacggagggccgccaattggcggcgacagatgcggcggttacaccgtttgtggtgtttttgtcaggactggaagtgtcacgcgttatacgccgagtgggacggcaaagaatccgacgacgagtcgtcggcgtcttcctcgggcgaagcgccagagcaacaggtccccgcttggaagaccgtgcgggccttctcgcgggcctaccaccaccgcattaaccggggtctgcggggcacgcccccaccgcgcaacttgccgggatacgagcacgcctccgagggctggcggttttgcagtcgacgggaacggcgagaggacgatcttcgcacgcgggctgagccggaccgcgtggtgttccagttagggggagtaccccctcgccgtcaccgggaaacttacgtgtaagaacacggcgtgacaataaacaacatagcgtaaatccccgtgtgatgtgtgtgattgacgttcgggaaacatgtccccatcatcagcgtcacaattgacgtgggttggtcactgacgtgcaggatgttacgcgagtcagagaatcgcataagaacggagtggtgagcgggttcccacaggagtctctggcgcaaaagcaccatgagcctcaggttccccgagagggtgggttacgagaaactgggataccgcccgcatgccaaacgcgtgcgggtgcatgactcgttgggattgacgcggtttatcatgaggcaactcatgatgtacccgctggtgttgccgttcacttttccgttttacgtgccgcggtcctagcacgtcagtggtgacgctgataattgcaacatggcccatgacgaacccgcttgggacgaacgtcaataccacgtcaaaccaccgtgacttggctgaacgttgaaacataaagccaaagcgccgtcggcacttggcttcagagcagcgcctcggggcgatgcgacggcgatgaacttagagcaactcatcaacgtccttggtctgctcgtctggattgccgctcgtgctgtcagccgcgttggtccgcatggctccggactcgtttatcgtgagcttcatgatttctacgggtatctgcagctggaccttctgggaccagtggtggcggggaatcgctcagtccggacctggagagagcaggcggaccgagccagagggaccttcgcttggcgttcaggccttaatactagccgcatcttacctgtcggcagcatgtatcggggctccgacgccttacccgccggcctgtatcgtcccgaagaagaggtgttcctcctcttgaatcgctgccatgggccactgtcaacgccgaaaaatgcttgtctggctgaggttggtgtcgctaatgccacttttttgtctcgcttcaatgtcggtgattttcacggagcgtcatgggaaaacggtaccgctcccgatggagagcccggggtatgctgaaattcctcttaaaatttcgtaaacgacgtcgtccagtcgttgtgccgcgattcgtacggttcatcgtctacgtcgttttgttcaccgtcgctgtgcaacgcgtgaaacaagagcgtgatgcgcaccttcggcggtatgaagaacgattacggaaaaaccgcgcacggcgtcggcagtcttttccgtgacttggggcgatgggtccgagctgcggtatgggtcacggcggcgtgtgttttattgacgaagatgccgatgtgtgactaaaaacgtcccagccccagagcgatatgtttcaataaaaaaaatatgtagtatcatattatgcgtgtcctggtttttcatttttggatgtatgtatcgcataaagggtggcgaggtgtgaggatgaaacatatgcagatacgcagtgttgttatccgaacgaaacccgtgtaatgcgtacaacggtacttcagtatgaaagtcccgtgtgtggggggggggggcaaatagttgcgtttgccgttgggcgtacgctacgtttgtatttctggctataatatgtgcggtcatgtgtcgatgttcctattgggaagggtgtgactgtagggtgtataaagtacggtgggacgcagagggacattgatagaaacaggttgagcgctgtacgagtttcacacgctgaatcggcgccaagaataaaacagtggttattcgtaaaagtatgggggggggggggatgttgtcgacggttgttagatgcattgcgtatctgtattagtagttttgcaagccgtggtgcgtgttattgtgacgtagcaattatcgtattgtgcatgtgtcgttcatcacagagtttagtatactaatatgaagcgtcgcgagtattaaagcaattggtgtctctgtgctagtctaacaacacctgtgtaatgcgtacaacgagaaaaaagacgcgaaagcaacgtgtatgggggggggggggaataatattgctaatcatgcgtcttgcagtacagatagccgctgtatcttacgcgtattgtcgcaacagttccacatcggtgtaattggatgtctggtacttatcactggcgtcgttataacattgtaaaacaagttttcgaaacataacgacagctgcaaaagaaaaccagtttattgagcattgtaatggtagtgtgtggctatattagaaaacgtgacgcgtcgcatgtcgcggcacaatctggcagcggggtcggggtagggtacggtgggaggcatgtacacagatggaacaaaagcagaagtaacgtgagaaggagcatacagtccagtatccagcggttcctgagtagcaccacccatcaactgaatgccctcatgagtaaaagtctgcgggcgacagcccttggggaccgttggcatgggacgatcaatctccaaaccacagcgtaacaccgttttcttccaacgtcgttgatagacgtcgtttttacggttactcccaagaacccagaaagtctcgtccaagtcgtaccaggaatcttctccggggagacgcgacggtttccaatcctcgtcgtctcgtctcaaagcacgtcccaaactggcttgaggagtcaacggtggttctgtgggtcgggtgtagcgcgagtgttttcccttcatgagcgattcatcctccttgcctttaggctttttggtctttttgtgtatcatctggccgccggcctccataaccaccgtggccaagtccagtcccagagcttgagcgtcggcgcggcgtcgggcgtcttgcaggtagtcttccacatttgcacagatggccgggtgtttggtggctagggtgaggacctcagcctcgccgcgacccggacgtagcaaaaaagccaactgcccgtgcggctcgcgcgcccacagcgcggcgcgcgggtgcaggtgcagcgcgtcccagcgcggccgctcccactgctcgcggtccagctcgggcagcagccgccgcgcggcctcggcggcgggcgccgactcgcgtcccagcgccagcgcgcccagcacgcccgcgcgcagaaagtgcgacagctccgccgccagcgggtacacgtgcccgtccagcgggcagtacccgaacacggcgcccagctcgtccagcagcaccaccagcatggcgcgcggcacggtccccgacgccgccggacccgccatcgctgtcgaacccaccatcaccgtcggcgccgctgctgctgccgcgtccgccccgaccaccgcgtgcgcgtccgcgttaggcacgcaaatcgcgcccccgccggcggcgccgtacggctgcggaggcacaggtacagcggaccccacggctcccgctatcgcgcacggcgcgtccccgccggcggcctccgtctccgtgccgctcgccgctggcggcgacgtcgtccccgccgccgtccccgtcgccggccccgccgcgcagcccagccaccgcgcgggcagcaccgcgcccagcgccagccagccgcagcacagacgctggttcaggtgccgacgcacggccgtcagcagcgacgcggggtgcggcgccgacgcgaacggctcgtactgcgccagctcctgccacgcgcccagcagtaccatcggctgcagtcgcctgcccggcgtctgcagcgccaccgtcgtgccggcccaccgccggcgcagctcccgtccgagcgccgtcgcctcctcggcgcgcagcaacgtctgtcggagcgccggctgaggcagcagcgtcgcgcgcggggtgcccacgcccagccggttgcagcggtacagccgcaccacctcgcccgcgccgtgccgaaaccactcgtccgcgtcgcgcgccgctaggatcagcgtgttgtttgccaggtcgtacacgaacacgcggaacccggcgcccagcgccaggtacagtccgtcctgcgcgcacagaccctcgggatggccggccttgtcgcccaacgtcgggtcggctgcggggtccacctcgtgcaccacggtagccaccagtacgatccacgcgtcccgcggcgacagttgacgcaggtccgtcgcgcccacgccgttcatctggctgcgcggcgtcacccgcgcgtagaatccgtacggccgtccgagcggcagcagcgtgcccgcgtcgcgctgcgaccacttgcgcatggcgcggcccgtgctgttggccaaaaacgccgcgcgccacacggcgcccatggcctggtattccagctccgtcagcgcctggcgctccaccggaatctgagacagcaacaggcgctccgggccgtgccaaaagttgctattgttgccgctactcggaggggcgcccggcggcccgcggggttctacccggtggacgccgtggcccggcgtcgtcgtagccgcagcactcgcaccagtgcccgctgtggacggcgctcccatcggcacacaagaagaaggaggagaggaaccaacccccgaaggccctccggccccgcggccgcgaccaaggggcggggggcgcggcgacatgccgttgcgctgggccatgggcgccggacacctccgacgtccactatataggaagcaaacccgcgtcagcgagcacgcggtttagacacgcggacgccttcgtcgcccgtgtgccgcgggcgacacgcagctggcttttataggcagcgacgtgcacggcgcgtgctggcgccgccttggcgccacgcagtctggaaggccgtggactgggaaaggcagctacccgaaggaagacgcgcggcaggcgcgtaccactggagcgcacagccgcctcccgggcgcgcacccatctaggtggacgcccgacatccattccgggccgcgtggtgggtcctcgaggggcgggggggtgtttttagcgggggggtgaaacttggagttgcgtgtgtggacggcgactagttgcgtgtggtgcggaggacggcgacggcgaataaaagcgacgtgcggcgcgcacggcgaaaagaagacgcgtgtctgtgtctgtgtgattccccggggaaaagaggaagttcccgggggacggcagcatgggtccctggggacacacgaaaagcaacgcccgggggcgagggacgacggccctggggaccgcgggggaaataacggccgcgaggccacacactcgttcctgcgaagccgcacaccccgaggccgcgcacaccgccgacacaccccgccaccacaccccgccggcacacccgccacacgcccgcgacacacccggcacgacacacccggcacacgcccgcgacacaccctgacacaccctgccaacacacccccgacacacccaacacacgcccgcgacacacccggcacacacccacccggccgcgccccgacacacccaaaacaccgccggtgcggggccgcgtggtgggtcctcgaggg

SEQ ID NO: 3 - DNA, 235645 bp, Human cytomegalovirus
ccattccgggccgtgtgctgggtccccgaggggcgggggggtgttttctgcgggggggtgaaatttggagttgcgtgtgtggacggcgacggcgactagttgcgtgtgctgcggtgggtacggcgacggcgaataaaagcgacgtgcggcgcgcacggcgaaaagcagacgcgcgtctgtgtctgtttgagtccccaggggacggcagcgcgggtccttggggacacacgcaaaacaacggccagacaagacgcgggcgcaagggaggagtcgcgggccccggggcacactgcacaacccgcgtcgaggacacacgcagacacggcccgccaacacaccccgacacacccctgacacaccccgccgacacacccggcacacgcccgcgacacacccggccaacacaccccgacacacccggcacacgcccgcgacacacccggccaacacaccccgacacacccggcacacgcccgcgacacacccgcggcacaccctgacacacccgccacacccggcacacacccaccccgccgcgcccccgacacaccccgaccgccgccggtgcgggacagggctaagcgcctttatggcgccgcaagcgctccgccgcttctgcggcttgctgtccacggcgctttctgcgcgctgccggtgcgtgtggctccacagcacttgtcgttccgccagtccgacactggacagggctgagggagtgttgcgtgacataagtaagcgcgtcggcgtcctcagcgcgtttgcggcgtgctgtgtccggcgctttgtgcgcactgccgttgcgtggcgtcccgcggtgttttttttcgcggaccagcgccggggacggggtgttgcgggcgctcgggggttggcggcgggtgtttctacggtgtttgtgcggcgtttctacgcagcttttgcgcagcgcttcgcttttcggggcggcgacggcgttgttttcgggcgtgctgggcgccggcgccggtaacgggagttacgctggggacagggacgggggttgcgccggggacggggggtgtgcggggacggggggtgtgcggggacggggggtgtgcggggacggggggtgtgcggggacggggcgtcgcgggatggcgggctgttgcgtgccggggacgggggactcttgcggcggggacggtggtgaggacggggacaggggcatttcgcggcggggacggggagttgcgggatggcgagctgttgcgtggcggggacgggggactcttgcggcggggacggggacgggggcctttcgcggcggacacggggaacacagacggcacgcacacgcagctcgcctatttaacctccacccactacaacacacacatgccgcacaatcatgccagccacagacacaaacagcacccacaccacgccgcttcacccagaggaccaacacacgttacccttacaccacagcaccacacaacctcatgtccaaacttcggacaaacacgccgacaaacaacaccgcacgcagatggagctcgacgccgcggactacgctgcttgcgcacaggcccgccaacacctctacggtcaaacacaaccccaactacacgcataccccaacgccaacccacaggaaagcgctcattttcgcacagagaatcaacatcaactcacaaatctacttcacaacataggcgagggcgcagcgctcggctaccccgtcccccgcgcggaaatccgccgcggcggtggcgactgggccgacagcgcaagcgacttcgacgccgactgctggtgcatgtggggacgcttcggaaccatgggccgccaacctgtcgtcaccttactgttggcgcgccaacgcgacggcctcgctgactggaacgtcgtacgctgccgcggaacaggctttcgcgcacacgattccgaggacggcgtctctgtctggcgtcagcacctggtttttttactcggaggccacggccgccgtgtacagttagaacgaccatccgcgggagaagcccaagctcgaggcctattgccacgcatccggatcacccccatctccacatctccacgcccaaaaccaccccagcccaccacatccaccgcatcgcacccacatgctacggctcggccagatcacacgctctttcctgtcccttctacaccctcagccacggttcacaatccccgaaactacgccgtccaacttcacgccgaaacgacccgcacatggcgctgggcacgacgcggtgaacgtggcgcgtggatgccggccgagacatttacgtgtcccaaggataaacgtccctggtagacggggtagggagatctaccagcccagggatcgcgtctttcgccgccacgctgcttcaccgatatccaataaacccatcccctcgccacgacgtctccgcgtatctttgtagcctcaggaatccgtccccacgtccacccatcccgagcactccacacgctataacagaccacgaacacggcaaaaaatgcatgcaaacttctcatttattgtgtctactactctgtgttgctacagggagtgaagggggtgaaggcaaagaaaaaaaaaaggaacaaaataatagattagcagaaggaataatccgtgcgaccgagcttgtgcttcttttcttataaggaggcaaatatactagggaaaacataagaataggaagaaaccgaggtttgggagaaaagctgagataaaatagcgcattttccatacagaggttgttgtttttgtggatcctaagaggtttcaagtgcgaatctcaaagttctcacgagaatattgtcttcaagaatcgacaactgtggtccaagatttttttttggtctttttaggttctgcgagggacatcacgatggatcgttgcgatgaagtcacgcgtacgcctctggtgtggcgcggtgtcgtgacaggagagtgtgttttcagtgcagagctgtcttgattcctatatccgagtatctgttttctcgtaaggacggtaatcttctttggtgtaagtacatctaaaagctgcaaactatattttaagggctgtctctaggtgtactttgatgctggagtttttcgctgtgttgatgtgaataaatctactactactattatatgcagaaagagtgattatgccgagacaagattgcattggctgaactgtttcaaaaacgcctacactctacttatccgtaaacctaaggtaatactatgtgtaagttgtttttttttctttttgtagtaaaatggtgatacgtgcaattaaaactgtattccatgtttccatcctttcatttcaactttaaaggcggctttgagagcgaagaagtgcgaggataaaaatggatgactccttcgtgtccagggagtcgactactgcaacgctgattgattaaaagatggtctccgatgatgatgttgttattgatcgaatcatggtgcagaacggcgacggagaggagcgtgtccgccgccgggaaggtggtctctttctcttttcttttttcaagaaatcttccatgtgtttatcgtagtgatcgaaatcgactgatctcgggttctttttgttggtttcttttcggttaatcatgtattgttttctttttttacagaaagatacttttttcatgagcaattcctcgcccggcgccggcatgccgaggtggggccactgcgatcagcggcatgccgacgccgacccggggatcttggattcaccgttttctctcttctctctctacatacagaccgggtggcaggagcggtaaggaatcatcgtcgtctttcattcttcgatgattatggtaatactaaatcttatctaggagcatatacatctaagattggagtactagtagtcgtttgtggtttctattttttttttatatttatctatgacagtttttctgtttttcgttttgataataatataataaaaactcatggacgtgaaatctggcttggttgtggtgatttcattctcattattgttgttttctttccgtcttgcggatgaagatgttgcgatgcggttgttgttggtgttgctatacaccgagagagatgatctttttgttcttctggttcatttcctatgattgtttggctgctgaccgacgcgtcaggatgtgcagggcatgcggggaatcaggaccggacacgggataatttcatctacctatacggagatcgcggtcctcgccatgaggatcgcgacaggcgcgtcgagggggcaggaacacccttgcggattgacattcttggtggtatttcgttgttgtcggtagttgttgttgacgatgaggataaataaaaatgaccttgtttttgttctgttttctcttgttgggaatcgtcgactttgaattcttcgagttatcggaaagctgaggtacccaaatgtctgtagcttttttctttttaccctcttgtttatcatctgcgattcgtggtaggtaggagagggaaatgataatccgagattaaggaaaggagaagataaaaaataaaaaaaaaaataaaacagaagccgaccggccgccgacccgttccccaggaccagcctacgaggaacggataacgcggtggcgacggcagcggtggtggcgctgggggtggcggtagtggtactgctgatggtagtcgggacggaggagagacgatgcatacatacacgcgtgcatgctgcatgggtggatggtccgaccgggagacgcggaagagaaactcacataaaaaggtgacaaaaagagcggttgaaaaaagaaaacgagattcgaccagacagaagagaaggaccggggcttggcgacccttccacgactgctgttgtcatctcggctcctccgtcttctcccggccacgggcggctaagtcaccgccgttctccccatccgtccgagcgccgaccgaccagccggccgattcgcccgccggggcttctggagaacgccggagcagcagcgatctggggaagccgctaaacccctgcgtttttatatggtagctctgccgagcgcgggctgacgcgttgagtaagcggaaagacgtgtgtgacgaaaaggggtcccatggtatttcacgtgacgatgaggagatgcggtttggagcacatacggtttaaaaaaagggagttgtcgtgacaagggctgagggacctctgtctccatgtgtgtataaaaagcaaggcacgttcataatgtaaaaaagaacacgttgtaaacaagctattgctgtatcattcggctgactatgcttcattcggactgattttcttttcctaacggcgtaacttaaagtgattaacgtatgatatttgttccccagagttatactatagtcatcatcctaaaattcagatataaatgaacacacgtcgtatgggattattaagaaaccgaaactctccacagttcaccatcttcttcgtcattcaaccgatgacccactccgtacaacgaatcagtctgctgcgtcatattgcaaagcacaagcgacgtatgcgaacaacttgaaacacaggctgttgtattgatgaccgttgtaccattattagtcacatcgtatagagactctccaccgtcatcccatgtttcccacccgatggaaaaccgtcttctatcatcaactgtggtaagatttcgaccctgcgaggtattcagtttcctcatatccataacctggattttatcattaaaccccaatattaaatacttttttagtaccccccacccaccaaaaaatgtgactggaccggttcctagcagctctgggagccatgttcaggttgaaccacagctacagcgaaaccgagtccagtgaccggtaaccacgtccagcccctgcgtatgtaccagtccaagcacgtccggtcattgttctacacaggaaatctaactaggtcaacgcaattttattccaccgttacgcagaatactaacaaaaaaacacacaaatttaacgaattacacgtagtttattacatgaaaactgtaagaacaccaattcactaagcgatacaacatttagctgacttccaagtgccacacatcaccactgtattcatccatgttttcaccgaaccaacgagacagatcgaagaagccagaatctcccgactttaaattacataaatccaacgtattatgaccacagctcgacacacaaatagttgcgttaccattcacagtagcattacctatacccgtaacgttgcacaaccactgatcaccattgttaccaaaaacggttttccacttagttgtcaacggatctttcctatgcgtaatggtaaaattactcccagtcgtcgcttttagctcattacgagtattatccgcatccacatatatcaacgtcatagctaggcacgctataagtaccccccccccacaatggaatgttgccaaaccggttctttcccgttatagccatagcgttcccaggcaaaagcaaacgccaaacctaatgcagtgaaaagcgcttgcagccagaaccagcttatgtaccagccacaatcacatccggttattgtttccacaggaaatcctaccaggcaaagccccgcttgttgtgttcctgaccatcttgtttagcaattcgtaaactgtcagcctagcgacgtccgtttagatcaaaagtcacgtatatagcgacgctgtttccacccgtttccccgtcccgccgtttccgaacaacccacccgggttcagacaaccgaccaccaacagaaatatacacacagaccaccgggagttcagttaaagatttcatcaggtttattttggctgctgctagtcttttgcttcttagaaaaaaaatacccatatagagaaataatgatagtttgacaacacatatggcagggatttcttcttcatcaataagatatgcaattcccccagggagagactttcaacaattgaatttacaaaaacaaaattacatcaggagaaagagaggatacattaataaatatattatatctggtgtatatactgaatgctgctggttcataaggtaacgatgctactttttttaattccaagatggtttttctttgttagtcttttgttgacttgctggttcctaaaagttcgcaaaaacgattgtgtgaagattttatgacgttggttgactagttcatgagattctgctgtacgtgtgatggttattcgctggttcgttctaagatgagtatcgtactgtgtctgcgatggtcgtctcttactggcattctctcggctgcctcttgctttcatgattgaaaaggaaaaaaggactccgagggcgcggtcatcttttacttttcggttttctcgttggcgggtcagaggtagtcagatcatgagactgtcgtggtcgatgaaactgtgtctgctcaagtgacgtccatttcttgtacggagaaaaaagtcatcgggataaataaggctatacaaggcgttgtcaagcgtgcggctctaaacaaattaagcgatacaaaattacagtaatacgaataataaattacccccctccccctgtggtcccccgagacgagagccacccatcgtgtactctcgcaccacccacgaccacagagggagacgggacgaagagacgacgcacagcgccatctcctcctggaggccggcgacgttaactgctacagctgcggcggcgaagacagctgcgatttgtcggccgacatgccgatggtatgggcggcggcggcagtggccgcggcagcggggaggagaggagagagaagaggagcggggcgtccgaaggcgaggatggcatggtctcgccggagcgcccggcttttatggaacactcgcgtccggttgggtatcacccacaggaagatgagtcacaacttccaaaccatcttgagacccgagtaacggtttacaggtcgcacgccagtctcagctaaaaacagcggacagtcccacgctgtttctgttgtggctctctccagtttcctcatcaccgtcccggtctccgtcgtcatcggaagaataccacccgctctcatgcggcagtcgatcggcctcgacgaacgagacgcggcgacgcctctccacggccgactggttgtggtggtgaaagaagagcaccagcaatcccaggaggagcaacaagccctcacatgtccaggaggtcggggagagggcctgtcggagatggccgtgaggcatcacgtacggcagctgaggagaaacggagaagaaaggaaaattaccgtcaggggccggggttcttattagagaaacagcacgtaggtcaggatccagatgctaatggcgatcatgatgacgatgatcatgcaggccaagacgcggcgcaccaatgccgaatccaagagccgccgtgccgccggttggtggctggcggcatctagagacatggtttgggggggaccggcggcgcgaaaagacagggagatggacagtgacacggtgttttgttatgattaggacatgggaaccggaagccgagacagagtactacagagtgttgaagggtaacgtgagggagatcatgtcatgggcgggctgaagaccgtgcgggaaggattgacgtgtgcggtgcttgtggaacacggtgttttaatatgtatccgcgtgtaatgcacgcggtgtgctttttagcactcggtttgataagctacgtggccgtttgcgccgaaaacacggttaccaccaactgtctcgtgaaagcagaaaatacccacctgacatgtaagtgcaatccgaataccacatctaataccaacaatggcagcaagtgccacgcgatgtgcaaatgcagggtcacagaacccattaccatgctaggcgcatactcggcctggggcgcgggctcgttcgtggccacgctgatagtcctgctggtggtcttcttcgtaatttacgcgcgcgaggaggagaaaaacaacacgggcaccgaggtagatcaatgtctggcctatcggagcctgacacgcaaaaagctggaacaacacgcggctaaaaagcagaacatctacgaacggattccataccggccctccagacagaacgacaactccccgttgatcgaaccgacgggcacagacgacgaagaggacgaggacgacgacgtctgataaggaaggcgagaacgtcttttgcaccatgcagacctacagcacccccctcacgcttatcatagtcacgtcgctgtttttgttcacaactcagggaagttcatcgaacgccgtcgaaccaaccaaaaaacccctaaagctcgccaactaccgcgccacctgcgaggaccgtacacgtactctggttaccaggcttaacactagccatcacagcgtagtctggcaacgttatgatatctacagcagatacatgcgtcgtatgccgccactttgcatcattacagacgcctataaagaaaccacgcatcagggtggcgcaactttcacgtgcacgcgccaaaatctcacgctgtacaatcttacggttaaagatacgggagtctacctcctgcaggatcagtataccggcgatgtcgaggctttctacctcatcatccacccacgcagcttctgccgagctttggaaacgcgtcgatgcttttatccgggaccagggagagttgtggttacggattcccaagaggcagaccgagcaattatctcggatttaaaacgccagtggtccggcctctcactccattgcgcctgggtttcgggactgatgatctttgttggtgcactggtcatctgctttctgcggtcgcaacgaatcggggaacaggacgctgaacagctgcggacggacctggatacggaacctctgttgttgacggtggacggagatttggaataaaagatgcgtgttgaccgtcaaaaacgcaacaacttcacgtatcgacaaacggtatatataatcctgaccttctacattgtatataggggcaaatgtaacagcactgataccaataattctacgtctacttcagatagcaccgtctctgatactagtgtgtactctactccaaatcttcccagtacattttttacaactcttgatacatctactggctcacagatatcaaccacctcaaacaccatatccagcactacaaatacattggccgcatcttctataactacgttaaacacctcgactaacactacgtcttatacagcttcaactcttactgctctctccagtacccacacaaattccccaatactctccaacaacgcaacattatacaccacatcgttggataatacgactacagacataacgtccagcgaaagttcgattaacgcgtcaaccattcataacactacgtacagtcctgtaacatcgattgctgttaattgtactgtcgcagctaatgaaacaaacaattcaagttcaaaaaattgccaacaagatattggaacaatacgtgttaaatcaactacattaacggcagaagaaggaaaaaacattacgatacagggcaattcaacatggaactgccccaatgtagtttggtaccgacattacaattggtctacacatggacaccacatttatcccaatagacgttaccaaacgccaacgtatcaacacaagatcttaacatcacatcccatatgtcatcctgacgtctcatcacctgcggcgtaccacgatctatgccgttcgtgtaataagacagaactacgtatatacgatttaaacactacaaattcaggcagatatagtcgacggtgttacaaagagtacaaccacgatggaccacacgaggatgaaaatttcggactaactgtaaatcccagaaacgacactgacaatcataccaccccactatgtcccagatacgtaggaacacaatcagaagaagacgaagacgacgattatacactaagcactatcacaaataataacatgcgcaaaacaagtcaccgtgacatctcacatggcacgcgcactacatgggctcttacactaatctgcatagcctgcatacttctgttttttgttcgacgagccctcaataaaagataccgtccattacgggacgatattagtgaatctagctttgttgtacgatatcatcctgaacatgaagactgacgtttccggacacgcaacacatgaaattaagtaacatatctaccatgaaatacagcaaagatatactaatgtctatccatccaatagcggtaccatgcactggcatcttgcgattacatggacggtaatcatattaacgttttcggaatgttacaaccaaacttgtccgtgcccctgcatttgtgtcaattctacaacagttagcatatccaccagtgaaacaacgtctaaaaacatcactccaactaccacgacaaattccaaaaaaacaacgtcaagtattgctaccactacaccctcgttagtaacgactggcaaagtcgtttctactgcagcgtcgtcaaccataatatctcaaaccaaccgcagtcatacgagtaatgctatcacaaccccgaaaacgcgatttgaatataatatcacgggatatgttggccaagaagtgactctaaacttcactggatcatggaattacattcaatggttccggtacggttctccaggctggctttattcctcggaaccaatatgcaccgttaccagcaattatcatcatactttccctcgtggtgctctttgctttgattgtgacatgacaaaacttctaatttacgatctgacgttaaacgattctggaaagtacgttgtcaagagaacgcgccatgacaatcaatacgaagaagcatgctacagcctcacggtgatttttgccaacacgacatccatagtcaccaacagaacgtgtgatagaaaacgaacagaaaatacagacactactaaccatgaaatcgggaaacatattattgaaactattaagaaagccaacattcctctgggaattcacgctgtatgggcgggtatagtagtatcggtggcactcatagcgctatatatgggcaaccgtcgcagacccaggaaaccgcgttataccagacttcctaaatacgatccagatgagtcttggactaaaacctaatatgcacatcaataaaattttttatctttagtcattaatgtttgggtgtgtttattctgagttaatcacttataagtcgggatatccatagacatttaaaaacatgggtgtacaatgtaacagtaaactgctgctactagccgtactaataacaattatcctatctagcattctggtacaggcaattccacataaacaaaaaacatcctaccagcagctcttgctgcaaagtgaacatgtacaaatacccatcacagtagccgaaggagatacaatttgctttaacgttagtgataacccctgcaacttttctagttactggaatcacaataactgcgaactttgcggttggacaccattttactcggaatatgctggatattccgaaaacaagtcgtgtcacccacgatttacctgtcttcacgatactaaaggtctgaaactacacaacgtaactacaaatgattcaggaatttatacccgaaacgtttattactgtgacattccatgcaacatcagcgatgatcataaacataacgtagaggactttgacaactgtaacaccactataaatagaactcactatattattactgtctcgtcttcacgttattctaaacgcaccaattcccacgtagccactcacgttggttggacagccaccgtggtgataattatctgcgttttaacttacgttaacgttacaacaaccctgaagcacagactacgaactagaaacaacgtcaaccacacaatgtgatcacaaagtaccaacgctaatttatttagggtacatttgtactactttgtgtagttctcaaaaactgtaaggtcccgcttttccactccgtcatgaaggatcgcaataaaatacttctatgtatcatctttatttgcatcatgtgcctcatttgtatttactttaaacgtcattgtattcctactccgtctccggacaaggcggatttccgagtagaatttccttcgttactcccgtgtatcggcgtacagtgcgctgcatagaaagacgcgtgacacataccgtacccctggacggtacagtctatgataacgtaattcaaataaagtacaggttcctagtgacatgttatcataaaacatagatttttctacgtgtttttacaaaagagcgtctcgaagcagcttgagccacactgcggtccaaatgacaagcatgatcaaaaatatgctgcgtagcagtcgaaagccgtactgagcgtgcgaggcgggtaggctgccgaacgacggatatgcgtcgtcatcttcgactataaggatcgtgaccgagtcttcggccatgctaaacgctaccctgtgtggctggtatgtagtgtatccggtttggaattgttctgttccggctcgggggatagtgaggaattctcaagggacaatacgggacccaatgactggatatgagaagggtttttccccgtaagatgatcctggtatcacatgaggtctggatatgtataaatgaggagtgaaataggtaaagggaatcagatgccgccttcgtgatgcagccgctggttctctcggcgaagaaactgtcgtctctactgatttgcaaatacatcccgccttaagcgataagtccataaaacgccgttgtccggatacggtgaaggtgacccggattatagcacgttcctttttttttgtttttgcatcacttatcgccactatcagtgcaatattttgattgtgagactgaaagagtatcgttatgatgcttagaacgtggatatcattaccgatggtactgcttgacgcgtactgtttttgtatttttgtgagttgttcaatcagcacgacgactgctcccgtggaatggaagtctcccgaccgtcagattcctatgaatattacttgcgctaattactcagggaccgtcaacggcaacgttacatttcgaggtcttcagaacaaaacggaagattttttgcactggctgttagggtggggtcataagtccatttgttcattttttccgaaactccaaggcaataaagaacaacattatatgtatggaataacgaatctcacgtataactgtacctatgaccgcctgacgttgctgaatttgacgacggaaaacagcggaaagtattatttcaaacgagaagatgtgaattccaccttttattactcttgttacaacctgaccgtgacctaaacgcatgtaaagttccacagagccgcgtggctgtagctattgtgtttacgttgcttttgaaatgttaagcgtccctacggcgctaacatgtttctaggctactctgactgtgtagatcccggccttgctgtgtatcgtgtatctagatcacgtttaaagctcatgttgtcttttgtgtggttggtcggtttgcgtttccatgattgtgccgcgttcgagtcctgctgttacgacatcaccgaggcggagagtaacaaggctatatcaagggacgaagcagcattcacctccagcgtgagcacccgtacaccgtccctggcgatcgcgcctcctcctgaccgatcgatgctgttgtcgcgagaggaagaactcgttccgtggagtcgtctcatcatcactaagcagttctacggaggcctgattttccacaccacctgggtcaccggcttcgtcctgttaggactcttgacgcttttcgccagcctgtttcgcgtaccgcaatccatctgtcgtttctgcatagaccgtctccgggacatcgcccgtcctctgaaataccgctatcaacgtcttgtcgctaccgtgtagctagttagccagctgtgtgtagttgtattttgcttttgcatatttgttttcagtcagagagtctgaaacggggtgggagggacttttgcgggtagtgcatgctaagatgaacggatgggctggggtgtgcttgataactcactgtttgaatacgcgctcacgcacatatgtagcactcaacatgttagcttttgcccgcacgccccggggcgtgccgagctgcctttttaataaagtctgggtttccagatacgcgctggttctgattttgatggtttgtgcctctgaaagctctacgagctgggccgtgacatccaatggactgcctaactgtagcacggtaactagaacagcgggtcaagacgctgaattgcacggtccggcaccgttaagctgtaatgtgacccagtggggacgttacgagaatggaagcacacccgtattatggtgcactttacggggatcacgcatgcgagtctcattaggacaccgtgtagcgtttggctgttcttggaaaacattttttatttataacgtttctgaaagtagcggtggcacttactatcaaaaaggttacaactgcaccgacaaacatataacactatcttgtttcaacctaacggtggttcctcgagcggttcaaagcacaaccaccgtaatgacacccacgctggttacaaactccacattcagtgtgtcacttgttgcgttgagactgacgacaaattccagcgcgtttggacacgctatttatcaacgacaacagcgtgttgaaaacgggacgttatccaagaacataactaacttggcattcacctatggcagctggggcgttgcgatgctgctgtttgccgccgtgatggtgctcgttgatttgggtttgcctcaatcggcttggcgacgctggcgaagccacgtggacgatgaagaacgtggtttgttaatgtaggaaataaaaggcagtttgagcatgactgtttccaaaccgtaacgtggtaaataaatcatggcttctgacgtgggttctcatcctctgacggttacacgattccgctgcagagtgcattatgtgtacaataaactgttgattttaactttgtttgcccccgtgattctggaatccgtcatctacgtgtccgggccacagggagggaacgttaccctggtatccaacttcacttcaaacatcagcgcacggtggtttcgctgggacggcaacgatagccatctcatttgcttttacaaacgtggagagggtctttctacgccctatgtgggtttaagcctaagttgtgcggctaaccaaatcaccatcttcaacctcacgttgaacgactccggtcgttacggagcagaaggttttacgagaagcggcgaaaatgaaacgttcctgtggtataatttgaccgtgaaacctaaacctttggaaactactccagctagtaacgtaacaaccatcgtcacgacgacatcgacggtgaccgatgcgaaaagtaacgttacagggaacgtcagtttagcaccacaactacgtgccgtcgctggattctcccatcagacgcctttggaaaacaacacgcacctggccttggtaggtgttgttgtgtttttagttctgatagttgtttgtattatggggtggtggaagttgttgtgtagtaaatcagagttatagtaatgtcctttttatcagggagaaggttttgttcccacaatgactagctcgagactatctgcgtcggaaaattatgacggaaattatgaattcacggaaactgccaatacaacgcgtacaaataccagtgactggataacgttaggaagcagtgcatcgctgttgaaaagcacggagactgcagtcaacctcagcaacgcgactacggtcatcccacaacctgtagaatacccggctgggggagtacaatatcaaagagcggcaacgcattattcttggatgctaatcattgtcatcattctcatcatttttattatcatctgtctacgagcacctcgaaaaatctaccatcactggaaagacagtaaacagtacggacaagtgtttatgacagacacggaactgtgacagtgatgtctaagcgtttgcaggtatttccatggataacaattttattttacacatcaaaatcccagtattggaactatatgacaataccatgtacccctacagttggatacggcagtcataatattagcttgcatccgcttaataactcattatttcaagacgatgtttttgaatggtacatagacaaaccaatggttactaacaagttatgtctttatcaaagtaatgaacgcataaaatccaatctagactctccaaatattatgtggcagtgcacagataatcgtacactaattctcatgaacttaaccacaacatacagtagaaactattattttcaatcttttaaatatctcggacaaggagtaccaaaaccgaataacttgtgttataacgttagtgtacactttacccaccaaacacattgccatacaactacatcatccctgtatccacctacatctgtacacgattcattagaaatatcacagtcattcacctcaaccaacttcacacataccgcggtccactacgccgccggtaacgttgaagcacaacacgacactgccacttcacatacaatgtggatcatacccctagttatcgttataacaatcatcgttttaatttgtttcaagttcccccaaaaagcttggaataaattcacacaataccgatacagcggtatgctcgccgccgcttaaagaatcaacgccaaggaaatcaaaacgtaaaaagaatagatatgtacgtttatttttcagctcactgtttgaataccgtaaacataatgacgtacatatacgtggttatacaacaggtgtttgtgttatgcggcaactgattaaccatatcgtgaaccatgatcttttccgatggtccgtcgtgaccgcaatgatattttacagatattccgaaacctgtatggaggtcactgtcagagtaggtgatccagttaccctcggtagtggacatggttatcatccaggacaaaaagtacactggtataaccagtcatgcgtcggcatcggcaacggcgaaaatacgcatcctatctgcacctacgaccctcctaaacctggtagacaaaagacaatgaaaactactccgttgccatcaccattgttgtacgagtgtcacaattccacattaagcattcttcatgtaaacgtctcagatcccagaaactattgcaggcgaaaatgtccaccaaagggtaactgtgagtttcccacatgttttacattatcgctgatttctagaactacgaccagaaaacccgaacaaaaaactacgttgttgcgattaaaaaccacgccaaataaacatacgcagcacaaaagatccacgcggagaacgtcacctaaagattacaatgtaacgggtcttccaaaaggctttgcggactcgtttaccggtaacgtagaggcacatcgaaccaaagatgccgcacacagcgcatggattctcattatcatcatcattatcatagtcgtcattctattcttcttcaagattcctcaaagactccgagagaaatgggacaccaagggatacctttacaaaggaaccgatggcctgcccactacggactaattatcgtgagcggacggatatgttcggtttcaaactcactgtttgaatatagggacagtccctacggaacctgagaacatgtggaaatcacctgtggtagaatgctgttcaggtacattacctttcatcgcgaaaaggtactttacctaacggctgcatgcatctttggtgtctacatcagcctccacgatgcctgcataccggtggtcggcaaaataggtaccaacgttacgttaaacgcggtagatgttcttccccctcgcgatcaagttcgttggtcatacggtccaggtgggcaaggctacatgttatgcattttcactggcacatcaacaacaacatttaacaatacgcgctttaatttttcatgtctaagcaattacagccttctcctcattaacgttaccacgcagtatagcaccacctatcgtactatgacatcactagaccattggcttcaccaacgacataaccatggttctcgatggactttagacacatgttacaatctgacagtgaacgaaaacggtacattccccactaccaccaccaaaaagcccactacgactacgagaacgacaactaccacaacacaaagaacaaccaccacgagaacaaccaccaccgccaagaagacgacgataagcactacccatcataaacaccccagtcccaaaaaatccaccacccctaacagtcacgtagaacatcacgttggttttgaagccacagcagcggaaacaccgttacaaccaagcccacagcaccaacacttggctacacacgccctctgggttttagcggtcgtaatcgttattatcatcattatcattttctactttcgaataccgcaaaagctgtggctgctctggcagcatgacaagcacggcatcgtgctcatcccccaaaccgatctgtaagcaagtcgcgtaggaaatgattgcatgaaatcactgtgaaacgccaactccgtgccagctggcgcggcggacaggcctttgacgtatttgaagccaggcgcgctctcgataccgaaaggatccaagggggctttccaaagccgacgtccctgattcccttcataaagctgttgaccggccctagaaagaccaagagcatgctgtgggcccactgcggtcgcttcttgcgttatcatctgctcccgctgctactgtgtagactgccattcttactcttttttcagcggccgcagtgggcccacggcttggacattgtcgaggaggacgagtggctacgggagatacaaggagcgacgtaccagctgtccatagtacgccaagctatgcagcacgccggattccaagtcagagcggcgtcggttatgacacggcgaaacgccgttgacctggaccgaccgccgctttggtctggatcgctcccgcatttgcccgtctacgatgtgcgttccccgcggccgttgagaccgccgtcatcacagcatcacgccgtatcacccgaactgccgtcgcgaaacgggatacgttggcagtaccaagagctgcagtatctggtggaagaacaacggcggcgaaatcagtcgcgtaatgcgattccgagaccctcgttcccccctccggatccaccatcgcagccggcagaggatgcacgagacgcggacgcagaacgtgccgaatcaccacacactgcagaaagcaccgtcagccacgacgcgagtgacaacgcagtgcggcgacggcacgaaagacggcgctataacgctctgacggtccgcagcagggactcgctgctcctaacgcgaatacgcttctccaaccaacggtgtttcggacgcgggcgtctgagacatcccgcgggaagcggtcccaacaccggcggaccgcgacccggcggtgcgggactccgtcaactacgccaacaactgacggtccgctggcagctgttccgcctacggtgccacggttggacacagcaagtctctagccagatcagaacccgctgggaggaaagcaacgtcgtgagccagacggccacgcgagtacgtacgtggtttgtgcaaagaaccacgttgtggcgtcgcacgtgggttccgggacagaacccggcggccgaagcgcaagaactggcgatcataccgccggcacccacggtgctccggcagaacgaggaaccacgtcaacagcttacgggagaggagacaagaaattcaacgcacactcaacgtgaagaagtggaggacgtttcgagagagggcgcgagagaagggaatgatgggagccgagcaagtggaaacgacgagagaaggaataatgcgggaagatatgatgatgatcatgaggttcaagagccgcaggtcacttatccagcgggacaaggagaactgaataggaggtcacaggaggagaacgaggaaggtggaccgtgtgaatcgccgccaatgacgacaaatacgctgaccgtggcctgtccgccccgcgaacccccgcatcgtgccctgtttcgtctatgcttaggactgtgggtctcgagctacctggttcgacggcccatgacgatttagaatacaccgagccattcctttatttccccccatccccggtcgcttatgcgtgtcaaacactaccaataaagataatctgccaatcgcaccttatatataatatgtggtcgcgtgtggtctttttaaggagctctgaaacacagacaggtatggggggtggccggctgccgccgctgtggctgccgctgctgatcgcctggagcgagtggggcaactgctgtctcgatgcgcctccggtggtgcgttcgccctgtctgcagccggtgcgcgaccgcaaccgcgagcggaacccgggctcaccgcagttgctgccttacggcgaccgtctggaggtggcctgcatcttccccgcgcacgactggccagaggtctctatccgagtccacctctgctactggcccgagatcgtgcgttcgctggtggtggacgcacgcagcggtcaggtgttacacaacgacgccagctgttacatcgccggcgggcgctggcgtttcgaggacggcggcgcggcgcagcggctgagcctctcgtttcgtctcatcaccgagaccgcgggcacctacacctgcgtgctgggcaacgagacccacagcctggcgaccgagaccacggcgctggtggccgacgtgcacgacctgcgccactcggaccgctcctgcgacctggctttcggatcgcgctcacagacgcggtacctgtggacgcccgatccctccaggttgcgcagtataaactgcggttgggagggtgaacggcaccgcgtagtccactacatccccggcacctcgggtctgctgccctcgtgcgaggaggacgagcgcgaactgtgcgtgcccttcatcagccagagcatcgcggacaacaactgcagccgccggcatcgggtagacggcgctaggcggcgctatcatctgcggagggattactggctgacggatccgaagatcgggctgctggccgcgggatcggtggccctgacctccctctgccacctgctgtgctactggtgttccgaatcgtaccggcgtctgaacaccgaagaggaaaacgaggcggcggaggaaactgccgcgggagaagcctctgcggtagcggcggcggccgtctctgaggaagagcagcagcgggagtaaacgaggagagccatgaagcggatgattcgcagtcacggcaggaaaacggagtgtcagatgacgggcgccggcgagcgacgcggctccgccgtcggtgcgctcatctgcggcagcggtacccgacgcggcagcggcgccaacgaacgccgcgactccgacgtcggtcccatcgcccacagtagcggtaccagacgcggttcggcgaatgaaacgtccgcctgtacgcggaccgatcaccagaaggcggacattgggctgtggttcatgtttctggtttttggactgtgttcgtggttggcgatgcggtatcgcgcacaataaattttgaatcgatgtcaaggaacgcgtgttttgtattttattgggaatattggcggggacaaaccggtttcggatgtttacccttaatcttaccggggacctcgttgtcctctcctccttcttcctcggacacggggcttcatgctgacgtaggtaccgactggggtcaaaagcctgggtacttatggggagcgcgcacaaaggaccgtcaggcgccggcatggagcgtcgccgaggtacggtaccgctgggatgggtgttttttgttctttgcttatctgcctcttccccgtgtgctgttgatctgggtagcaagtcctccaactcgacctgccgcttgaatgtgactgagttggcctcgatccatcctggggaaacgtggacgttacacgggatgtgtatttctatctgctactacgagaatgtgaccgaggacgagataatcggcgtggcttttacttggcagcataacgagtctgtggttgacctgtggttgtaccagaacgacacggtgatccgcaatttcagcgacatcaccactaacatcttgcaagacggactgaaaatgcgaaccgtccctgtgactaaactgtacaccagccgcatggtcactaatcttaccgtgggccgctatgactgtttacgctgcgagaacggtacgatgaaaataatcgagcgcctctacgtccgattgggctcgctatatccgagaccgcccggatccgggctcgccaaacacccctccgtaagcgccgacgaggaactgtccgcgaccttggcgagagacatcgtgttggtctcagccatcactctgttcttcttcttgttggccctacggatcccccagcgactgtgtcagcggctgcgcattcgcctgccgcatcgataccagcggttacgcaccgaggactgaacggataaccgcaaaggccacgtgcaacgttcacgctgctataagaaggccatgtcccccgtggacgggtctctttgacacgagcgcggcacgccgttgccacgagcatggatcacgcgctcttcacacacttcgtcggccgaccccgtcactgtcggttggaaatgttgattctggacgaacaggtgtctaagagatcctgggacaccacggtttaccacaggcgccgcaaacatctacctcgacgtcgcgctccgtgcggcccccagaggcccgccgagattcccaaaagaagaaaaaaggcggccgtccttctattttggcacgatttgtgctggctgtttcgacgacttttctttcctcgggaggactcagagccactgatgtcggatccggcacggtctcccgaagaggaggagtaaacaacacacggctaagaggatacatcatcaaagaagataggaggggtcaaaacgcggactgaaagtatataacgccgatcatgttcgaggaactgttaataaaacgccatgatgacaatgtggtgtctgacgttgtttgtgctgtggatgttgagagtggtgggaatgcacgtgttgcgttacgggtacacggggattttcgatgatacatcgcatatgacgttgaccgttgtggggatttttgacgggcaacacttttttacctatcacgttaattccagcgataaagcgtcaagtcgggccaacggtaccatttcttggatggctaacgtctcggcggcctaccccacctacctggacggggaaagagccaaaggtgaccttatttttaaccaaaccgagcaaaacctgttagagctggaaattgcgttgggttaccggtcacagagcgtgctgacgtggacgcacgagtgtaataccacggaaaacggtagttttgtagccggttacgagggatttgggtgggacggggaaactttaatggagctcaaggataacctgacactatggacgggccccaattacgaaattagttggttgaagcaaaacaaaacgtacatcgacggtaaaattaaaaacatcagcgagggggatactacaatacaaaggaactatctcaagggtaattgcactcaatggtccgtcatttatagcgggtttcaaacccccgtcacccacccagtggtaaagggcggtgtccgaaaccagaatgacaacagagctgaagcattctgtacatcttacgggttctttccaggggaaattaatattacttttatccattacggtaataaggcgcccgatgatagcgagcctcaatgcaatccgctacttcccaccttcgatgggactttccatcagggatgttacgtagccatcttttgcaatcaaaactacacctgccgcgttacacacggtaattggacggtggaaatccccatcagcgttacctcacctgacgacagttcctcgggggaggtccctgatcacccgacagctaacaaacgctataacaccatgaccatcagcagtgtcctcctagccctgcttttatgcgctttgctattcgcgttcctgcactactttaccaccttgaaacaatacctacgtaacctggcctttgcgtggcgctatcgcaaggtccggtcgtcatgaccagcaacgccctgtatgagctgtttcgacgtcggttaccgcgtgcccccgtcaacacggtcatgtttctcacgcgacgcactcgtgatgggttctgcggtcggttgacgtccatcgccacgaattcccactacactatgttcgtgttagatcacggatccgtgcgcatcgagcgaccgagtcagtcagaagtggattgcgccagtttaatggaaacgctgaagcggattcggttacgaaattcgtgggtagcgtcagaagacgagctagatgtgagtcgcagggacgcgtgacacgaaacgcgttcaggattaacgtaggttttcgaaataacctacgtccgtgagtgacgcggtttcgtgttgaaacccgcgcccgcttctcacggcggtttatgatgaaaccggcgttgcggatccacgcgggttcctcattcaacctgcgaaaagaggaagttgcggtaaaaccacgtcaataaagacgtcaatgacacctcaatgttgcgttggaacggtctttatatatacaaacgccgttatgatcagtgtccggcaagatgctcgggatacgggctatgctggtgatgctggattactactggatacagttgataacgaacaatggcactcgaagcaacaataccgataccatctttgtatctctccttaccgggcccaacggagttactcgcacagccatcggaggtctgtattcaaactacaccaacttaactggagcatttggcttcacttcaacaaatatgtcagcaaccaactcttccgctgaggataattggagcgtaaccaacctgacggagagttgcatcaaccgcggtgagtcctatgtgactaccatctggcttctggactgcactaaaaacgatacttattggtactatggaaatgcctacaatcatacatgtgaaggtacaatttcgggatatctcctgggcatgtgcaagctatggaaaagttgggtcaataatattacttcttataacactgtcagagtcgaatcgctgggaaatgaaacacggtgcatgctgctccctagacagtatactctcaacgccacggtggaatggtacaacaaatctgaaggtgacgtaccagaagaattcatggactatgttatcctgacccccttggctgtgcttacatgcggactgcaggaagcttatatactcgacaaaggtcgtagatacatgtatttgttttccgtgtcctgcgtgggaatcacaggtaccgtatctattatactcgtctccctatcgctgctcatcctcatctgttactatcgctgtggccggcttctgatatgcccacgcggctttgaactcttgccagaattcactgaggaagaggaggaaaaagaaaaattgttaacgcataatgacattgaagtccaagtgcctattcgcacgcggcgactactcgtcccttggatccgggagagcaaaatgtgggtactaccacccccgttgcctccacgacctccccacttaatagaattcccgccgtctcctccgccatcgcctgggcccatgcacatggtggtctgcatgccagcatgacgaactttggactctgagccccaagcggtacgaactacatattttccataaatctacactgaacttgagcacaaagatactgacaatagactggatatacagacttttatatgatccctgtacagatgtaaataaaatgcttttatttaaaactggtcccaatgttcttcgggaatcatggggtggggacgggggacgcggtagggagcaaaaccgggtacatgggggggaacatcgtccagcagtagcaccagcggattgggtaggggttgctgcggaggtcggtcgatgacgatgtcgatctccatcggcagatccggcaacatctcttcatctccctcaccgaccagcactcggcgctgttctggatgtatatgattctggaaaagcctccgacgagctcgcggcgcgtagaaagccaagcggcgcaagggccggcgagcccgaaagtccatgcgcacagatggcatgagtccttgagtgacggtggtgagctggggaacagggctacctcccatcgcgacggtgacagtggatccatgagagaggcgccgcacgctgcatggctaaataccgtgaatcccctgacgtcgtctttcgtcccgaacgcgtcatgttgggggcgaggcgtaaaccgtcgaggttgaaaaaccgcgtatctgcgacccgtccggactacgttgttttttagaagcggccacatgacctcgagatgtcgtcacccaaggtatttaacggcacacagccagacgcgttcgtcagcagcgacgccgacaagacctcagcatggctcggaggctatggatcttgagcttactagccgtgaccttgacggtggctttggcggcaccttctcagaaatcgaagcgcaggtaaacggaatctggggaattcaacacaggtaagaaatacaaaaaaataacgtgattgtgaacgcggttatcgtgttttgcagcgtgacggtggaacaacccagtaccagcactaactccgatggtaataccacccccagcaagaacgtaactctcagtcagggggggtccaccaccgacggagatgaagattactccgggggagactatgacgttttgattacggatacagatggaggtaaccatcagcaaccacaagagaagaccgacgaacacaagggagaacacaccaaagaaaatgaaaagacccagtagcagcagcagatcccaagggttaaagaccatgttgactattttgttttttattaaaaagctgtaaggttttgctctaaaaacaccccgcctccggtcttttttcttttgtattcggcacgcgaaacacggtttcttcccatagcctgtctaactagccttcccgtgagagtttatgaacatgtatctcaccagaatgctagtttgtagaggctatgcgggatgctgcggcggcgcgaccttccctctccacccagccccgtcaaaacacacgcgactcgagcggttcgtatgaaaaataaaaaacagctttttatttacaggaacggggaaaaaaaaaggcacacggtccgtgggagacgcgggttcacgcgtcgtcaaaaagttggtggtccactccgtaaggacaggtaggcttatttagcttccgcatgctcctggttccgtaataaatgccgttttcgtggcagcgtgtcatgccgcgagtcacaaactccatcaaactgtcggccacgatgcaaacgtgctgattgttggcagcaaagacgcgcatacagtcgtccacgaagaggttgatcacgtcgtaggggctcaccaaccagcctaaaggttccacgtggttactgccgaccatgaccctccagtcgttaatctcgctccagtcgtacagccgaatcgtggagacgcgaatgacgctgtaatcacccatgaccatgagtcggccgcgatacgtagcacgccactgcgcgaacgcgtggatgtgcatgcagccggccagcgctctaagcgaggcggtgtgcggcagctcctctgggacggtgatgaagttgcagcgtcgcaaaccgatgttgagaaattcagtgatgctctcggccacaaaggtcaacgagtcagagtagatgtggtcggtccataggtacatggcgcccgaggcgcccaggtacagttcagacggcacgttgtgatcgcccttgtgtttaagaaagttgtaggtgcagatgctgccgacgaaacgcagcggctcggggcagcagaggtagctggccagacgctgtgcatcccgtccttcgtcgcgcaccaagcgccagcgacgccggataacgaggcagcggtctttgggccagaccagggccacgcgttgcccgggtttccacggtcgcgacgtcttaggaggcctccagcggtcgagcagattgagaaaacagtccttgattaccgacatcgcggtcgcgcgtcggtggacaaaaagaaatcgggccgatccggaaaaaaaaaacgacggcaaaacaccgccgtgctcgagcgaagggtggcggagggccagaagaggcggccttgacggcgttggcagcgaaaaaattggcacgcgagtcaaacgggaagtagcgtcggtgttttatgccccaagcagcgtcgtcgtcactcgtggcgtcacagtcaacggtgctgacgtcctttggggcagtcgggcacgcgatcgtagatgccgttgtggccgctgaaacgtcggttttcaaacagcaggttaagtcccagacacatgaacgtgttgagattatctcccacccggatgtagcggtcgtcgcgcacgtcgcaggcgtagacggccccggtataggcgacgacgatggggataaggtcgacgggccagcgcaagtgaggaaagggcgcgttctcgcccttgaggctgacggttcccaggccgagaacgcgcattccgaaagcggttttgatgttgcgcagcaagtgaccgccttccacgctgttttcgaaacacctgaggttgcatagacgcagttccgttcccggcgggtacgtcaacggcatgaactgcccgtggtggcggatgatgaatcgcgccatggtatccaaaccgaggctccaggcgcgcaacagcgggcgaaagtagcgcttaaccaacgacgaggtcaggtagcgcatgcagtgcagggtctcgacggcgcgcagcccgacgcgcgcaaactccatgaggttgcgggccaggtagtagacggcggtgtcctcgcgtacatagcaaaaaacatagccctcgtccgagatgaggcacacagcggtcttcttctgctgatccggcgacaacacgccctcgttcacgaagcgacccacgaaggccaggcgcgtctggcaacacaggtagtgactccaagccttcacgtcctccggtttgaagtcctcgtccgtctcgatctcctgcagcactaggttccagcccggcggccagaccacgggcaacacctggcctgcgttgatgcgcacgtaagcttccagacagcccaggccgaactcggccgtgagcgccaggctagccagatcgctcatgtgacgcgccgagtcagtgggcgagcccgggggcccgtcgcacaccacgctccgtcttcttgtcctcaccgcggccagcgtggcgaggacactttccgcgcccgaggctgtatcttcggtttgcccgccggagccggccctcactatataacgtcccgcccgggtctcctccatgtatgcaggtaagcaactgagccgaacgcacctcagcagacgagaggatgtcgtcgcggcgtcgcagctcgtcacgtcgctctggcgaaccctcgacggtgatttatatcccctcgagcaacgaggacacgccggcggatgaggaggcggaggacagcgttttcacgagcacgcgggcgcgcagcgccacggaagatctggatcgcatggaggccggtttgtcgccctacagcgtctcctcggacgctccgtcgtccttcgagctcgtgcgcgagaccggcggcaccggcgccgccaagaaaccgagcgaaaagaaacgatcgtcgtcgcgtcggcaaccgcagatcgcagcgggcgcgcctcggggctcgccggcgacacccaaggccggcaagtcgcctaaagtctcgcgaccgcctagtgtgccctcgctgcccgagaacggcgccggcggcggtggcgacgataacagcagcagcggcggtagcagcagtcgcaccaccagtaacagtagcagaagtaccagtcccgtggcgccaggtgagccgtccgctgccgagggcgatgagttttccttctgcgacagcgacatcgaagactttgagcgcgaatgttaccgggtcagcgtggccgacaatctgggcttcgagcccagcgtggtcgcgccgcagcacgtcgagtatctcaaattcgtgctgcaagactttgacgtgcagcacctccgccgcctcaacgaatgcatacccatgccggccttcgcgctcaccagcctcgtcgaccccgtcttaaacaacgtagcgcctggcgagcgcgatctcacgcgtcggataatcacgcacgcggtgatcatcaactattactacgtggcgcaaaagaaagcgcgccacatggtggaggccatacggaccaccgtgcggggcgacacggtacgccgggtagccgcgcaggtcaacaaccagagccgttcggggcgtgcggccgcgctagcgcttcactttctcacgtcacgaaaaggagtgacggacggccagtacgccacgtctctgcggcggctggacgaagagctgcggcatcgcggcacgcccgaatcgccgcggctcaccgaggtctaccagacgctacgcgattacaacgtgctcttctataccgcccactacacctcgcgcggcgcgctctatctctatcggcaaaacctgcagcggctcaacgagaaccaccggggcatgctccggctgctttcggtcgaagagatatgtgaagagcacacgctcaacgatctggcgttcctagtaggcgtcgagcttatgatcacgcactttcaacgcaccattcgcgtgctgcgctgctatctccagcaccagctgcagagcatctcggagctgtgttacctcatctatgtacaactgccgtcgttgcgcgaagactacgcgcagcttagtgacgtgatctactgggccgtcagtcaaaactacgactacgcgctctacgcgagcacgccggcgttgtttgactttttacgcgtcgtgcgtcagcaggacgccttcatttgcaccgactacgtgtactgcgccctgcgtctgctggcctgtcccgacagacctattatcggtgacaccggcggcagcagtagctcccaacgcctcgtaggcgagtttatggtgcgcgatccgctgttgcgcgacccgcgcgccacccacctgcgccagaaactcatcacccgcgacatatgcgtggcgcggttgcaagcgcagccctcgagtcgacacattccggtcgaacacacgggtgtctcctccgtcaccctgctcaaaatctttagccaggtcccccccgacgaacgcgaagaagacacgttacgcgagatggctcttaaagcgtttatggaagcgaacggtaatcaccccgaacaaatctgccgatccccaccacccccgctgccaccgcgcgactatcctcaacgcgacgagcgggaccgtcaccgtcgcgaccgccgcgacagcggggaatactgttgctgatggtgggacgaaacagcagggcggaacagtttatgatagaaagtcacaggaaagtatgtgttgtttttttttttaatgtaccaagaataaaaagtgcgtctacgaccaaagcggtgtgtggacgctcgtcctctgtcttctccggttttttttttatgtgtgtgtttttcttttccttcctattttgttacggcaacagcgctgatggcacgttgccggcttcgaacatcgcgtcggtgatttcttgcttgcccggcgtcacacggtgacgcagcagcgcgcggctcacgtagcaggccgactcacggatgacctggccgtcggcgtcgcgtcgcaggcccgagcggttgccgtgacgcagtctgccctgcgcagcgcgctccacgtcttcaaagtagctgtgtagcaggccgcgctccagcaactgcggcagcgagtcggcggcgcgcaccacaaagttctcacggctgatctcgtagcacagcacgctgccgtcggccgccacgccggccacgctgcggtcccaactgaaaaggttggcgagtccgatggtgccgatgacgcgcaactgaccctgggtcaccaccagcagcttccagtattctacgtcgcgcggggtgaggatggtctcctccacgtcgcagacaaacaacgtgtagccgcgcggatagggcagatccaggtggcgaccgcgctggcggcgcataaaatcgtctaaattcaaaccgccgtcgggtgcgcgcctgctcgtcatcgccgcgcctcgtcggtcgatgaccccacggtgcttataacgcgccgccgcggcttcatgtggcgtgacctccgacctcgtgaggccgaaaacggcgtacatgaagacgctcaaacttttgaatgtgggcccggtagcgcaccgagggccccggggcggcgacgacggcgggtccgagttccagcggggccttgcggcggcagcggttggcgtggttgctcagctcggcgtccgagagcgccgagctgaactgcggcagccgcgtgcgatcctgcggcgcgtccccgtgtcgcagcgagtgccagagtaggcgctggacgcgcaccgcctcgggcgtcggcggcgcgcgacagccccggcgcagcttgaaaacgtgcaggcacagcagctcgcgcttgatgcgcagcgacacgctgcggtagtcgggaatccgctgcaccagctcgagaaagtcgcagaaggtctccacgaacgtgtcctcggtgaagcgaatgcgcttcagatcgtggacgtgtttgcgaaaccgcgacagttctcgacgttgcacggggttctgagcgagtcccttgcgcagcagcgcagcctcgcctttaaacagcctgatgagccgctgcacgtccccgctcaacatacgtatacacgccgtgtactcgtgacgtatactggcgcgcagcagccgaatgatacgcagggccagcacggcgttggaggccaggtacatggcgtagccgcgacgcgggttggcacaggcccagcccgcggggagcagaaagtagtcgtcgaccagcgtctgcgaccagtcggcgaagcccaggtcacgtgatacgctgtcctggacgcgggccacgtcgccggctgtgaggtggcggatcgccggcaggtgaaacgcgcccaggtgtcgattgcgctccagcctcagctcggcgtgctccaaacgggaatggtgggacgccaccgcggagggcgacaaagaggagtggtcgccgccgccgtagttaccgttgtgattaccgccgtcgtcgcgcccgtcgccgcactcgcaaaaggccgcgtagaggtccttcaacgccgcttcggctcgcgccataaacgtggcgtggaaaaaaacggcggcgcggtgcgtccggtacttgacgggcaacccgcggcacagggccgccggcaggcagcggccgatgagttcgcgctcctcgggctccagaaacaggcacagggtgccgtccaggcgcaggtacagctcctcggtcatcgagcatagctgccgcaagtaatgggtgcgcgtcccaaaggtcttgtaatcgagcaacgtgcacaccacgtattgccccgtggccacggccagagcgatgcgtttggcggcgcgactgatctctggcaagtactgcgcctcgtgcaccagacggcggaaagcgccggcgttgagccagcgaaaatgctgcggatcgggcggcaagggcacgcctcgaagcgcggcccagacagcgaggtccgactcgagcgtcagaccgcggatgtcgtacttgccgtgcgccgtagcgcaggctgaatggaccagacagctgcggcgaatgtacaccatggcgtgcttgggatgtttgggcgccggcgttttccttttctgaccgccggcggccgccagatcctcgggcgtgcgacacaacaggccggcgcgcacagcctcctgtcgattacgaatcggcgtcaggtaggcgcgcaggaactggtgacaaaactcctcatcatcacgacagtcgtcgagatactcgtacgtggtgagcggatcgcgaaataggcgctcgtcaccgtcgtcatggtcttctttagcctgctcctccggctgctgggttagcggtggaggtggcggctgatccacggggttcatgactgagaggaagaagaaggtggcggcgaagcgacgcggagcgacggcggtaaagccagacagcggctatatagctagtcatcacagtctcctccttcacgacgcccccgtgccgctcacgctatccagcacgctacgacccgaaaacacgtactcgctgacgtcgtacgcgggcgatgtatggctgctcaccggtttcgcggcaacggttgcgctcgagtccaacggcgagaagcaaaaacgccgtgggcaacgaaaccagaaggagccctgacggataaaaccgcgcagcgtctcggccaacttaaccagcatcgtaccgtacagcagtacgtgaatgccgccatgcgcgtccataaatacggctttgttcacgggttccatccatccgatgactacaaaatgggcctgttctagcacgccgatcacgaaattgttggcctcgtcggcctcggccacgttccacgagccgaaagtgaaagtacaagcgggcgagccgcccaggcggatcttgctaccggcgtggagctgacatacgcgcagcagattggcgcggtcgtgcagtatctgggagagttcgtacatgcccgcaaaggtgtgcttaaaccacgcgccctctacgatctcatccacgtagtcgcgctcaaagaagctgtacacggcaaagaggccgttctcaaaaaactcgccgaacgagagccccagcacgtacaccttgtcctcgccgggcaggtacgcaaaggcgtgcccgtgcccggagacccagatctcgggcgccgtgtttgcgtccggcacgcattcgtacacactgacgaggccgataaagtacaagcggccagcctggcgcaggcacgagaagcgccggtaggtcttgtgatcgcgcaccaccccaaagtactgagtgtcgcccagcatgatgccgtgcagcggcggccagcacagcgggagccaacgacccgccgtggcgcgcacgtagcgctgcaggtgaaccccgctcgcacgctcgcgcggcttcgggcgcttgtgggtccaggcatcacgcagaccgcgccagatgctgctgaacttgggctgcccgcgcagatagagcgacgagagcgagtcaaagtagcccacgacgagcctgtcgggagacacaagagcgcgaaaatcaaacctagagcgacgacggtgaaaaaaccgaccagaagcgcgtgtctcaaacacgctactttcggttataaaaacaccgtcgccctatttctgggcgcgtgtacactgatgactcacctacgctttttgaacggcagtctcagctcgggattggcctcgtacagcgagctgcggtccacggggccgatgctctcgtagcgaaagtcgtcgatgagcagcgccagccccacgcgcacgaagcccctgaggtcgcgcgacagccgcaccaacttatcctgccccaccagcgccgcgtacacggtgcccgtgtcgccgcagagaatccgcacgcggtgaaagaaggtcttgtcctcggcgccctcaatttcgcccagcggcatgacgggctcgcgcgtgtacaacgaacgttgaaagcggcgcagcatcgaggccgagagccccagatcgcgcgccgtgcgcagcactagggaatgcttctcgggccagatgagggtcagttgcgcctcgcggtgcgcctctacgtaggcgcaacgagcggcggtgtcctcgcaggccagcaactcgcggaaagccagcagcgaacgtaggtagcggccgcgagcggaggcgcgcgagcggcggcacagctcggcccgatggtcgggatgcaccaagggcacgttaggttgcagacgcgcgcagatggattcgtgcaccgggtcgcagcggatcatgcccttggcaaaaaatccggccagatccgaggccaactcgtacaggcagtcctcttgcgcgtcgtaggcgaacacggcgccgtacgcgtccacgaacacctggtaccggcaggtggcgtgcgagaccgtgccaatgagatgcagagctcggaattcgccgaaaaagtcgttctggcagtgctccagatcgatctcagtcagcgagtgcggcgaatgctcgcccccgaccacgtagatgcactgcgagggccagcccagcgacacgcacgagccctcgaagcgccgcaagtaacgccgcaggccctcatagtcgcgtcgcacgcacaggtcggccaagtcgcgcgtgcaaaagacctcgggtaccaagcagcgtttgcgacgcggccgacgcgcgtgcccaggcagaggaaggcgcgacggcggcgacgacgaggaggaagacgccgtggccgccgagcagcccttgcgacggccggacatgccggcagtccgcgacgatccacaggagacaaaaaagcagaagcagtagtagtctcggcgacccgctccaccccgtcctccacacgctcagccgcgactgagcgccggggcgcgccgctacttgggtttttatagccatctgccccccgtctcgggcacccgggagcgatctacggagacctgacagcagttgggcaacacaagacagggaaatacaaagacacttttaataaaaaacgagactactttgtgtgtgtgctccgtaaactgtttattctccccctccgtctcgctctggatgggctccgggtccgtcaacacgcgacccgcgcggcaaaaggcacgctgttgacggcgcgagagcccgtcgtgatagtccatcatgccccggagatcgtgcacaaagcagctgtcgccgcgtagaaaccgacgcagcgtctccacgtgctgcagctgtcggcgcgtatcaggagccgtcatcgccgatgtcgtcatcgccctgacaggcgcgtagatggctccgcgagatcatgcgcgttttcaaccgccgtgacacatcaggtccatcttgagctggcgccgggcctcgcgcaggtctcgcacgcgttgtgagcgggaggcgagttcggcttcttgctcgaactcctgctgctcactgtccgagagggtgcgataaaaggcggcaaagtcctccaagtcggctacatgcgccctgggtctgacgctccaaagcgtacgcagtctgatgaagcggacccatcgagcgtcacggcacgccgtcttgaacgcagggcccgggaagagattcttctccccggcgcgctcgggccggcgaggccgacgcggtttatatacaccgtctcggacggcgggacgccgagcccgcgccgcggccgctcatccggagacggcggaaaccgcggcgccggaggaaacggggaccggcaacgacggcggtggcggcgaccagattatgggggacaagcccacgcttgtgaccctgttgaccgtcgccgtgtcgtcgccgccaccgtcgtcgccgctgccgctcgtcagcttcacggagctgctgttaccgccgccgtccgtcgccgccgctgcggtggcggcaacagcgacgagcgaggtgggcgagaaaaccgcggagcaagaggtagcggctgcgggtccggagaccaggaatgagagaagagaaaacagggaggacgaaggaggggagacgaggacgacgggcaccaccgcggtcaaaaggtcgcacgacggtatccctcgccaactggcagagcgcctgcggctgtgccgccacatggaccccgagcaggactatcgtctgccggcgcaggacgtggtgacctcgtggatcgaagcgctacgcgacgcggaccgcgacaactacggccgctgcgtgcgccacgccaagattcaccgttcggcctcgcacctgacggcctacgagtcgtacttggtgtccatcaccgagcagtacaacacggcctcgaacgtgacggagaaagcttcgtacgtgcagggctgcatctttctctcgtttcccgtcatttacaacaacacgcagggctgcggctacaagtacgactggtccaacgtggtgacgcccaaggcggcgtacgccgagctcttctttctgctctgctccaccagcgagagctccgtggtgctgcaaccgctcatcaccaagggcgggctctgctcgtccatggcggtttacgacgaggaaaccatgcggcagtcgcaggcggtgcagatcggttttctgcacacacaactggtcatggtgcccttcgtgccgcacgcctgcccgcattacgccgtgcctttcacgacgccgggaaagccgggctgcggcggtgctccgagcggcgttgcggggttggaggagacggcgccctttggacgggtcagcgtcacgcggcatggcgcgacgctgctgtgtcgcgtggaccatctgacctggatcagtaaacgcgtaaccacgtacggacacaaaaaaattacgcgctacctcgcgcagttccgcggcacgatggacgacgacgaggcggcgctacccggcgaggacgaggcgtggatcgcgtccaaaaacgtacagtacgaattcatgggtctcattttcaccgtcaacgtggattcactatgcgtggacgcggaacagcgccaactgctgggcaccgtggccacctccttctgtcaccgcgtctcggacaagatcacggcgcgcaacatgccgcgcgccttttccttctacctgctgacgagcgcgcagcgcgggtacgacctgcgatttagccgcaacccgtcactcttttttagcggcgacgcgctcaactgtccgcttctcaacgagcccaacgtgttttcgctcacggtgcacgcgccttacgatatccacttcggagtgcaaccgcggcagacggtggagttggacttgcgctacgtgcagatcacagaccggtgtttcttggtggccaacttgccacacgaggacgccttttacacggggctcagcgtgtggcgcggcggcgagccgctcaaagtcacgctgtggacgcgcacgcgttccatcgtgatcccgcagggcacccccatcgccacgttgtatcaaatcaccgagggcgacggtaacgtgtactcgtacaatcaccacacggtgtttcggcagatgcacgccgccggagcaaccacgttctttctgggcgacatgcaattgcccgcggacaactttctcacgtctccccatccctgaccctccgtccgtcctcctttcccgacacgtcactatccgatgatttcattaaaaagtacgtctgcgtgtgtgtttcttaactattcctccgtgttcttaatcttctcgatcttttggaggatgttctgcacggcgtccgacggcgttttggcgccccccatgccggcagaacccggttgcggccccgtaccgctcttctggggcgacgataagtcgaaagccaccgttttcatgcccgtcgtgctcttgacgggggaacctacggcggcgatccccgtcgagcggcgtgattgcaaagccgcgctcgcccccggtttcaggatggagggggaggccacaggcggcgcattcgatacgctgcttttggccgtagacgacggtgggtaaacggtggttaccgcgggatacgtcggcgtggtcgaggcggcccggctgctgccggacaggcgacccggcgcgctaccgctcacggggaccgagggcggtcgacctaccaccgccttgccgcccaaagtaggtttcaaggaaggaacaccgacgcggctgccccggcctttcaccggagacgggggggcactcttggccggggacggagaggctgacgaaagcatggacagcggcgatgtggcaggggacacgacatcatcctccgtgggcgacaaaacggacgccgaggctgacggctgtcgagccgaagaagcggaagaggttcccgcgccagaagtcacgttccttgatgacgtcgttttagacgaagccggttgaggttgcaacagcgtggcgggtaccgtcgacggcgtgcccgacacctgtttctctagccttccctgaaccggcgtcgacgtcaccgtctgcgctcgggcggacgcgtgcggcgtcgcgactcgcttgcccagcaccggtttctggctcgtggatgtcgtcgtcattggagacgataacttagctttacgtattctggacggcgtcgactgctcgggcgtctgactgggaggcgaaatgacgtcgttgttgtaatcggacgacggtgttgtgtgtcccaggctgacgacggagccggtgtccgaggagtcgtcgtcttcctcctcgctgtcttcgaccggtgactctgcagtttggtcccttaaagcccaaacctcatcagcggcgtcccgagacgctgtttgtgtcaccgcggcgcgtggagtcgacggcctccgaggggtggtggacacggtgttttgagaagccgtggaagtcgtaggcatcctgaagggattgtaagccaggtgaggattcttgagggcccacgcgcgttcgcgcggccagttggcggggttcatatccccgggcaacggcgccgtcggagcccagggcgagttaccgttgaccggggtttgggtacccgcgaaggtaggtgtcggggccggagcgggggccgtggaaggattgacaggcgtcggcgtgaggatggcagcgccggcgccagcaggaacgttaactccggcgccgaacgtcaacgtcggttgctcgaacttgtacgcggtggtgacgggcggtttggcgctcgtctcggtatccgtgatgtccaccagcgtgtcggtgaaacgcggatcttgacggttggggggatagccatccgagctgtcggaatcctcgtcgcccgagaaaagatcccctctggtctccgtgagcggcctcacgtcccacgcgctgtcccgacggacccttcccgggctggccttggtcacctgcggggaaacgagactgaaagccgcgtgacgctgttgttgctgcgggatgttcaagggaccgctggtcggtttctgactgcccgaggataacaggccgctgaaaatgctggaaacaccgccaccactagcggcgcccttgccgctagttcccggtttcttgatgggcgtaaagatgtttttctcgtcatcatcatcgtcgtcgtcgtcctcatcggcactggagccaaagagcctccgggaggcgcccggtttacgtgtcgggggcggcggttgctgctgacgttgctgcaggttctgctgcctctcctcccaagccttcagctgctgtttctcacgctgcaccacctcgtcgtccacccgtttctgccgctcgcgacgcttttcctcttcgtcgtaatagccgacggccgccgaacgggcagcgtgggcttcggcggccggtgccagagaaccatgggcctcgaagcggaacggtttgtgtcccttccagggactggcgatccagctccagccgtccagcggctgcgtggggacatgtttcttgggtaccgacgagaaggctgaaccgccgccgagcgagaggagattggcgtcatcatcaaactccaacgacggcgagcgcgcgcccaaaaaggtgtgcgccgactgcgggaagctgtccacgtagatgtcaaagtcctcgatgagcagctccagcagcgtgtcggccgagtcgccgttttccacggcgtgcttgaggatattgcgacagtagttggaatcaaaggaaaggcacatgcgcagctccttgaccagcagcttgcaacgctcctgaatgcgcgccagacatttgcgctccagctcctcccaagacctgcgcacgttcatgatgagacggcccgtgtacacgagcttgttgacggcgttgaccagcgccgtgttggcgtgccggtccaggttaaggtcgagcggtttcgcacagaacatgttacggcgcacaccctccaggttttcttcaatgcgctgcacctccgtatccttgaggtgcacaaaggcgatgggttccgtctggccgatggctgtgaccagcgtctcgcgcaccgacatcttggccagaatgaccgcgcttacgagcgcgcgctccacgatctcggcatcgtggcgcacgtccgtatcgaattcggtacggtctagcacagccaggtggtcacgcgccttaccacgatcaccgaacgggtaagtgtagccgcgacgcgccacggccgcgcaacgcacctcgaactcctcgagcaccgaggaaaggtcggggttgtggaaacgcagctcgcggtagtatcccaaccaaagcatgagctcgttgaacagcaccgtacgccggtgcaggcgtttttcgccgcattttttcaggatcttggggtgtgcctcgagatccacgtcgggcttttgcgtgagatggcgcagaaagttgaccagggctaccacatcgcgccgctgtagaccgataaactgcaaactcatgctggcttttctccagaacccggaagcgtcgtcgccccggactgcgcccgcggtctgctattcgtccacgatggacaccatcatccacaacaccacggtgagcgccccacctagagggagggggggtagtttaatagcggaggcggatacgcggttttcacccgggcgccgctgacttgtttcttctgttttttactccgtatgctgttccgcccagaaccgcagtaccgatactccgcatgtcaacatcacctgtaacataacggagccgctatccgccatccgtaccacagaagccgtgatcaacacgttcatcattttcgtaggcggcccgctcaatgccatagtgttgatcacgcagctgctcacgaatcgcgtattgggctattcaacccccaccatctacatgaccaacctctattccaccaacttcctcacgctcaccgtactgccatttatcgtgctgagcaaccagtggctactacccgctagcgtggcttcgtgcaaattcttgtcggtgatttactactcgagctgcacagtaggctttgccaccgtagccctgatcgccgccgaccgataccgcgttcttcataagcgtacctacgcgcggcagtcgtaccgctccacctatataattttgctattgacctggtttgccgggctgatcttttccatgcccgcggctgtctacactacagtagtgatacataatggtacaaatggacaaagtagcaatggacacgctacctgcgtattgtacttcatagccgacgaggtgtacacggtactactctcgtggaaagtgctgctgacgctagtgtggggcgccgcgcccgttatcatgatgacgtggttttacgccttcttctactcaaccgtacagcgtgcgtctcaaaaacaaaggagtcgcactttaaccttcgtcagcgtgttactcatctccttcgtggcgctacagacgccttacgtgtccatcatgattttcaacagttacgccacggccgcatggcccatggactgcgaacacctgacactgcgacgcaccattggcacgctgtcacgcctggtaccccacctacactgcctcatcaatcccattctgtacgcgctgctgggtcatgactttctgcagcgcatgcggcagtgtttccgcggccagttgctggaccgccgcgctttcctgagatcgcagcagaatcagcgagctacagcggagacaaatctagcggctggcaacaattcacaatcagttgctacgtcattagacaccagtagcaaaaactgcaatcagcacgccaaacgcagcgtgtctttcaattttcccagcggtacgtggaaaggcggccagaaaaccgcgtccaacgacacatccacaaaaatcccccatcgactctcacaatcgcatcataacctcagcggggtatgagctttcctgttactttattcagaaagcaccagaacccgtcgccatttcccctcatatacggtacacgtccccctgatctgtcatcacggtacacagatttcgcccgactgcggacgccgacggccaatcgcgtggcgtaggagtggcgccccggcttcattataacgccacgtcggagcccctgcgcgccacaacgccgtccggcgcaacttctgtctcggcacggtacgataaaaacgacgtcccccgtcgacgttgttttctccgagcggtgatcgttcccgtccctctcctccctccgcggcccccacggcggcggcctgctcgcacggacctatactattaccgccccaccgccgtcgtcgtcatgaacttcatcatcaccacccgagacttctccaacgacgattcagtcctgcgagccgccgagatgcgtgacaacgtggcaggctcgatttccaaagcgtacaagggcacggtacgcgccgaaggcaagaagaagctgctgctgaagcacttgcccgtgccgcccggcggctgctcgcgccgcaacagcaacctcttcgttttctgcaccgagcgcgactaccgcaagttccaccagggcatcgcacagctcaagcgcgcgccggccgaactggacccccacgagatccagcaagtcacggccagtatccgctgccgcctgcagcccagtctccgcgagccgcccacgccggccgacgagctgcagacggctgtgtcgcgcgtgtgcgcgctcttcaaccagctggttttcacggcccagctgcgccactactgcgagcaccaggacaaggtggtgagctacgcgcgcgacgagttgaccaaacgctgcggcgaaaaatcggcgctgggcgtagaggtgcatcaactggtagccttgctgccacacgagcgccaccgcgaactgtgccacgtcctcatcggcttgttgcaccagacgccgcacatgtgggcgcgctccatccgtctcatcggacacctgcgccactacctgcagaacagcttcctacacctgttgatgaactcaggtttggatatcgcacaagtcttcgacggctgttaccacagcgaggcctaccgcatgctcttccagatcggtcatacggactcggtgtcggcggccctggaactctcacacagcgcggcggccgggccgcccgaggccgatgagaacaacgacgagggagaggaggacgacgacgagctccgtcacagcgacccggcgccgcttcacgattccaagaagccccgcaacgcccgtcgtccccgcacacgcgtgccgcctcacgagcaaaagcccgaagaaaacgaggaggaagaagaggagctgtttccctcctgcaaggcaaccgcagcattcctgcgggcagaaccctccgtctccaacgacgacggcaacggtggcgaacgctgcgacacgctagcgaccgccctgcggcatcgcgccgacgaagaagacggacctctagccagccagacctctgtgcgagtcgccgcgaccccctcaccttcagtcacctcagcccttacccccgtcacgtcccccataaccccgttgtgtatttaacgtcactggagaacaataaagcgttgatttctcaagttccgctctggttttggtttcgttttcaaagggggccccatcatggcccagggatcgcgagccccatcgggcccgccactgcccgttctccccgtggacgactggctcaactttcgggttgacctgtttggagacgagcaccggcgcctgctgctcgagatgttgacccagggctgctccaactttgtggggctgctcaactttggcgtgcccagccccgtatacgcactcgaggccttggtggacttccaggtgcgcaacgcttttatgaaggtgaagcccgtggcccaggagattatccgtatctgcattctcgctaaccactaccgcaacagccgcgacgtattgcgggacctgcgcacgcagctcgacgtgctgtactcggagccgcttaagacgcggctgcttagagggctcatccgactctgccgcgctgcgcaaaccggcgttaagcccgaggacatcagcgtgcacctgggcgccgacgatgtaacattcggcgtgctaaaacgagcgctggtccggctgcaccgggtacgcgacgcgctggggctgcgcgcgtctcccgaggccgaggcgcgctatccgcgcctcaccacctacaacctgctgttccacccaccgcccttcaccacggtcgaggcggtggatctgtgcgccgagaacctgtccgacgtaacacaacgtcgcaaccgaccgttgcgctgcctcacctccatcaaacgcccgggctcacgcaccctggaggacgcgctaaacgacatgtatctgttgttgacactgcgacacttgcagctgcgacacgcgctggagctacaaatgatgcaggactgggtggtggaacgctgcaaccgtctttgcgacgcgctttacttttgttacacgcaagcccccgaaacgcggcagactttcgtcacgctggtgcgtgggctggaacttgcgcggcaacacagcagtccggccttccagccgatgctgtacaatctgttgcaactactgacgcagctgcacgaggccaacgtgtatctctgcccgggatatttacatttcagcgcgtacaagctgctgaaaaagatccaatcggtctcggacgcccgcgagcgcggcgagttcggggacgaggacgaagagcaggagaacgacggcgagccgcgcgaggcccagctcgatctcgaagccgatcccacggcgcgcgaaggcgagctctttttcttctccaagaacctgtacggcaacggcgaggttttccgcgtgcccgagcaacccagccgctacctgcgtcgacgtatgttcgtggaacggcccgaaaccctgcagatcttctataacttccacgaaggcaagatcaccaccgagacgtatcacctccagcgcatctatagcatgatgatcgagggcgcctctcggcagacgggcctgacacccaagcgcttcatggaactcctcgacagagcgcctctgggccaggagtcggaacccgagatcacagaacatcgcgatttatttgccgatgtttttcgccgtcctgtgaccgacgcggcttcttcgtcgtccgcgtcttcgtcgtcgtcctcagcatctccgaattctgtttcgctgccgtctgccaggtcgtcatccacacgaaccaccacgcccgcgtccacgtacacctcggccgggacttcttctaccacgggtctcttactctcctcttcttctttgtcggggtcgcacggcattagctccgcggacctggagcagccgccccggcaacgacgccgcatggtcagcgtgaccctcttttcgccctactcggtagcctacagccaccaccgacgtcaccgaaggcgacgcagcccgccacccgcaccccgagggccggcccacacacgcttccagggacccgacagcatgccgagcactagctacggcagcgacgtcgaagacccgcgggacgatctggccgaaaacctacggcatctctgaacgcggtttttcctctttttctacgtgtctgtctcaggacgagacgtcgatatcaataaaaataccgtcgacgtggttttctaacagcgtggttttctttattgaccagcggagtacacagtttacgagtaaaaaagacagggaaaggttatataaaatgctgtgttatatacaaaaacatgcacatagacagacagaaccaccgtgctcgtcgtcccctccttaatcagttgttcatgtaggcgtgtggcggggtgaggggcggcatgccgttggcggcgccgggaataatgtgccgtcgaccgacgtcgcacaccttgaaacgccgtcggcgcacgcagcggtcgcaggacgggatatcccagaggaagcccatgtaggtctcggggtcctcgtcgtgaaagcggtaagagagttcaaagtggtgcaacgagcccgtccgagctcgcagcttctggcgaacaccctccacgtcatcggtgcacagcgacagtgctgggctgtcacacagggcctgaagctcctgcggccacaggtgcgtagccaggggcgagtccgtcgtcaccagtttgacgcagtgcatcaggttctcggtgatggcgtcgtacaggcgactctcggcctcctcgtgcgtcatcacgtttcgaggcagcgacagctcgtcgtcgtcatcctcgtcaaacatgatcatggggtcaggggtttttttgggatgttgacaggtgggtgtcttttccagacgcacgatggcctcacgccggccgctgaaacggtggtttcggtgtcccttctttcccatgacgcaggtgaacataaccacgtcctcggccagacggtagacggcgtccatggcggggtcgtagccgtagacgacgccgaaagtgtccaccaagacgtactggcgtacgaggaactctttgcgttctggcacctcgtggcccagcgcgcccaacaactggtggtaacaggtgatgcgcggcacggtacggatcatgagctccatggtctggatgctgccgcccgcgcggacgacgctgaaagatgtttccttgaacttcataacctctgtgttgtgggtccagaaggcgaaatgggtgtcgggacactcatcgaaagggtcgtcgatgctgtaggaagcgtagccccgcttggtcacctcggccgacaggctctccacgtcgccgcggtagagcataacggcgttccagtagtcgtcatactgcaccatgggccgctggtagtcgcgcatagtgtggaagtggtcgcagtgacgaaagccatgccgcagaaaatccttcatggtgggcgccagctcgtagatgcagtcgcgcaggtcatcgtagcagtagatgccgccgcgctgcccgatgagcacgatgagttggtagcgcataaagcccggaccctcgacgaagccaaaggggtgcaggtactcctgacagcagacgtaagcacctggtagagaatagaaaaaatccacgcacgttgaaaacacctggaaagaacgtgcccgagcgaacgtcctctttccaggtgtcttcaacgacgtggggcttaccttgcgaacagacggtgcccatcttgcccacgaagggccccagggcgctgcgcgaacggagctggatgaagcagcgttcgggccaggccacgtgcagccgggtgccgcattcctgctccagaaagtcgttgagaccgttgaagtccccggctcggatggcgatgcagccgtaggccatcagcgtgtcccgtaggtcgtccatgacggactcctctaccttcgctcgccgacgctgcgcttctccagccaccgctgcggtcgacagactcctccgtccgccttcggagaactacggcgcggcggcacggcctttatagacactatcagcgttgacgtcagacgatccaatgaacgtcgttttttgtgctggaacttccctcgtcccgacaaatgtagcggaaatcttcaagcaaatcgcgacgaagtccgatgaggaggatgcagaagaggctgagcaacgcgatgctgcccgccgccacagtacatatgctcaacaacgcccagtgtcccaacgcgcgacttttggctcggagcagagccgaacggcggtttttccacatgatggataacgtagtccaatatttccacccctggcattgttgtagtgtccactcgggaagcgacgtcacgttagttcccgtaaaagttgtgtttcttctgttgtttttcgcaagcttaacgctcctcttaagaaaccgcggacacatgtcttgtagaaaaatgtaatcactttccgcatataccgttaagactgacatcacggtgacggtgttgttttccgaagacgtcgcgttgtcggtgacgttggtttcctcccaatttacggatgactcaaacggactcgtgcgcgccagtgcccgtaatacgtaactgcggccggtaaggttaagcgtcagctgtcccatggtaatgttagtgtcatttgtaaaacacgcaacctccccgtagacctcggtgacgttgatatcgcggctctcgttcaggatgcgcaggggaaaccagccttccaggtggtactgaaaaccaaacgtgagcatgacgctgtgccactgccgacgtgattgccgaaacgttacgttcaagggcagtttggattcggctccggcgcaggggccgttgtagatttgcgtatgattgcacgtgcagtttaaccggcagttcatactcgtggcgttggaagtgacgttaatgtccgtaccgtggtacgtacatcgaacagaaacaccgtatcccgtgctccaaaacagcgtcaacaacagccacacagacacctacgtggggacgacacgggactttttattgacggagactcacgtttctgccctcccctttcccgtaggtaaaaacccacgtttatcacacacgttgtttttacctgaaacccgcgcagcccgtggacgcgacaaaaaaccgcggcactagaaagaaaatgaaacaagtatgtttattaagcagcatgtggggctaataggggggataactgaggtatagcaactatgaaaaaatactacaaaaaaaaagctgaacatggtcatctagcagcaaagttctccttctagaccacgaccaccatctgtaccacgtcgccctccccggccgtgtacatcacatccttcaccacgaccggcggcaacggcggcgacgaggacaactcgctctcgacggaggccgggacgacagaggacgggggggtggtggcggcggaggacggaggggtggcggcggcagcggggtcttcttccgacacgggcgacggcaggctcggcggcgcggacagcacccgttgcgccggagcgtgagaaggctgagccccggtggcctggatgtgggccaacgaattggctcgcagcgagtcgcgatccacgaaggtcataggaattttcccttcgcggattcgccgctcagattccaggatggcgcgcacgtagctgttcaccgacttggcaaaagtgcgcggcccctccgtattcttgtcgcgacgcgcttccagcacctgcttttcgtagtccagctggtggaagaccatcaccaggtcgtccatagtgtgcgcgtgctgacggacgtgggagcgcacctccaccgggaacaaagcgttccaatactccagcactatggcaccgtgccagaactgcgccatgctgggcgccaggaaaaacaggataccggagtcgtaggcgaacacgtcccacttgggcgtcatgaacaacaccagctgacgcgtgggccgcaccgaagcttcctcccaggcctcgatgaccccgaacatgatgagctcctggtccaacggggggcagtgtcgctccagccaactgatcttgctcaggttcatctgcagaaactcgtaagaggggtcgcagatgcacacgtagagacccgagtcgtgccgcagcctggctccgcgcttcatcagtttcctcaccgcgtagcgaagcgccaccttgcccaacgccgacgcctggatcagtccccccacgtccatctgcgtctgtcgccactcggcctcgtccagcaggctcatgatagcggcggtgctatgcgtggtcgtagtcatcctttctatccttctctatgaatagcagcaatagcggtaaagtcccttcttatactatcccggagtctgtggtttttttgtttacccctgcttactggtgagactgctgggggccgttgtgctgcagcagccgagctcgtcgccgccgttgccacaggaaccggtgcctccgcagggcctttttgagagcctcgcaggcttctcgcgcaagtcctgagaggccctcggcgtccatggggttcacctcgggcgtccgagcctcgttttcttcttcttcatcctccctttcctcctccgtgtcctcccgctctgtgtcctccgttacgctctcctccccggcctcggccaagagcgcggccaccaagtccacggaccgctcggtctccgagttctcaccgtcaattacgccatgttggcggcgtaaccggtgccgagaacgccgggtgagcgcacatgcttttttctttcttaaccaaggcgggagaggatcttcaaggcgttttcgctggatccagcggtagctaaagtaccaaaaggccagcaggcccacgctacctaacagattcacgtagactggagacataattaaagaaagaagtgaaacccgcgtgtgggtctcacgtcgtcttgaaacaccgtcttatatacatgaagatgccggacatgacgcgcccaagacacgtggggttttccccttaggcgacccggtttcttaagatgtttttcatcttcgcacgcgatgtactacatcaaagggtcggctgaccgaccgcattgacgcacagtttccgagtacgcgcgtctcggagcacctgacggtgaaccacccaactcacgcggataggggacaacactgacgtgaggggcgattcacgtcactgacggctgacgggaataagacgggtgagggatttccacatttttcttaagtgtgactctccttacggtaaatcgcacctgtgacttcttaacccctcctccctggtacccgataacagtgaaaaacacacaccacacgtcacgacaccgatcgattttctttattcttagtgtgatgataggtaagggcactcgtgaggatgtgcagttatcattatcaagccttcttcaaggcgtagtgatgatcgttgggcagaacccccaggctcctagcgatctgggaatagaaggaggagaacgaccccaaggccagaatgcccacagtgtacatggcccaggtctccagaccgaacgtggcgggtcgcagcttcagatggtaggccacccgctccgagagttgtgaatgctcgttcaggcaacaggactgcaggtgggtgagcccaaaagcgctttcgtttacgccgcgcacgtgcaccgtctgggccgggcaatcctggtgttgcgcgcgaaaatggtcctgacaggagattccgtctacgtggcgacgcgtgttgttacccacttcgatcagcaacgtgttatcggcaggatgatgcgagaacgcgacgacggtgttgctggaggtctggcggcagcagtacacgtcgagcgtcatgaggaccatgtcgccttggtggtacacggcgtacgcccaaccctggaacacgagcggacatagcggaccgtgagcggacgtcacgccggcggttgttaccgtcgtctcgacaggagaagacaataaactcctgatcctcatacacaggagtccaaccgtcagaattaaagtccgcggagccataaccgcgcaagtgaagccgatacgagtgttgctgaatttgttcattctgccgactgttgctcacgagcgttcggaggcggtgccacaggctgttggccattaaaaagtcctggcccgaatgacgacgagacagagcccgaggcgaagaaaaaggcgcccgtcatgaagacgtaggcaggggaattcccatatttttatggcttcttttaaaagtctgtatccgactccatccggcgcttttcccaaaccgtggtctcctcgtcgtccgactcggtacccaggaggtggtaagtcttttgccgcacgtagaaagctttcaacgtggagcaaaagatgagaataaagaccccgaaaacgaaacaaaccacgccgatcatgccgatgcagacgttcatgtcgacgtagccggcggtgctgttggcggtgcggcaaaagagtgtcatgtcgtgcgtgcacaaaaaacaacacacaccacaggccaggtcgtagcgtagttattattccgtagcagcaatgatggtacagtcaagcacatgctctatccccgttaccccgatgatgcttgcgtccccgttgttatattggcactgtcccggttaatcaccacggtgaacaccacggccaagaaaatgatccctaatatagcgaccactaagagagcaaaagtccatttccagccgttgtcaaagtacgcccccgtggtgggatgcatggtggcgggcatttccatcatatccatgtcgaacgtgtgtcgcggcgacggcgaactaaccaggcagtacgggggtcgatagggcggtgggctgcagtcgggtggtggcggcggtggcgtggaaaccgtcgtcgggcacagacccatggcctgctcgtaggtggggggcgcgtcgtcgtgatcccggtcgcggagcatcggcgtgggctccatgtcggtggcagtgacggcgacggtggtaactgtggtggagacggtaccgacggcgtccgcggctcaccttcgagcaaagagccccttctttttgcgcaaacgacgacaaaacagttctctgggacagccggtggcgcggtaagcgggtgccacgctttcagggtgggtaaaacagtcgcgggcgaagcagtagttgttgcagaaccgcaagaacccgacgcgaaagaagcccaggagtccgcgcgccagaaagtgcgcctgccgcgtatcgggatgcacgccgaagacggcgccgctctcgttcaccagtatggagatgtccaggcgctgctgcgactccaccggcacggcccgcaccacaaatacctgcagcacgttcagcgagcacgtctcttttaaccagttgccgtgggccggatcctcgtaagtctggctcccgttcaagacgaccgtcgtcagcgcctcgttaccgtctcgccagctgaagatagaaccctcgcgcttcatgcacaggcgccacagggccagcaggtcgcgcgccaacatgaactcgcgacccacgtcgccgccggtctcgaagcggacatagcccagttcttcgcgcagcggcgcgtagttgcgcaggccctcctgcacgaagccgcggaaaccggaccgcgacaccaggtacagcgattccaccacaggcgagtagacgtagacgcgaccgccctcgccgatgagtacgggtagcggtgggcggccgatggcttcgcaacgactcacagtgcccaccggcagcaagaacttgtcgcagcacaggaaggtcttctccaaacctttaatattgagatgtccaaagtagccgacgcgtaacaggtcgcagtaggtgaagaaccaaccgtttggccagctgagacgcagcaccgtgccgctgacgcgacgaaccagcttctgcaagtccttgcgggcgtcggaggtgacagagcagcggaaggtctcgttgaccagctcgacagccagcgcgtcctccagcgtgcgttccttcatctcgtcgttgatgctctggcggcgccgccggatttcgtcgaaacgggccgcggaggcggcgaccgacgcggaggtcgtccgaacgccctctgtgacgctgtcgtccggccagtcaagaaagctaaggctggcgctgcgccgcctaaagtgtccgatccgcgcgggacgtcgctgagggacggtggctggtctgctggggcgggtacggccgcgggtgtccgcggacacgttagttatacacggaattgagtcacgtggcacgttgccagctgaaaccgccgtcgtctccgccggcgttttctccatcgcgggaccgcgccgtgcgcacgttcccaggcacgcggcccacgctctagccgcacttttgcttcttggtgttagggacgaactcgaacgttacagaatcctcgctgtcgctctcctctttcgcgtcgttgaagtaattgccggagttgcgatccaaaccgccgcctcctcctccgccgccgccgcccgatccacctttggacgtcaggtagctggtgatcttgtgctgctcgtatttttccttggaggaaagaccgtggtcgtgatcaccgccgccgccaccgctgctcattttccgcgtaccggaaccaccgccgccaccgcggtcgtgcttcttgccgccaccgccgccacctcctcccagaccgccgagacccatgggctcgttcataatatcgttatccagacccgggccgtcgtcgtgcagaccgccggcattagccagcgaagagaggctgccgctaccaccgccgccgccacgcgatttgccgctgttcccgacgtaatttttgtcgaagggatcgccacgctggaaaggttcctcggtgagaaaattctccacggcgaacagaccgttgcggctggccacgtacaacagcgtgtcgtgctccgtaactatacgcaacgtgcacggcagtttggtgacggcgcaattgagcagcgtctggtagaagttcttcagctgcacgttgatacgcatgtttttcacgccgtggaaactgacgcggttattggctgtgaattccagctcgctgccgttggtcaggataaacttgatggccggtggaccggcgtgcaccagaatctgcacggtgcccgtagggcagggcgcttttttaacgttacgcttgacgcgggtatgcggcccgatccacttaagcaggtcggccaccacgccgaaatctagatccacgtgcacggccgaattctcgctttcgcgcacaatgtcttggccgtgcacgcaggccgagctgaactccatattgaaatcgggcgcgcacatggagatcttggccgacaggtccgagatgtcctgcacgtagaacttggtcaggtccttgctggaagtcaggtacatgaaattacccagcagcggcgtggaattgttaatggtcttgggctgaaacgacttgtcagtgatgtagaggcatgagctgttaaaagtgatttttgacacgcagtgactgcgtaccgtttgcaagataagcgacggcgtgggcaagaaggtaaccgtggtgttctccttgagcgcacggatcacagatcgcagctgctggatagccgtcttgtacggcttcagccgcagcgccagcgtcggcggctccgagaggcgcgtcttgcgatccatcccggacagcgtgcaagtctcgactaaggagcgggcgcgagcgagcgaaagttttatagagagcacacacgacgaccgggaacgctgcgaagacgcccggcgtctaataatacagccgcgccgagccagcgggcccccgactaagaggcacagtacttatatactccgaccttaaagcgccagtggtaccacttgagcatcctggccagaagcacgtcgggcgtcatccccgagtcatagtagaaaaccagggccacgcactggtccacaaacacgctcaggttcacggccgccatttccacgtcgttttggatcgccggtgccgcctggaacagacactgcgtcgccttgccctcctcctggtgctgctccaaccacgcgtaattcaccacgggcacgcgcagcggcctccgcaccacggtggggaagtaacactcacggttgggcgggcacaatgaccacaccgtctcctcctcgaacacggtgccgcgcgaagcccacactgacggcgtcacgccccacagatgcgccacctcgtcgtcgggacccaccgccagaaactgacagttgcgcaatccgaactcgagcatgtcggcgcgcagcgcttcccagcgcgcgctggcgatggagagccgcggcaaccgatacaattcgaaaatgaatttgccctcttgatagatggtgcgttcgaaccactcgcagcgcggcaaacccgacttgcacaaatcgacgctagcgcgcaccgcggcaaagtacatgtgctcaaagatgcgctcgatcaagtcccaagaggcaaagtacgtgaaccctaaccgcatgagcgccgtgtgcaagccagccacgccgatgtgcagcggacgcagtttttccagcgcgctctctacccaccattcggacgccgacattagcgcgtccaagcgcgcgttgccccaaaccaccgcctcggtcaccaactcgcgcagcacgctcaaatcaaagtaacgtcgcgtgttccccaaaaccacgtcgggtagatgcagcttctgctcgtcgctacgcgcaaacacgcagcgagccacgttcaccgtcagccgctgcaccggcatgtcacactcgccaaagtggcacgacgccatatcgggactcaagcacggcggcaggcacacgctgtcggccataatcgagtacttgactacgtgatggacaaagaccaccgaggcacggcccttgagcgcgcacagcaacatctttttcagaaaatcgtccgtgttcacgaccaccttggggcacgattgctcgcagcgcgaatactctttctcgaaagccgactcctgacccaggtccgagagccgccgggagacaggccgcccaaacagcgagtagcgctgctcacgcgcacggtagcgcttcattaacacgctaggcacgttgaaagcgtagcaaacccccgtcaactccgacgtgctttctttgagaataaagttaatcacgcggatagcggccacgtcccacatgtccacaaacacacgtaccacgggtcgatgcacctccttctcgcgtatcaaatcgcagtatccccccaggcaacgaatcacgctgttcacatcggcgttaagtcgcgttacgttcaccgacacagaaacgccgcaactcaaggtactcatccacttgcacatggccgcccaactggcgtcacgcgagaaagggtcggccgagatcagaaagtcgtactgcggcacgcgatcgaaacccacggtagacatggtgaaggtggacagcgacagctgcccatcgcgacagcgcttcaacaccgattccaacacctcgccctcgaaacgcgcatccagatggaaacgatagatgcgcgagtgcctactgttctcgatagcggccgtcaacgccacggcgatgcgcaaaaacacgccgcccgggctctcgtcctgtccgtgcagttggcgacacaccttatccaaacacaaaatggccgcgtacaagccccagcaaccggccaattccacaaaacgcgccgtctcctcggccagcttgggtagatcctccatgtgacgcagcacaaaacggcgcaccgactcatcgcacagctccgaagcgtaacacagtggcgtgcggctttcacgcgcccagttggctttgaaataaaagcgacccaacagcaggtcgcaacgcggcgagtgacgaatcagacagggaccgtggcgcataatgagctgaaatagcctgaaactgcccaaaccggcactgtgccgcgacacggtgtccatctcgcgccacagcgcgttcctgtcggacggcagctcccgcgccggctcctgtacgccgcaaaagcgaaacttgccccagtagccgtgacaatgacactttttgcccatcaacatgcgcatagcttgtatcggcggcgatactttgcagagcgaagccccgaaatcgtcctcctcctcgacactgtccagctccatcctggtcgcgccggccggattaaaggtgctcagaccgctactcacgcgtccaccgcgactgggcacggcgggaccgctgtcacgcgtcaacgacagcacagacggcgtgccgtcgggagacggcgactcgggacgccaactgacgacgccgccaccactcgtaaaacccgctacacatgctacaccgctcgatacgttggtatttccagcggacgcttccttgtcacccccgggcagcggcccctcctcgagctcgctgtcatctcccccgatagtatcagcggcgacctctgccgacgattcctccgtctcggtttccgcgctgcggcttggaatcctacctggccggcaccgatgtgcgggcaccgaggacacccgctgttcctcgtccgcgtcagccggattcataagtttacgaggaaaataacaaagaaatcaggtagatttcaataaagtgagtctagatggcgccgacaactacggtttataaagtctgtgtgcgatgtgtttttttcttctgtgtctcctccccgtatgctgtcagcgccgctcagacgaattctcgaaagtctcccaattcgacgctaaagttgtccaaacggacgacggacagtttgagttctttgtgtaccaggaacgaggtgtgaatgtcgtcagccaggcaccagcccagcttttgtatgaccccggtacacagagggatctggcgcgggcgcgtgatgcgacggttgacaaagctacagcgctcgcgggcgaactttccgcgtgcaacgtcgaccaaggtctgccagtgtgcgatgctggaggtgagcacgtagatgccgggacgtgtttcgggcccgtcatagtcatagacgatgattaaatacacgtattgcagccgtccccgggtctcttcccacgtcaggtacatgtctttcggtatcatcaacgcgaacacctccgttttgagcgtgttgtaaaggtagccgcgcatgacgcaggtgagcaacgaggtgatgcccagcgagacggtcttgacgcagcccagcgtctcgaggcggcggtgcagcagatgcgggcccaggtccagccactgcagcgcggcgcgcgcggccgaggccgtgtacacgctttcgagcaggcagcgcgtgctggccgagacgttggaggcgcgaatgcctaacaggtaaaggctaatgtagaggtgtcgcggcgagtcgcaacccgtctccatgcggatgagcagcgcgcccggctgcgcctcgaactctaccaggccctcgggcacgaagaaacgcgccgtgagcgcctggtgatcggcgtggtagagatagcgaaccgatatagtatttacctcgcgtttggctttgagcgccgtcactagttcattgtcctcgtcggccgggtcgcgcggccgtttggccaccgcgcgcgcgtccatgatggcgaggcgcacggtagatttcaaaaagttgatagagcagctgcgggcacgggccacggacaaagcggaggcgttaaataccgtgagccaattggagatcggcgcggtggatgcccaggacgtgaccgcgagcgccgtgcgcgccttcgtgggtgcgttgccgagctcgggctaccactttggcttcgtgcgtcagaacgtggtcttttacctcctaagccacgccacggtacagacggcgcgcgacccgctgtacgccgccgagcagttgcacgaacagctggaccgcttcctgcgacaccagcacgacggcggcggagacgaggaccggttgccgttctaccacaacggggccacgctgacggctttccagaagctgttgcagaccctgcgcgagatccagaccgtaatagccgaacagagcggcggcaccgcggcggcggcggacttgatcgccagtaacaacgcgtcgaccgagcgccgcggcaagaagggcggttcgagttccgggggccagcagccgctggtccgccgggtgatcacgcagctggaaacggctgccacggaggcgcggccctacgtcaattgtcgcgccgtggccgaactcctggacctgacctaccagcggctcatctactgggcctgcacgctcatgccctacgtgttgtttcggcgcgacaccgacaccgaactggacacggtgcttctgatgcattttttttacacacactaccgttcggttaacggcgatttggccgtggagtttcaaaactacgtcaagaacagcgtgcggcacatgagctctttcgtcagttccgatatcgacggcgaccagaagcccggtgccgaacacatgcgtgacgtcagctacaagctgttcgtgggtaatctgcaagcgcgtgacgccagcggcctcatgtttcccatcattagcacgcgcatctccaccgtgaacctttacctgtcgcccgaacgtatgtttttccacccgggtctgatctcgcgtctgttgagtgaggaagtttcgccgcgcgccaacctagacgcttacgcgcgcgtgtgcgatcgcgtgctggaagaccacttgcatacgccgcgacgcgtgcaacggctactagatctgacgcagatggtaatgcgactggtggaactgggtttcaatcacgatacctgcgcggcctacgcacaaatggcgctgatccagccggccagtcagaagagctcgctctttgtcagcgagattcgcgagaaactcatacagatcatctacaatttttacacgtttttcatgtgcctctatgtgtacagccccacgttcctgttcgaccaccggcggcggttgattttggagcagcatcgatccacgttgatcggctccaaggaggaactacagcacgtctggagcaacgtgacactgaacgtcaatacgcactttgcggttcagtacacggaagaagactttgaggcacatacgaagggtgccacggaggcggagcgcgagtacctgtatcgggacctgcacagcaagtggggcgtgcacctgtttaccttgcgtccgtctcgcggcgcggccggcgcggcctcgcctttgcctccgcttgacggcgtcacacgctccgacatcttacgcgaatgcgcgctcgttaatctgaacgaaggccgcgtcaactacgcctccctgctagccttcagccatcatcccgagttccccagcatcttcgcgcagttggtggtggtaactgagttctcggagatctttggtatcccgcagggcctgtttcaagccgtgggttcgccgcgtcttttcgcactcattcagctgtgccgtgtattgttgcccgagcaggtgacgctgtaccagaacctggtctccatctacaacctgaccaccttcgtcaagcacatcgacgccgcggtttttaagacggtacgcgattgcgtcttcgacatcgccacgactctcgagcacctcagcggtgtacccgtcacgcccaatgtggacctgctggccgagctcatggcgcgctccgtagcgcataacctgtacaccaccgtcaacccgctgatcgaggacgtgatgcgcagcagcgccggcagtctgagaaactatctgcgacatacgcgactctgtttcggtctggcgcgtggccgggcgcgcctctcggaggacggcgtgacggtgtacgtggaggtacaaggtcaatacggactacgcgtacccaccacgcgtttcgtagaacagttgcgcgagctggttcgccgcgatcggctgttggccgagaatctgcgcggcttgaacgagcgcctgctgagtgttcgcgtgcgcgtacgtcagatcagcagcgacacagaggaagtaagccgacacgccaagggtcaccgcacggtggcccagatgagcaaggcgctcaaaaagacggcctccaaaatcaaaatgttggaaacacgcgtgacattggcgctcgagcaggcgcaacgttccaatggcgccgtcgttaccgcggtgcaacgcgcgctagccgtctttgacgtactaagtcgcgagaacttggaacgccgcggcgcacagctctgtctgacggaagcgacgagcctactgcaccgacatcgcgcgctagcgccgatgacctggcccgcgggcacgggcgttgcggcggcggccgaagcggatggcgccttacgcgagttcttggaggcgccctgggaatcggcgccccaaccgccgcgactccgcatgacgcccgacaccgatcacgaagaatcaacggcaggcgcgacgtccgtaccggaggtcctgggtgcgcgctacgaacccgcacacctggccgcgagcgacctattaaactggtacatcgtccccgtaagccaggcgcagcaggacatcttgtcttcgatcgacccgcccgccggctcgacatcggtgtccctgccgccggcctcgccatgaaagtcacacaggccagctgccaccagggcgacatcgctcgctttggagcgcgagcgggcaatcaatgcgtctgcaacggcatcatgttcctacacgccttgcacctgggtggaacgagcgccgtcctgcagaccgaggcgctggacgccatcatggaagagggcgcgcgtctggacgcgcggctagagcgcgagttgcaaaagaagctgcccgccggcgggcggctgccggtctacagactgggcgacgaagtgccgcgccgcctggagtcgcggttcggccggaccgtgcacgcgctctcgcggcccttcaacggcaccaccgagacgtgcgacctggacggctacatgtgtccgggcatcttcgactttctgcggtacgcgcacgccaaaccgcgtcccacctacgtactcgtcaccgtcaactcgttggcgcgcgccgtggtcttcaccgaggaccacatgttggtctttgatccgcacagctccgcggaatgtcacaacgccgccgtgtatcactgcgagggtctccatcaggtgctgatggtgctcacgggcttcggcgtgcagctgtcgcccgctttctactatgaggccctttttctctacatgctggatgtggcgaccgtaccagaggctgagatcgccgcgcgtttggtctccacctatcgcgaccgcgatatcgacctcaccggcgtcgtccgagaaagcgcggacacggcagcgacaacgaccaccgccgcaccttccttacctccgctgcccgaccccatcgtcgacccgggttgccctcctggcgtggcgcccagcattcccgtctacgatccctcgtcctcacccaaaaaaacacccgagaaacgccgcaaggacctcagcggtagcaaacacggaggcaaaaagaaacccccgtccacgacgtccaaaacactggccaccgcctcctcctccccctcagcgatagcggcggcctcttcttcgtccgcggtaccaccgtcctacagctgcggcgaaggggccctgccggccctgggccgctaccaacagctggtcgacgaggtagagcaggagttgaaggctctgacgctgccgccgttgcctgccaacaccagcgcctggacgttgcacgcggcgggtaccgaaagcggcgctaacgcggcaacggccacggcgccgtccttcgacgaagctttcctcaccgatcgtctccagcagctcatcatccatgccgtcaatcagcgctcgtgtctgcgtcgcccctgcggtccgcaatcggcggcgcagcaggcggtacgcgcctatctgggcctatccaagaaactggatgcctttctgctcaactggctgcaccacggcctggatctgcagcgcatgcacgactacctgagccacaagaccaccaaaggcacgtactcgacgctggatcgcgcactgctggagaaaatgcaagtcgtcttcgatccctacggacgtcagcacggcccggcgctcatcgcctgggtggaggagatgctgcgctacgtggaaagcaagcccactaacgaactgtctcaacgactgcaacgtttcgtaaccaagcgaccgatgcccgttagcgacagcttcgtctgcctgcgacccgtagactttcagcgtctgacgcaggtcatcgaacagcgacgtcgggtgttgcaacgtcaacgcgaggaataccacggcgtttacgagcacttggccggcctcatcaccagcatcgacattcacgacctagacgccagcgatctgaaccgacgcgaaattctgaaagcgctgcagccgttggacgacaacgccaagcaggaactctttcgcctgggcaacgccaaaatgctagagttgcagatggacctggaccgtctgagcacgcagctgctgacgcgcgtgcacaatcacatccttaacggctttttgccggtagaggacctgaagcagatggaacgcgtcgtcgagcaggtactgagactcttttacgacctgcgcgacctgaaactgtgtgacggcagctacgaagagggattcgtcgtcatacgcgaacaactgagctacctcatgacgggcactgtgcgcgacaacgtaccgctactgcaagagatcctgcagctgcgacacgcgtaccagcaagccacgcagcaaaacgagggtcgcctcacgcagatccacgacctgcttcatgtcatcgagacgctggtgcgcgacccgggcagccgcggctcggcgctgacactggccttggtacaggagcagctagctcagctggaagcgctaggcggcctgcagctacccgaagtgcagcagcgcctacagaacgcgcaactcgcgctaagccgcctctacgaagaggaagaggaaacgcagcgtttcctcgacggactctcgtacgacgatccgcccaccgaacagaccatcaagcgacacccacaattacgcgagatgttacgtcgcgacgaacagacgcgtctgcgactcatcaacgccgtactgagcatgttccacacattagtgatgcgactggcgcgcgacgagtcgccgcgaccgacgttttttgacgccgtcagtctgttattgcagcaactgccacccgactcgcatgaacgtgaggatctgcgtgccgccaacgccacgtacgcgcagatggtcaagaaactggagcagatcgagaaagccggtaccggcgcatccgaaaaacgcttccaagcgttacgggagttggtttactttttccgtaatcatgaatatttctttcaacatatggttggacgactgggcgtcggacctcaggtaacggaactctacgagcgatatcaacacgagatggaagaacagcacctggaacggctggaacgtgaatggcaagaagaggccggcaagctcacggtaacttctgtggaggacgtgcagcgtgtcttggcccgggcaccgagccatcgtgtcatgcatcaaatgcaacaaacgttaaccaccaagatgcaagactttttagacaaggagaaacgtaaacaggaagaacagcaacggcagctactggacggctaccaaaaaaaggtacagcaggatttgcaacgcgtggtggacgccgttaagggcgagatgctctccaccatcccgcaccaaccactggaggccacactcgagctgctcttgggcctagatcaacgcgcccaaccgctactggacaagttcaaccaggacttgctgtcggcgctgcagcagctgagcaaaaaactagacgggcggatcaacgagtgtctgcacggcgtgctaacgggtgatgtagagcggcgctgtcacccgcaccgagaagcggctatgcaaacccaagcctcgctaaaccacttggaccaaattttgggtccacaactcctgatccatgagacgcagcaggccctgcaacacgccgtccatcaagcgcagttcatcgagaagtgtcaacagggcgatccaactacagccatcacgggtagcgaattcgagagcgactttgcacgctaccgcagcagtcaacagaagatggagggacaattacaagagactagacaacagatgaccgagactagcgagcggctagatcgctcgctgcgccaggatcccgggagcagctccgtcacgcgtgtacccgagaaacctttcaagggtcaggagctggcgggtcggatcacgcccccgcccgccgacttccagcggcccgtcttcaaaacgctgctagatcagcaggccgacgcggcccggaaagcgctcagcgacgaggccgatctgctgaatcagaaagtacagacgcagttgcgacaacgcgacgagcagctgagcacggcgcagaacctgtggactgatctggtcacgcgccacaaaatgagcggcggactggacgtgaccacccccgacgccaaggcgctgatggaaaagccgctggagacacttcgcgagctgttgggcaaagccacgcaacaactgccgtacctgtcggcggagcgcacggtgcgctggatgctggcttttctggaggaagcccttgcgcaaatcaccgcggaccctacgcacccgcatcacggaagcaggacccactaccggaacctgcaacagcaagctgtcgagagcgccgtgacgctagcgcatcaaatcgaacaaaacgcagcctgtgaaaattttattgcacagcatcaagaggcgactgccaacggcgcgtccacgccgcgggtcgacatggtccaggcggtggaagcggtctggcagcgactggaacccggacgcgtagccggcggcgccgcgcgtcatcaaaaagtgcaggaactgttgcagcgcttgggtcagacgctaggcgacctagaactgcaggaaacgttggcgacggaatactttgcgctgttacacggcatccagaccttcagctacgggctggactttcggtcgcagttggaaaagatccgcgatctgcggactcgttttgcggaactggccaagcgatgcggtacacgtctctccaacgagggagccctgcccaacccacggaaaccgcaggcgacgacttcgctgggcgcctttacacgcgggttgaacgcactggaacgacacgtccagctgggtcaccagtatctgctcaacaagctcaacggctcatcgctagtctataggctggaagacattcctagcgtgcttccgccaacacacgagaccgaccccgcgctgatcatgcgcgaccgcctgcgtcgtctatgcttcgcgcgtcaccacgacacctttcttgaagtggtagacgtcttcggcatgcggcaaatcgtcacgcaggccggcgagcccatttacctggtcaccgattacggcaacgtagcctttaagtacttggcgctgcgagacgatggccgacccctggcatggcggcgccgctgtagcggcggaggactcaagaacgtcgtcaccacacgttataaagccatcacggtagccgtggccgtctgtcagacattgcgcactttctggccgcagatctcgcagtacgacctacggccctacctcacgcagcatcagagccacacgcaccccgcggagactcacacgttacataaccttaagctcttttgttatctggtgagcaccgcctggcaccagcgcatcgacacgcagcaggagctgacggccgccgatcgcgtaggcagcggcgaaggtggtgacgtaggggaacagagaccgggccgcggcaccgtgctgcgtctgagtctccaagagttttgtgtactcatagcagctctgtaccccgagtacatctacaccgtcctcaagtacccggtgcagatgtcgctaccctccctcacagctcacctacatcaggatgtaatacacgcggtagtcaataacacacacaaaatgccccccgaccacctccccgaacaggtcaaggctttctgtatcacccccacccaatggcccgccatgcagctcaataaactgttttgggaaaataaactggtgcagcaactgtgccaggtaggcccgcaaaaaagcacaccatccctaggcaagctatggctctacgccatggccacgctggtctttccacaagacatgctgcagtgtctgtggctagaactgaaaccccagtacgccgagacctacgcctcggtgtccgaattggtacagacgttgtttcagattttcacgcaacaatgcgagatggtgaccgaggggtacacgcaaccgcagctccccaccggagagccggtgcttcagatgatccgcgtgcgacgccaagacacaaccaccacagacacaaacacgaccacagagccaggacttttagatgtttttattcaaacagaaaccgccctagactacgcgctgggctcctggcttttcggcatacccgtgtgtctcggcgtgcacgtagccgacctgctgaaaggccaacgtgtattagtagcgcgccacctcgaatacacgtcgcgagaccgcgacttcctccgcatccaacgctcccgggacctcaatctcagtcaactgctccaggacacgtggaccgaaacgccgctggagcactgctggctacaagcccaaatcagacggctacgcgattacctgcgtttccccacccgcttagagtttattcccctagtcatttacaacgcacaggaccacaccgttgtacgcgtgctgcgaccgccctccacgttcgaacaggaccacagtcggctggtgttggacgaggccttccccaccttcccgctgtatgaccaagatgataacacatccgcggacaacgtcgctgcgtctggcgccgctccaacaccgccggtacctttcaaccgcgtaccagtcaatattcagtttctgcgtgaaaacccgccacccatcgcacgagttcagcagccgccgcgccgacatcgtcatcgagcggccgcggccgcagacgacgacggacagatagatcacgcacaagacgatacatcaaggacagccgactctgcattagtctccaccgcctttggcgggtccgtctttcaagaaaaccggctgggagaaacaccactatgtcgagatgaacttgtggccgtggcacccggcgccgccagcaccagtttcgcctcgccgcctatcacggtgctcacgcagaacgtcctcagtgctctagaaatattgcgactagtgcgattggacctgcgacaactggcgcaatccgtacaggacactattcaacacatgcggtttctctatcttttgtaaccgacactgacagtagcgggcaataaaaacaagaggattgttatcgttttttatgatacaaaacaacgtgtcactttcacggtgatttattcttgctattacttttccccatgggctgtcagcgtcgggtgcgcgacacggctatcatgcgcaacaggtccagcttaaaggcgcacttgtcgttaaacagactggacatgcgcgtatacttgctcagcatggtggccagcaccgggtgggtggcctctgagatctcggtcggcaactccaaaacgacgttgacgacgtgacggtgtttttcgtcccgcttgttggccaccgtgggtcccggcgcggtgttagacatggggcaggccgtggggggaggacgaggaggacgtcgctgctaaaccgccgcgcgcctgctgcacaatgtggccgccgacgtggcaggcggtctgtttaaccagcgcgcagcctcgacacagcggggcgccgtcttcgctttccaaacagctgtcgcggtactcgcccgtctgacagcgcgcgcacagcaggccgtgcccgtgcgaagtgagacgcaggagacgcgggaccgtcacgccgcgtaccaccacagtggagtcgcaggtgcgtgccgcgcagggcagaatgacgtcgaaagccagccggtgatcgtacacggcacaagccgcgttgaggcccagcacggctttccagcccacgcgtacgcagcgctgtccaaagagcgtctcggagacgagctcgtagacgcgctgccgcactacccgctgactgccgcagagcgagcagtgtacgagctcggcgtgcgtgttgaagatgacgctcttttcttgacggtcccgataatagaacatcgagttgagcggaaaattttgctggcagtgtagcttttccttacccaggttgaggcagtgtccgcactgccgacagaccacggccaccagcgagcgcgcatccagatggcgctcgcacttgagtcgacacagacaccagagcggcaggtcgatgacgctgccgatgaggccgccgcgcagcgcggcgctgagtgcaaagaggacgatcttggtgggctctacgtgatgcgcctgctgtccggcgcccgcgtgtcctaccgccgcagctgccgccgtcgagcctcctccgcgcgtctcgtcgtgcagacccagtgcccgcaacggcaccaggtatcgcggacacgtgtcgcaaaacgtctgcaccgcttgtcgggccagtacgtagagcgggtttccgcagggtaccttcccggcgtgccgacgcaaggctgcgatgaggccccgcagctgcggcgaccgcggctgccgttggtgacaccactggttacggtggtatacggccaaatcagcgcgggcgtcgaagcgcttggcgcgtagtagtgctaggcacggcgagctggtggggtgaagcacgggcagccgaaggtccaccccgaaaaggaaacggtgaaggtcacctagcagcgagacggtgacaccgtccaacaacgcgtgcagccgctcgggcgggtagagccgcagacggcgcagcaggtagtcggtgtcgtagcgttcgaaacgcagaaaggccatcgtgcggacggccacggtgtgcagacagtccatgctgtagacgtaagcgagaaacacaaagtagggcttggtcataaccatacgctgaaagagcgccgtcaccgcctcccgctcggcctgccgacacaccagccattcgcgcaggaagcgttggtagagacggtcgcccagctcgcgattcagaaagcgcttatccgtcacgaagagatgaaggacgcaagaacgtggcacgtgatgcaccagctgctgctggaggaccgccgacgtctgcgccgcaaactgcgccggtggctgcgacgtttctaccgccgcttcctccggctgcagcgcaccgcggccgatcaccagctgcacatggaaatggtcctcgtgaacgcagaggggcgcgaagagacggcgcagagcctggtggaactcatcagtcgcggtgtgcggagcgtgtcggagacgacgattggccatgaccgcgccacagcagagccagcaccagcagaagagccagcaccagcgggcccagagtcgcaaagcgcgcgggcagccacggcccagactgcggtcgcgatggcccggagcgcgctcgccaccacgatgacggtgcccaacgataaccagtccgctccaaggacggcgtgcacggcggagacggcggatgacggtgatgggtcgacacccctcgccgacgactcacgtgctcctccagaggccgacgcgcggaccctccgatgtcctggcccgccgctgccgctgccgccttcccttctcccgccagagccagcaactcctcctcctcttcatcagcgtctccctcgcttgcgcatccgcatcgtcccatacaggcctcacaacgacacagccgccacgaccccgccgccatgggtggcggcggcggccgaggcccggcagcggcgccgccagcggcgaccatggtgggagagcaactcggatgacgaggaggaggaggagggggagatgcggtccgaggggaccgctttcccgccgttcgcgtgagcgcggccgacatgcgggcgcgccacagagatggaccactgccgctgtgactgcttacggtgacgtggttccggaccgccaacgacgtcgacgcggctttcttggcgtacagctcgcgcagcagattctcgtactcgccctcgttttcgggtccgaaggcgatgagctcgatgttgaacaccgacgccgaattggatttgcgcaccacgcacttcgtcagcactccgtaggccgagggcttgatctcctcgatgtccttgagcgtgacgatgagcgactcgttcaccttaagcacattgaactcacctacgtggcgcgccggcgagacgagcttgacgggcgctcgcacaaaacagcagagggagacggcgcagccagtgtttttaaagataaaacaaggcacgtggtctgtgcggctctcccagtagctgagcagatattcgacacaatagaccgtgtctgtcttgagcatggcgtcgcacaccgagtaattgggatttttacagataaggccggcgtcggtgacgcgcagctcgctaggacccaacttgaggatacgccgcgtggcctgcaccagatcctgatggagaaccttgttcatctccatcgcaccgacgccaccgccgatttatttacccggcgccggctcgtcttttccctccaggattccgttaatgtccatgagcttgctgacgatcgccgttaatagttgcgtcttctcacggaggatctctccgtgactgcaggtcgcgcagtcgccgtgcacgtacttgaggaaggcggcgtacttctgacccgcgttcacgaaatttaagcgcgcgtccagagagggcagcaacagatcgtagacgcgcggcagcatcggctcgaactgtaatagcagatcgtcgtcaagatcgggtagcgcgtgtccgtcttcaccgtcctcgtcgtcaccacctcccccctcgagcccaccgctcgtaccagccgcgggctccgcgtcctcgtcgatcaccagcggtcgcgtcggcaccggagaatccacgtcatcctgcacgtcgttttcctcctctccgtcgtcatcgtccagaaacggcacccgctgcttagcccaggacattctttttccgcgtcctcaatcagcggcgccgatcgccatgaatccgagtacccacgtgagcagtaacggcccaacgactccccctcacgggccccacaccacgtttcttcccccgaccagcccggccccgtccaccagctccgtcgccgccgctaccttgtgcagtccgcaacgacaggccgtttcgcgttacagcggctggagcaccgagtacacccagtggcactcggacttgacaactgagctgctatggcacgcgcacccgcgtcaagtacctatggacgaagcgctggccgccgcggcggccgcctcataccaggtgaatcctcaacaccccgccaaccgttaccgtcactacgaattccagacgctcagcctcggcacctcggaggtagacgaactgctcaactgctgtgcggaagaaaccacgtgcggcggcacgcaatccaccgtactcaccaatgcgaccaacaccactagctgcggcggagccgtcgccggcagtagcaacgcaggacccgccggcgcttcggccgcctgcgacctagatgcagaactggccggcctcgaaacctcggcggccgactttgaacaactgcggcgactgtgcgcgccgctggccatcgacacgcgctgtaacctatgcgccatcatcagcatctgcctcaaacaggactgcgaccagagctggctcctcgagtacagcttgctgtgcttcaaatgcagttacgcgccccgtgcggcgctcagcacgctcatcatcatgtccgagtttacgcatctgctgcagcagcacttttccgatctgcgcatcgacgacctgttccgacaccacgttctcacggtcttcgatttccacctgcactttttcataaatcgttgctttgaaaaacaagtgggcgacgcggttgataacgagaatgtcaccctgaaccatctagccgtggtgcgggccatggtcatgggcgaagacacggtgccttacaacaagcctcggcgccacccgcaacagaagcaaaaaaacaacccttatcacgtcgaagtgccgcaagaactgatcgacaactttctagaacacagctcacctagccgcgaccgcttcgtgcagctgcttttctatatgtgggccggcaccggcgtcatgagcaccacgccactcacggaacttacgcacactaagttcgcgcgactagacgcgttatccacggcctcggaaagagaagacgcaaggatgatgatggaagaagaggaggatgaagaaggaggagaaaaaggaggagacgatccgggccgtcacaacggcggtggcaccagcggggggttcagcgagagcacgctaaaaaagaacgtgggtcccatttacctatgtcccgtacccgccttttttaccaagaaccaaactagtaccgtgtgtctgctgtgcgaactcatggcctgctcctattacgataacgtcgtcctgcgcgagctgtaccgccgcgtcgtctcgtactgtcagaacaatgtgaagatggtggaccgcattcagctggtattggccgacctgttgcgcgaatgcacgtcgccgctcggcgcggcgcacgaggacgtggcgcgctgtggactcgaagcgcccacctcgcccggaggcgactcggactatcacggcctgagcggcgtcgacggcgcactggcgcgacccgacccggtattttgccacgtcctgcgtcaggcgggcgtcacgggcatctacaagcactttttctgcgacccgcagtgcgccggcaacatccgcgtcaccaacgaggccgtgctcttcggacacctgcacccccaccacgtccaggaggtgaaactggccatctgtcacgacaattactatataagtcgacttccgcgacgtgtgtggctctgcatcacactcttcaaggcctttcagattacaaaacgcacctacaaaggcaaagtgcacctggcggactttatgcgcgatttcacgcagctgttggagaattgcgacatcaagctggtggaccccacgtacgtgatagacaagtatgtctagcgtgagcggcgtgcgcacgccgcgcgaacgacgctcggccttgcgctccctgctccgcaagcgccgccaacgcgagctggccagcaaagtggcgtcaacggtgaacggcgctacgtcggccaacaaccacggcgaaccgccgtcgccggccgacgcgcgcccgcgcctcacgctgcacgacctgcacgacatcttccgcgagcaccccgaactagagctcaagtacctcaacatgatgaagatggccatcacgggcaaagagtccatctgcttacccttcaatttccactcgcaccggcagcacacctgcctcgacatctcgccgtacggcaacgagcaggtctcgcgcatcgcctgcacttcgtgcgaggacaaccgcatcctgcccaccgcctccgacgccatggtggccttcatcaatcagacgtccaacatcatgaaaaatagaaacttttattacgggttctgtaagagcagcgagctactcaagctctccaccaaccagccgcccatcttccaaatttattacctgctgcacgccgctaaccacgacatcgtgccctttatgcacgccgagaacggccggttgcacatgcacgtcatcttcgaaaactccgacgtgcacatcccctgcgactgcatcacgcagatgctcacggcggcgcgcgaagactacagcgtcacgctcaacatcgtgcgcgaccacgtcgttatcagcgtgctgtgtcacgccgtctcggccagcagcgtcaagatcgacgtgactattttgcaacgcaagattgacgagatggacattcccaacgacgtgagcgagtcctttgagcgctacaaagagctcattcaggagctgtgtcagtccagcggcaacaacctatacgaggaggccacgtcgtcctacgcaatacggtctcccttaaccgcgtcgccgttgcacgtagtttccaccaacggctgcggcccctcctcctcgtctcagtccacgccgcctcatctccacccgccgtcgcaggcgacgcagccccaccactactctcaccaccagtctcagtctcagcagcatcatcaccgtccccagtcaccaccgccgccgctgtttctcaacagcattcgtgcgccttgacactgtacggcagaaaagccggctccaagtgcaagcgccgcggcagcaccatgtgcaaaaacttgtccttgcgcgcggtttcgccgccgggaaagacgggcgacagcacgttggttacagccttgagaacctgctcaaagtacttgtcggcgtgaatgggcacgccgtgctcgcgcacgtagctcggatcttcggctacctcgtagttgcacacggccgacggtggtttccgcgccctcttctttgccggctctcctcctctcctgttgctctcctctaccccgccgccgtcagcgtcgtcgtccgtgccatcaatcgcgtccgaccgggaaaccacgccggtggttacagaatcaccgttgtcggaggaaccctgcggcgccgcccggacaccgggcgccgtcaggacgtaaaagacccgatccccgaccgagggtagctcctcagaacgggccgccaatcgcttaatgacggcaatgtgcggcaggttagattgacggtacaacgagatgtccttagaaagcaccgacgaaagcaccaggtcctcaacacgcacacggtgcaggtacagatcgtcgcgggcctgcaccaggcggcgcaagatacgccagaaaccgcgtggcacaccgtatttcttaacttcatcgagtgagaggcgcgacaggcgcacggctgcttccgagacctcgcgatcctcaaagagcagcgagaggacgtcacgcgtgacgcccttgacgaactcgcaggccgtcttgcgcaccagatccacgcccttcatgctcagacccgaggcgccctccactttgccgatgtaacgtttcttgcagatcatcataagagagacgaagaccttttcaaactccagcttgacgggctccacaaaaagacaagccgtcacgtagtgcgccaggctgggcccacgcgccaccagagcctgcggcgtcaggccacgaaagcggacaaacacgctgtccgtgtccccgtagatgacccgcgcctccacccgccgttcgtttaagccccctgatgatgtttcgagcccctccggtaacgtgctgctctcctccgaatccccctcccgcgttcctactacatagtcttcctgattaaaaaaattgtgcaaaaaacacggctctgaaaagttgtctttgatgaaccgcgccgtgcgctctagcatgtcgcgaccgatgcgcgtaatgctggcggcgatgggcagacacggcatcatgccgttgaccacgccggtaaaaccgtagaaagcgttgcacgttactttgagcgccatctgttccttgtcgagcagcatacggcgcacggggtcttgacactcgcgcatgcattcgcgcacggcacgccgctgcgaaacccacttgttgagcagttccgaaagcaccgagacgcgcaccgaagcacgcacaaagcggtgtgtcacgccgttctctagcgtgacgctgtatacgtcggcagggtccacggggtactcgccacccggcaccagcagggtggagtagcagaggttgtgagccatgatgatggaagggtagaggctggcaaagtcgaacacggccacggggtcgttgtagtaacccacctcgggctcaaacaccgtggcgccctggtacgaaaccgccgcagtaccaccggcgccgtgattgtcgttggaaacgccgacgccgccactactgccggagccgacgctgaaaacgccgacgctgctactactgttactgccggagccgggtgaaacgccgtcctgactggacggcgcagattgcaagggcggcgacatctgaaacatagccgccacagaacccgcgtcgccgggcacggcggcggtagagatgatagcggcgttaggtgacacggcaacactattcgtttcgggcaccgtcgtacctttgctgtagtggttgggcaggataaaatcgcggcaggcgcactcgtccagcagcgaggtgtagatacggatctgctgtccgtcaaagatgacacgccgcaacggaattttagccagccgcgcgatggccccggcctcgtagtgaaaattaatggtgttgaacagatcgcgcaccaatacggcgtcctgcagacagtaacggcctacctgggcgcggccctcggcattagccacgaaacaacgcgggatgtccttgtaggacaggtcatccttgcgttgccgcaggtaaagctcggccatagtgttgagcttatagttgggcgagttagtcttggccatgcatacggggtacatgtcgataaccaccgaacccgcaatatacaccttggtggcggccgtgctggccggattgttgtgagaagccgagggaaaggcggcggcgtactgccgcttaaaacccacggcggggctgtgtaaaaagaaacggccgccctgcgccgtaggcaacttgcagaagcgctgcgagtccaccttatacaggtactcgaggcgcgtgaggatgtacttcaagtcaaaagagttgatgttgtaaccggtcacaaaggccggcgcgtaccgttgaaagaaaagcataaagcccagcagcagctcgtattcggaagggaactcgtagacgtccacgtctgggcccacctgcccgcaggtgccgatcgtgaagagatgaagacccgagtgcccaaagatcacaccctccgaagtgcagccccggccatcgttcccgtttgggatcccctgatccacggcggtgtttccccccgtctcgtagcacacgcacgagatctgaatgacaatgtcatcggacttctcggcgcagggaaaaccaccctcgccgctcatgcactcgatatcgaaggacaggcatcgatagcgcggccacgagctgtcgtcgggcacggccaccaggtcagagacatcgcagtcgacctcgatatcacaagtcgacgcgcgaccctgctgccgccagtcgtaacgattcacggagcaccagccgaacgtggtgatccgccgatcgatgaccaaacgcgtcagcggatccacacggacctcgtacacgggaaaaccctgctccagcagatactcgccgatttttctggccatggtccagttgctgatagacacacactgcaaatcgggcacgggtcgcgtcccgtacccgtagatcgaggttttggtggccggcgtgacagacacggcgtatggcgtccgcggttcgggcactagttcgcccacgctggcaatgacctcacgcagcctatcggtgtcgctgtactcacagtaaaagtagctgcgctgcccgaaaacgttgacgcagatactgtagccgtgttctgtggccccgaagaaacgcaacacgttccccgaaggcaccagatgctgacgatagcgcggcgacacgttttcgggcgagtcgaagaagagcacggcgtccgtctgatcgtaggtgtgaaaacgaataggtcccaccacgcgacccaccagggtctcgcgccaaggacacggccaaaccatgtcatgactcaacaaatgtttaatctctcgatagaacatgagaggcagccgtcccgttttatgcttgatcaaccccgtctgaccgtcgaacatgacgcctcgcggcacgatctgcaaaaactgtttctgtggcggccgcttgcccgagccctgcgcggagccgggctgcgaacgctgacgccggccacccgcgaccgcaccgccggtcacgccgccgctcagatacgggttgaaaaacatagcggaccgtgagaggctgacagcttacgaagcaaaatcacaaagaaaatacacatgcagcacctagatatccagtttaaccccgtatatcacaagtctctgtgtcactttttttttgtctgttttttttttcttctcctggttcagacgttctcttcttcgtcagagtctttcaagtgtcggtagccgtttttgcgatgtcgcagtcggtctagtaggttgggcttctgtcccttgtcctgcgtgccagtccgtccgtccaaagaatctgtaccgttctgctgcgctcgctgctctgcgtccagacgggccagggccagaagcatctggtaagcctgctcgttggtgtaaggcggagccgccgtggatgcatcagacgacggtggtcccggtcctttgcgaccagaattataaacactttcctcgtaggaaggcggagcctgtaacgacgtgtctttggtgctgcccgacgtcacggtggtcccgtcggcggacaccagatagggaaagaggttctgcagcggctgcgtgcacaaacgccgctgtcgagtatagatcaaataagtgataatgactacagctatggccacgaggatgatggtgaacgctccgaaggggtttttgaggaaggtggcaacgccttcgaccacggaggccaccgcgccacccacggccccaatggctacgccaacggcctttcccgcggcgcccaggccgctcatgaggtcgtccagacccttgaggtagggcggtagcgggtcgactaccttgtcctccacgtactttacccgctgcttgtacgagttgaattcgcgcatgatctcttcgaggtcaaaaacgttgctggaacgcagctctttctgcgagtaaagttccagtaccctgaagtcggtattttccagcgggtcgatatccagggcgatcatgctgtcgacggtggagatactgctgaggtcaatcatgcgtttgaagaggtagtccacgtactcgtaggccgagttcccggcgatgaagatcttgaggctgggaagctgacattcctcagtgcggtggttgcccaacaggatttcgttgtcctcgcccagttgaccgtactgcacgtacgagctgttggcgaaattaaagatgaccacgggtcgtgagtagcagcgtcctggcgactccttcacgttcatatcacgcagcaccttgacgctggtttggttgatggtcacgcagctggccaggcccaagacatcacccatgaaacgcgcggcaatcggtttgttgtaaatggccgagagaatggctgacgggttgatcttgctgagttccttgaagacctctagggtgcgccgttgatccacacaccaggcttctgcgatttgcgccagcgcccggttgatgtaaccgcgcaacgtgtcataggtgaactgcagctgggcgtagaccagattgtgcaccgattccatgttggataaatgagttgcattgttgccatctgtacttcttttggttctattatgagtaagattcagactggagcggttggccaaacgttcgagttccaccagagatttttgcttgataccttgccagaacactaccaaaccaccagtggtttcaaagacggacacgtttccatatttttcatatgtttgattgtatgaagtattgaaaatctgctgtaacttatttatagcctcatcacgtacgcagtccagcgcagagtcggacatgttcacctcttgcttcttagataagaaagtggcggtcattttggcagaagaaaagtgatacgagtcctcggcttcggaacgaatggtgcgttccgaggcttcccagaaagtgagttgacaagtgacattcttttcgtcctgtatatcccaggagatcaccgagtccgcacgttcaagaaaagccaccaacctgtgggtctctaacgcagaattcggtcttccaaagtcggagacgatagtgtagttcggaaaaatgaaaaacttgtcggcgttttctccaaagtagctggcattgcgattggttccgttgtagaaaggagaaatgtcaaccacgtcacccgtggaagtggcgaaaaaatgataaggatatttggagcgcgcagtagtgatggtcaccatacaattcagattacaggtctcacgatagagccaggtgctgccgcggctgtgccattgatccttgaccgtcacgtaacgggtactgtgggtgttggaataatcgtcgggcattaattgcatggttttgttttcatagctgtccctatgataagccacgaaaaccgtgcctgctataacgcggctgtaggaactgtagcactgactgtggctgttgatatgatgaatctcccacataggaggcgccacgtattccgtgttgctgcccagcagataagtggtgtggatgtaagcgtagctacgacgaaacgtcaaaaccttctggtagactcgtaccttaaaggtgtgcgcgacgatgttgcgtttgtagaccaccatgatgccctcgtccaggtcttcattgatgggcttcatcgaggtgcagacgatattacgttcaaagcgaataagatccgtaccctgggccatagaacacacgcgataggggtacttggtggtattgacccccaccacatctccgtacttgagggtagtgttgtagatggtctcgttaacaccatggctgaccgtttgggaagaagttacgcgttgagagactgaaccggatcgagagtgagcagcagacgtcgtatgagaggaatggtgactgtgagtagcagaagttccacgagtagaagatgaggaaaccgcagcacccagacagacgatacacaagttaacgcagactaccaggcaccagatcctggattccatgttcgtcgcgggccaaatccagcagcgatgaggcgcgtcgtggtctcttgcgtgttgcgcggaccctccgggaaacgcccgcggtcgaggaggaggggtacggacttggcagccaaggtcggtccggctccctgaaggcacccgagacggccgcggcggccgtcagggtggagggcttggccacgggagctgttggcacgtcgccactctcatccggtctggacagatgcctgtagaggaggagatatagatctttggacttataaagacttccttcgtgacgaagcagcagcggccactctttgttatacgtgagaatcacatctctgtccgggtgcagttcgtcgcgcaggcacgcgatcgagagttgtttcccgaaagtttcattatatagtgcgacggagagcacgagctcccgcacgtgcatccacatctccttctgcagcacgtttaggtcctgacagtccgaaaaattgaaaaaacccatgtacttcaccaccatccactcactgggatacacggtaccttccgcgcatttgaccaaatcgtccttgacgtggggtagtacgcccgcgttgtcgcaggcataggccatgtccacattgtgagagaggggatagcgatcggtacagtgtgtgaagaggggcccgttacacaactcgtagatctgctgacccagtagcgggagggattccacaggcagactcttgtggatcaggttattgaccacatacaggtgctcatcgtacgtgaactgattccccacgtccaccacgtcttggtcctggtggtattggctgcggtatagaaacccattcatgagcttagagataaagtccagacacaagggccccactaggttgacatcgatgagtttgctagtcagacgctcctgcgttttgatgcaacggatcaccttgccatagcccacctccgagaccttctgcaggtaggcgcgtttgcgcacgttcacctcgcgggtgacgttgtggatgcgggaacgcgcgtccaccaagtcgagagcttcgtgttcgtcgcagttgcgcacccgtaagccgttttcgctgccgtcgccgtcctgcccattcgcccctccccctacagctttcttgcctcctccacgggcccggccgccgccaccgttattcctctgactgtgagtactgctgttgctgctgttgctggccgtcatcaaagtcgtacccgtccccgacatcgcctcccgtccacgcaggtgaataacctcgccctcggggccgtcgccccccgtgccatcgggcagcggacgtcgaatctcctcgagaatatgcttgattttggtgtacatctcgttgctttcgtggagcttgttgaacaccgggttgtcctcgaaagcttgaatgctgagggatgtgatgaggtcgatgatcctgttgggggcggcaaagaccgaccccacgaacatgcgctcctccccgtccaacgccttttccccgagcacgaagatgtcctccacgtcctccccgtacagatggcgactgatgccgttcatgagcgcccggcacagctggtgatacacatttagctgctggatggtgatgcccacccgcttgacgataacctccgaggtacgggaccagtaggtaaaatccgacaaggaatatattcgttccggtatatccgtaaacaggttgtactccctcagcgcctcctccgcctcctggatgtagctgtggtaggccgatgaagaagagaataggcttttgagggccgaaaggactccagccaagtgggggatgcgcgttgtcaggtccagcaggtcctgctccaccgtctggatattcacatcggactggcttgacggacggtggaccgctatatggttgcacagcaagccctgcagccgcttgttcagcgagcggccctgattcgggatgatggtcagctcctcgtagcattgggcgcatgtcgtcccttcgacgtacacttcctgacgcgccaccggcgagatgccgcataggcgacggaggagctccagcagctgcgcgcagacctccaggccggcctccggcgccaggatcccgtacacgtagttcattttgcacaggaagcgctcgatgtcgttgagtgtggccagactgacgctgaaacggacgttgtccgtaaactggagctccacggtgtgatggcgatcgcagcgatccaaacggaggacggtacggtagaaggccgcccggtccggctggcgcgagtaggccatcagcgcccgatccagcaaagccgtatcctcgtgcagcgccttcagcagcatctccagatagagagtcagcagcgaactctgcgtacgattctgcgccaccacctccgggtagatcttccggtacagatacactatagccgccgcgtttctcttgaacggcgtggactccgccagtaacacgttcggatcgcagtactttagacactccagctccatggcgtattcgttgcatttcgaacacactacgcatagtttctgtaacaaattcatctccatgactcgactcgctcacgtacgagacgctgtcgtccggtctggcgccggccagagacatggagtcggtgcacaaataactcgcgggccgctcgctatgccgactgacgttgacgttaatatataacgacgtcgtcgacgacgcgggttctgctcccgaagctgttgccgccgcttgcggcgcaacctcctccaccaccgccgccgccggctcctccgcctcgggcgacgggggctcggagatgaccggctgtgtctgacactcctccccttcctcaggcggcccgggcgccgacgcgaatgtcggagtttgccagcgcggcggcggtctctgtctctggtgccgcggcgctaaccttcggggctgttgctgctgttgatgatgcgacgccgtccgtcgccgctgttgcggcggtagctgatacggtgtcgcctggtgctgctgtgtcggtggctgctgttgctgctgttgttgcggtctgaaaagcggccacgggggctgcgactgttgctgctgttgttgcgatgctcgtggctgcggcggccgttgtcgcggcgtttgctggcggttacaaccggctgcgtttggccggcaataacccgctgcccccgccgcccccgctgctcccgccgacgccgccagcctcgtcttcgccggcgttcacgagaaagcagccacctcccgtctcgccgggcacgccgaagcaaatggagttgcccgcgacggactcgccgagaagaagaccgccacccccgacgccggacgccgcgccgacgccactgggcgcgaagagcgccgacaggtcgtgcacctcccccccggcggcgtccgttaatcgctgggcgtcggcgtccagcacgcgtcgcaagttctccagcgaaaagtcctccacgccctgctcctgcaacgcggcaaacttgtccatcagcgacgcggccagcgcctcgcagccatccacgaagaagagcacatcgtcggacgcggggatctcctcacgcacgctcaaaatctcgtacacggccatcacttcggggtcgcaatccaagttctcggcgtccagcgccagcatgacgcggttttttataagatccgcgtcaaaaagcacgttctcgcggcgcgagcgtttgatgagcacgtcggccagacgcgtagccaagagatagcgctggcgcatgaaacgataatcttgaccgctcatagagctcacgttaaggctgcgttccacaccgttgcccgaaaaatagccgatctgcccaaactgatagatctccttgctgttgttgataccagcatatttttccacgctcacgggcacggtcaccaaggaacgatgctcaaaaacgctccgtaccaacgattcacgcgccacagtggcggccatgggcgccggcacgcctgcggtcttcaagcccttgacatgcaacgcaaattcggcgggcgacgagaaacgcggactagcacctaacacgtgaggaaactgcgcgtggttctgcgtcgttaagcgcgtcgttaacccgtgcagcgagccgatgtagtccttgaagccgtagtagcagaggaatttgttatggaaacggctttccacgtaactcagcacacagtctggcgccacatccagcagatcgtgctcctgatagtcagccgtcacagccaccagaaatttgacgaaagcattgaactcgcccatgtcacctatgggcacattcttgggcaacgcgttggaacaaaccttctgccaaaactgtaagcaggggagaccacattcaggaaagagtcgctcgtgatgtcgatacagcagaaatcccaagcagcccttagccggattacgacgcggaacgtgatcgcggcgaaaaaacacgctacccgcgttgcccttgcccgcgcggtagatgggtcggtttttcacccgcaccatgatcaacgtgggtaccgatagccgcgagagcttgatctccatgggcaccacggcgtacgtgccctgcgcgtacagcctaaagtccagcaggcggtcgtgatccgaattcttggacgacttgatctgcttggtgaagagaaagcccttgcgcgacgacgtggtggagaacgcgccgtgaatggattgaaaatgctgcgtcatccatttggataccaagttggtggtcaacggattgtccacaatgtatgaggtagcggtaataagcgccacgttctggatcacgtaaaagacggatctgaaataggcgtaggccagcagcggctggaaggccacggcgtagggattcagatccaggttgaaggcctgcgtggcgcccgccacctcgtcgcggctgctcttgaggcgcacctccgaaacgaaacccagggcctcgtcgtccacaaacttgttgagcgccgaaaagacggccacaaagtcgcttttgccgtgcgcgctaaaggtatcctcgcccgtcacggggtcgatgagccgcatcttgcggcagtaatccaagatgcgattgagccgataggtacggtccacgctagcgcccagcatgcgaccgccgcgccccatcattcccccggaatccccgccacccccaccaccacgaccgccgcccagaccgtcgctcgggcccccgctcacgtcccgtccaccacccccgccagcaccgccgcccggaaccccgtcgtcacctttgccgtccaaacccccgtccttggcgtcgacgttgtaacgccgaccgaagctgcccaaaatatccacgtcgttgagaaaacgcgactgcacggtgatcacgcagggctccttcttgggctgcttgggcaccacgggcaagcgggtgcgcacccgcacgaaggccgtctgataacacgtgtggcaacaagtacccccacaggcctcgcacagccccgcggcgcagcccaccaggtgattcgtgagcgtcgacgaacccgacaagcccgtgttatacaccgagacacgatttagataccagacgaagcccgaaactagctgcggacacgtgccacacaccaacgccaaatgctgcggcccatagcgttcgtccttgagcggcgcgccttgaaacttgagcaccttgcgcgcgtcgttgtagacgtcttcgcaggccgccgacaacccgttggtgaactgaatagccttgagcaacgtctcctgactggccgtaccgccggcgctgggatgccgcgccgacgactggagatacaccagcctgtgctggtagagcaccgaattagcgctgaagaccaaggcggccacgtgcgtcgagagatgcaacttgagctcggtcagcgcgcggatcagatcgcggtgatcggttgcgttggtcactaaaggccactcggaaaagagcatagactcggcaggttggtaggccgaatcgaaaaataccgaggcaaaactgaaggccaactcgcaaaccaccgcgtcactcagcatcagatgatccttttccagactgctgagtcgctggctcatgtaccccaagtagcgcttatgtggcgccagcttcaccgactgctgactgtcgtgcacaaactgccgcaacgccgcctcgatcagcacacgcggctccgagaagcgcagcgattgacaccatgacgtgtacacgtagtagaaaagcgtctcgcttacggccggcacgtagagccctcgcgcctccacaaaagcgctgcgcgcatccagcgagacctcgtcggcttcggcgtcaagctgcagcgaattaaagagcgtaggcgggtacaacggcacgcgcaccgcctcgccgccgtgcagtcgcaccgtggtcgcctcctccacgcatggaatcagctgaccggcaaagagaaactccttcaagccgttgcccaccaccacgtgcacagtcgtctcggacgcctgacagcccaccgccgcgcacaacgccgccagatcggtaggcacgcgatccgcctcgggcgtgtaggcctccaacgcgtacttctggcgggcgtcctcgcacagccgatgcacgtctccgtgatcctcggtaaaagccacgatgccttgcgtatgatgaaagtagagcgcaaaaggacagaaggacgtgactttcgtgagcaccccgccgtcgtaacaaagcacaggcgtacgcacagagacgccgaaatccgcctccaccgtgagccccgccaacagaggagcgatcaccacgctcgaggaacggtcgcatagcgagagagtggccagaatctcctgcgtttctgcgttcaacctgctgaagtagagaaaagccgcgggccccaccggcgctagcgcggttagttcctcgtggctcatggtggatgaacggaagacaatggctacgccgccactgagtgaattttataccaaggaaaagttcagcacgtcatgtttgacgcacgacgtctgagacaccaccgtggccaccactgcggtctggctgcggttgcggaccaccaaaggcgacaaccgcaacgatcccagcaattcgtaagaaaagctaaccgctacggtcgggtagcctctcgcagccagaccgctagccgacgcacccgcccgcgaaaatagcgtgatgttcgggacggctttgcgtcaccgccaactaacgtcggtagtcgagcacgtcgtttatcctcagcacaccgtccgatcacaatccgttttcccactcagtcgcacaagcagcacataaaaaccccacacagggcacgtgaaaacaccgtccctagaaaacggtgttttctgtcctaccgtcaccggtatacacaggcaaatcccaagcccgatccccgaaaacaccgtacggtgtttgtgacctccaaaatcacatcagctaacaaaccgtgaaaagtcacgtttcacgaacacggtgtttttaaatcacaaagaaccgcctaacggtttacaagcagaaacaccgcaccacggtggtacaagcgcgatgaatctggtctcgcaacctcaatcgccgctatcaccaccgattttcgctgcgctccgccgacaaaacgtcgtacaagctacacaccccaaaaacccgcgcgcctacgggcgccaaacctgtgtattatctcaacgtcacaacacgacacaaaccgcgtaacgtggtttcccgaacacgtacgcggcacagacccccgacacgtactcgaagaccttacagtttacgagtcaataaaacaggaaaagatccgaactttaaaattgtgtatttttattttcccatccccctctttttaccaaaaaacacatttttcgtcttgtaaaaagtaactttcgcccattgccatgaaacaccgtgatggggaacggtgttgtgtgtcgactgacgtcactacggcgatcagtatcgacgtcgtgtatacataacggtgcccggtgtttttattcggggcgttgtcgcgtcttgatgtagtgtaacctgaaaccgccgtgcccaagaatgcggaagccagcgtgtaatcataacggggttttgggtacaatctgacgacatctggcggcgagcgtacaccatcgaatgtggcgatcgccggctctacgtcacaatgacgcaaaaacacactgtaaaacccgcgtagacagctttcctggtcaacgagcgccatctggtgtcggcataagaacaggcatcaaccccgtggccggcgaggcggtgagcacttttcctggtcacgtgaccatcagtgcaggaagcgaggcccgtagaaccgcccaagaggcggtgccagatgccaacgtcataatcacaaggtgatttgttacgtcacgcgtgtgcgcacacgcgcacgcgcgcacacgcgcgcggtagaatacagcgatccctagtgaagccacacccattacgtgtagccatatccgcttacgtatacaaccacacccctaggtacgccaccttatctaccaatcacagaaacggatatacaatgagccctccctagactccaccccttgtacggaaatttcagataggtggaacccgttagggttccaccgtcctcggtgtacgtacaggcttctccgtctaccggaaatatacacctgctgacgtagacgctactcccggatacgcgtcataagctactggaccctaggggggagtgtctacagggctacgtgcacgtccccttacctagggtatccgcccccttccgctgttttggcctagtaaacttaacgccgccgcttctcacgtgacccctgacaagcccacgtcacactcgcgtagccacacccactccggatatacgtcatcctgtggacttccggacatacggtgacgtagcgagcgtagcgagctacgtcacgtatgcgtacgtcatctccggcggaaatcatctctgatgacgtagcgagcgaagcgagctacgtcatcagtccgttttacgtataccggatgctaggcgacgccccgtaggggcggagcctagcttccacccctaggatgcataccctatatagcataattcttctaacgaaacgttctacgaaaacggactggcggaacgggaaccaccgtaacccccccccctcacccccccccttctcctccggaaccggggggggcaaatttttaccaaatttgggcaaccatgatttccaatgggacggcgtttccgtgcgcatgcgcagtcggggcgaattttcggttgttagggcgttgccacgcggattatgggatgtggcctcgagtgcgcatgcgccggggatgtcgtataaaaagcctatatataaagaggggtgaaccaggggacccggtgcgcatgcgcgggccaggacccgcgggaggcgcgccctgcgcatgcgccggtaaaattccactgggcatgcatcgtgcgcatgcgccggtatttttccactagaggcggtcagtgcgcatgcgtcggtaaatttccactggatgcgcgtcgtgcgcatgcgccggtatttttccactgggcggccgcacctagggagcgcgagccccgtgccgggcatgggtcgcggcggtggaaaattaccgctccgcccacctaggcggggcctctgaaaacctataaaacccggcgtgcccgccgccccccggcgcagtccgcggcagggttccggccgtgctgcggtccgcacgctgcgcccgctcccgcctgcctcccgccctaccccccaccctccccggccgaggcccggcgccggtccgtccgcgggcccgtcccaccgccctggagcaccatccggggccgtgggccgggcaccgggcgcggcccgctccggacctcggccgggggtccctgccctccccccgctcgaccccccatccgacggcccggccgggctgggacccccgcaccggggtcccggttcccgtccgcggcccggggggacccgagcgggggcttcccacccccaccccgctcctccccgggctccggcccgggatccctcgctgctcccggcgacctccgccggcttcccggtccacccgccgcggaacggacgggacccggggtccgcgcccttcccctccccccacggggggctgggtcgcggaccccggttcctaggctcgttccgcggtgggcgaccggggatcccccacccagctccccttcccggcccgccccgctggcttttgggcccctccgggctttttttttccggctgggggtcgcggcggtcggccgacgacgacggtaggtgggccgggtggacggtggtggggacgggcgacgccccggctcgacggcagtcggtcccggaaggttgggggctgggggcccggtcaggagcttcgggagcggggtcgaccgcgacggcttccgggtctcgcggcggctccctctcggcggctccggttgggctcccctcccccctctcgagggtccggccgccagtcgtgaccgggggtccctcggcctagccgccggctctcggtccgccttatcctgggcgttggccggtcccgtgacgctcccctcccccactgctccccaaaaaaactccgcccgaaccgtcgcggcttgctggccctgggcgtggtcccccactcccctccccccatcggccgcccagccggggtcggcgcctcggaccccaccaggctgtggcgtgtgtgctggccgatgcggcggcgaggttgggtgtggccggaagcgctcggggtcgacggtgggccgccatgacacctcaattgccgtcagtacgcccctccacaatcaccgtccccacacgatgggcccggcaggtcacccaacgttggttcaggcccagtcgagtttttccccggcacgaacgcacgtccccgtgggctccacgcgttttccaccctttcctggaggggtccggaacaccgtgaatccacggggagggtcccggcacgggccgaggagaccacgaccgtcccacccggcgtgtcgactcgtccgagacccgggaagggaacaggccccacctttttttcccttctccgattttgccgtggaaaacccgtgaaccgatacgggtgcagacggccgaaaaaaatcgagacgacaatatgacggcagggcgcgatcttctcccccatccgacaaaaccgtgtcccttaaaattccccacctttctctgttcaaatgggcccgaaactgtaaaacaccgtttgaccgcaccccaaccggcgccatcttggtgactttctcgacggttctctcgctcgtcatgccgttctgagctccgacatggcggacgagagaaaatggcgtcgagagcctaggagcgttttcgctccaggcgggtaaaaaaatagcacgataacttttctgtgcttttttttgagacgttttagaagagcttttttctgctcagagcgaaaaaatgatagccctgaaaatctcgacgagtctggccgagcggcgccatcttggaggaggggcgagtcgcgggcaccgcctcggtaccccctggccgaggcgagtccgcggtcgccgcctgttccgtgatgctacctagagggcgctgtcgaggcgactcttcctgttttcgccctgagggctaacggtcgctgacgtcaaaccatctcgtgctcgctgagtcacatccggttgttgacaagcgatggaggaccgcacccaaagtgcgccctctagtcatcgcgcctgaccccttttataaactgctcgaagaaaagaacaccttatgtgaaaaaatacagaatgatgacaagttcatccaacacaaccgctcaacaacgccatatctatcagtgtccaaaaactatcttctatcctttgaaactataaatgctgcctatatacatatttagtatccaagactcttaccacgtagacgaaaagaagtgatacaatgatcttgacgtgtatcgtctatatcgtgctagatatattcagataagacgcgcaaaccatagatttctcatcagtatcatgaaagacctatagctctatatacgaacctagtcattttaggacagccgccggagaagccgacgagggatcgggcgggtgcagccagaacctcacgcccgatcccgcctccggtaggcgatttgcatctgtttggtaaaaagctcataagtctgtatgtgacctatatatatattatacgctatgtacaccgaactgtcgctgttgtataagaagaaaaaactctccatatttatatcgtctgaatttttgcttgatagacacgtgtttggaactctgtccccccacgttttcactgtgtataacaaaaatatgtgtttctcaaaagatcttgaggtgtttgaaaacgggggaaacctgcgtttgggtgcgctaagccccggactgggacgtagccggcgtccggcacctatatttttctatttttttacaaaatatatgatgaaccaagaataaaactctagctctcgtctatttttaatatgctctacttagaacctttttaatgacagaatgaactccatgttatacgctctttatatagtttctctgcactaacctttaaaaccgtatccttccctgttgtacaaatcatcttttgatacacaatgatgacctgatatccctccatatatatgatcggatattattccgttagacttgtcctccttttttttcctcatctcctatatctggagatatatgttgaccaccaccgccatgaccaccaaaaagctagccgtcacgactagaaatgtgtaggattcggactttccgttcgagaagaaagagaccgcgtctctggacgctctttttgtcggtctgaatcgacccgggatacgtaagagagcggccctacatcggggggcgctcgagaccgacgacgttccatctgaccagaaaaaaaggcacccctcggtagcgacctctcaccatcgtttgcccgtccgcccgtccttcgtagccatcatcatcatctcaggctctatcggtaccatcgttgtcatctgaaaaaaaaaactgcctcacccacctgcgtaaaaacaccatctttccggaggtgcggtaagacgggcaaatacggtcgtgccgaggcaaaaaaaaacgcaccatcgacaccacaccctcatgagcaccacctgtcggtgttggtcgtcctccatcgttctctacgaacatctcgacgcccgggtgacggacgacggcaagacgtcccggagaagacggtgttctctcgggcggtacgctctctggatctataatatctatagtagctaaacgagactgtgagtacgacgaaccacatcatcttttttttatgttgcttctttagaaaatgacttatgtcgacgacactcggcatcagccatctcgtgaaacacgctcgcttttcgtctctccaaggaacactgggtccgctgaaagggaccgtgtaccgaccaaagcaaaaaacacacacgtagtaacatgatcaaccacgtctgaatgacacgaaaacacaatcgtataacgctctattcatggaacgaacttggaataaaaaaaaccatcgcaggccagaggctaagccgaaaccgtccggggaagcgggcgcgagttttccgacttagcctttggtgctcgttgagcctctttttttttttctgattctctgaagaatcaccgtcacagccctatgacgcgaaatcaattgctagaacataaacgttctcaacaggtatgaaatgaacaaactagatgatgctataaccttatattgtgtgtatatagataggtgtgaaatttgtaggataaaaagtgtcgttgtatgatgcacaacgatcgtgaaactggagactgtagctctctaccgaatgcaaatacacaaatgacatcgattcccgtccccacataaagaaatgtgctttactgtgaaagaatgaagaagattcttgttcctcgtacgacggggccctcgctcgtcgtgcctcttcccccctccgggagaggggacgtcggggccctccgtcgcaccgggccgaagccagtgaaatgtttactacactgtcatcagaatatatgatgtatattatttcctccaaactcctcaccatagccaccaattcgcatcacttaagaaagtagtagcaaccgcggcggcggcgaccggccggtcgtcgtctcctcgtcctcaaatgttgtacatgtgcagaaaaatgtgtaaatacgtgttatttatcccatgcgtcttgtacatagatatatgtttttatatacgctatttatactttatatatccttttgcataaccatagacagtcaaggattttaatgatttgctcatccgcctttgagccatcgcttaggagttagttcctctatgttctcggcccaccttttcgactacagtagcaaacccttgtactaccaccccgataaaaaccacatcatcatcgtcaccacgacctggaaacgacacacgttcccccccaatcttgggcatgtgtatatatatataaagaatgggagggagaggacgtggggctcgagaagaaataaacgccaagctcgattcgaaccaaaaaaccacatgtgtattgtgctttgttttttttttttacggtggggaaaaggagggggccgtcattaacggaaaccgtgtatggggtccggacacgaacagtacacagcttatggggaaaaaagctcacagagagaaaaaaaaacaccaagctcaggcacgcgtacatcattatcatcatcggatatctcaccacgagtcatagtagtaccaaggagtgtgtaacaccattttttcttttttctttgtaacgggataagggacagcaatcatcacgcacaacacccttcactctctttttagtcatccatatcatcgctgtaacacagcatgtcctcgtaatcgggcgtctggcagcgcattaccaccgagtcgtcttcttgcggtaccggtggtggcggcggcggctgctgctgttgggttgccgtcgtactgtgattaccgttggcggactgcaccgggatgatgggctgcttgtggggaacctggggtggactgccgccgtgagaaggcgacggcgtcatcaagttaagctcaccacggtgactccggacaccggcgaggggcgccgggggactgggagggaccgcggtcgtcttgtagacgacggtgtccccgtgtcgatccgtggctcgtaccagatcttgactgctagcgtcgtcactgtcttcgtcctcttccagctcgccctcagagtagtgctgctgtggttgcgacggtggctgggcgggaggagcggcggcggcgatcattggagagggatgtcgatgactcccttctctgtcctttttatcgtaggctgtcagcgttgctgggtccgtcctgctttccatacttgcgcattgctcatcggtgggatgaatttggtctcctccccgctgttgtccgccggcagtggcgtggttgctggcggttgtcgttgtcgtaccggcaaagacggtgagatccaatagcgactgctcgtcgaagggacagtacgctatcatgaaacgatagggtgccaacgcgcgttggatgcgcagttcgcacatctcgttctgacactcgtggcactgcagggcgcctaggatcaggtccgagacagcgccgcagcggtaggtacccatggcgttgttagtatcgaactggtcaaaaaattggggcgtaccggtgacttgcaacgcgcgacggcgtagcgagacggccacgcgcgagaaggagcacacgtaggccatggcgcggtgcatgggttgcgagaaggtctcgggcggacgcttctgcagatcgcagacgtcgtcgcgtagccaggcgctcatttgaccgggcttcttgactagccgtttgagcgtgctgcaatggtcgccccagccgtcctggtggtccaggatgcagcccaggtccaggttgttgagtttgttgaaaagcagctgacgcatgccgcccaccgtctccagatagggatcgtgcgggttgacgggtagcccgtgcaggtggtggtacttcatgtagctgagcgtttcgtcgatgatggccagcaacgtgtgcaagttgggagcgttgtatacggcgaagatcttttccaccaccagcttgcgcagcaacggttcctccagccaatcgaactgttgacggatgtgcaacaggtagtcggtgtgcatgagctcgtcgtgtgacagcaggatgcgaccgcgcggctgatgatcttgcgggaaggcggtggggaccttgaggtcggcggggtagggtgccagacgtagactctcggccgtgtagcgctgaaggtcgtagacgggcgaggtagaactcggtgaggtacccgacgaggcggcgccgcgctgcagacgcgctctttttttcttttcgatcaaacggctgagttgctgtagttcgtcctcgtccatggcgtccagttcgtcgtcaataagcgccagcatctgttgttgttgcggtccggcggacgatccgtgatgattattggctgaggaggggtgagaagaaccgaaagtcgtaggacaactgggaactcggcgacgaagatgcgtcgaatcgccgccgtgatggtgcggttcgccgtcatcgttgtcgtaagacttaccgtagtgggggttaaggggcaccgaggcggacgcggccacgcgtcgcttgaaagaggaggacgccctatgtccgccacggaagcccgcagtgcccatgatgatgtgtccgccggtgcccccgagtgcgtggcgggaggagggtggaaggggaggaggatagtggtccggatcgccttcggtatcatcgtctttgctgtagcggggtcgtcgtgcggggacgcagggtcggtgatgatgcgaggcggcgccgacggtatcttccgcgagatggtattcgctggcggctgctccgttccgtgtcgacggcgaggttggacttcgctcgcgtcggaacttccgtggcacgggttcgtaatccagacagaagcgccgtgcgcgacgggcgcggcgttcgcgctcgctcagggaagataacgacggagcgtcgtgacggccgcgtgagtgcagctccatggccgccgtcgctaggaaggtcacgttctggcacgctgatgtatatatagatgagaccgctgccggggggcgggtcaccggcgccgtggaaagtgaggctcagacggcggtcgccggcggcatgggcgcgtcgggcggtctgattttgatggaaatgtggacgtttttggcgttggagtgacactttttggtgaaacagcggctccagaggctggcccagagcgcgtagctgtgctcggtgcgcaggtcgatgaacacctgcacggtctcttgcgggttgcggtgcgtgtagttgagacagcgaaaatcccgcgtgcgcgcgccgtcgcgtcgcttgacggccacgcagcaggcgccgtggggctgaaagaggaggacgtggggcgcggtaaactgctcgctgacgtgcggttcgtagtgttgcgtgaggtgctcgagcagcggcggccacacgcgggtgacgacgagccgctgcaagtccgtgtcggaaatcgcagcggcagtggcgccgtcgccaccgtacaggtgataggcgagcacctcggtgagaccgcggcgtcgataacgcgtcacgttaagcgagcgcgtctcgataaagttggcttcggtcgaggggcagattttgtcgcgtacgctgagaatgacgcgtggcggcggtgacaggggcaacgcgggcaggtcgtgcggcgggtggtggtgaagcaggttacgcagatccagttgggcgcgcacaaagcctagcgggtgttcgcggtaggcgtcgggcacgatgaacagcggcaacagacggcgatgcatgaaatagccgtcgtcttggtccattttatacatgtagggcagacgtacagagcgtccatggtggtagatgcctgtgtctaggctgctctcgggatgcgagatggggtccagcagcgtgtgcagttcggcgtcgagacagacggcgtgattgagcacctgcgccacggcgcgtaaaacgctggggtgtacggctatggtacaggcggggaacggcgtgatgatgcgcagccccagtttgcccttgcagcggcagtaagggggtgacgtgtcaacagaggacgttgttttttggaaaacgccgttacccgggacgttatttttatcctctttcccgtcttcgtcttcctctgtgtcgcgctcgtcccggtaatcgagatagtcgtcgtcatcgaaaggcgcgccggccgcgtccacgggcacgctgttgggtgggcacgcgcttttgaagaaatagaccgggtgccggtcggggtgcgtgtagccaaagaggctcgcccatacggtcatccagacgcgtcgtagtccgcgacataactcaaagacggtgtgtcgcgccagaccggagacgccgtcgcgcagccgtaaatcaaagtcggccacaaaattgaagacgggcagacgttcgttgaagacttcgtgtcgcgtgtagtagaactgtgtctcggggctggtgctggccacgtcgtcgtcgtgtagccacacggtctcggtcagggcctcgtccgagaaacggctgtcgggtacgtgacggagcaggtcgcgcggaaagaggctgcgatgccaggtttcggaggccacggcgcagaagacgtgctggtcattgggcaggtgtacgcggtagacgggcagcggtcgctccagcagcggtgccagcgcgggctcgggtagcaggtagcgacgttgcgagtaacgcgttagcgtgccggtggtgtaggtctgagctgtgcgcagcgaggcgcatagacgtaacaagccggacagggagcgttccagcggcgagaagacagactcggaaagcgtgttgatgcgttcgagctggcgcgccagctgcgtggaggtgccgaagaagcccgccaggtgcgtgccgtcgatgcggccgccgtagccggccagccccaggccgtgcgggctggtcgccgagtggggggattcgtcgagacgtagtagatgcgtctccacgtaatcgtgtagaaagttgtcgagcgagaagtatttttgcatgacgtccagcagctcggtggaaagccggcggcccagaaaacccggttcgcgcgtacactgcgcttcgggcgccgcgtcagcgtcgtaagccaccacgcgccggtactcgagcaaccgcgcgcgtgccagcgccgtgcggtaggccaggtagacgtagtgcacgcagaccgtgtcgggcagacgcgcacgttcgcggaacgcgttgatctgcgtgtccacctgctctagctcggtgtagtcgcggcggttgcgcgccacggcgtacgccacgaaagcggacacgcgctgacggaagggcgagcccagtagcagacgcgcgaactcgcccatggaggcgtgcgtggggatgatggtgcccaggtcgcgcgtgcagaagctgcgcacgtactcctccacggtggagatggtgctgtactggccctcgaataggtagtaggccatggtcagtagcacctggccctcggtgtgcccgaagacgctgatgaaccacgagggcgaggtggggcagaggaagacctggttgagatgacgtagcacggccgcgtggtgaaagtacaccaggtgcttgaattcgcgcacctcgccgccgtgttcgggcgagagcacgggcgtgcggaagagatgccggtagagcggccgcgtctcggcctcgtccagactggcgatgagcgccgagagggggatgggctggcgcgcggccaggtagcgcgagagttgcagcgtttcgttgttcacggcgaagacgggcgccacccgccgcgagtccgagcacttttgcgtctgtaggcagaaataaacacgtcgcgagacctggtgtttgaccagcagggggaagacgcagtggtccgtcggtgtctgcgagagtacgttggcgactatatgagcagaatcatactctgttgcgaacagaacgagcgtcatcgtcgcgccggcacgatgcagctggcccagcgcctgtgcgagctgctgatgtgccgtcgcaaagccgcgcctgtggccgattacgtgctgctgcagcctagcgaggacgtggagctgcgcgagctgcaggcgtttctggacgagaactttaagcagctggagatcaccccggccgacctgcgaaccttttctcgcgacacggacgtggtgaaccacctgctgaagctgctgccgctctataggcaatgccagagcaagtgcgcgttcctcaagggctatctctcggagggctgtttgcctcacacgcggccggcggccgaggtggagtgcaagaaatcgcagcgtatcctagaggccctggacattctcatcctcaaactggtggtgggcgagtttgccatgtccgaggccgacagtctggagatgttgctggacaagttctccacggatcaggcctcgctggtggaggtgcagcgcgttatgggcctggtggacatggactgtgagaaaagcgcgtacatgctcgaggccggcgcggctgcgacggttgcaccaccgacgccaccggcggtcgttcagggggaaagcggcgtccgcgaggacggggaaacggtcgccgccgtgtcggcctttgcctgttcctcggtttcggactcgctgatccccgaggaaacgggggtcacgcgtcctatgatgagtttggctcacattaacaccgtctcctgtcccaccgttatgaggttcgaccagcggctgctggaagagggcgacgaggaggatgaagtgaccgtgatgtcgccgtcacccgagcccgtgcaacagcagccgccggtcgagcccgtgcagcagcagccccagggacgcgggtctcaccgtcggcgctacaaggagtcggcgccgcaggagacgctgcctacgaatcacgaacgcgagattttggatctcatgcgacacagccccgacgtgcctcgggaggcggtgatgtcaccgaccatggtcaccatacctcctccccagataccctttgtgggttccgcgcgtgaactcaggggcgtgaagaaaaagaaacccacggcggcggccttgctgtcctccgcgtgaacagcctggcacgttttggaaaacgtacgtgatcacgaacacgacgagtacgaggtttctcatagacgtactttattaggtcagggatgacggggaggtttcggaccgacgtcaaaaataacgtcactcgtgttgacagggctttctgcgtcggagctcttttcatcttcttctgtctcgtcgacgtcatcgtctaccggcgagggtgtccgttgcagcaacgcgtgctcgggtgtgtgggtgaaaccgatgtcgggggtgggcggcacgatcatctgtcctagggggtgactgcccaccggcagataggtaaagcggtgggtggtaaaaaccgctttggctacggtggtgtgtggggagatgcagacggtggtgtgcgaagtgttgaccaccgtcacgccggccgcggtacccgggagccagatggtgggtcggatgatgagatccgattgactaaactggcgcacgcccactatgagggcgcagataccgggcgcgtgcacgtaggccgcgtcaaaatagacggtttgcgtgtgacccggaccgatcaccagcgtctgacgggtacgtaatgaaaagaaacggtgttcgttgggcggcggcaagttcatgagctgccagggttctggcacaaaacaggggaaaacgccgatatcgccttcgatggtgcccggaaagatggactgaaaagtgtcgttgaggttgacgacatccaactgcgggacttgcagcccggattccagcagctcgggcatgcaaacgaattgcgcgtccaggcatttgtaaaaggtaatgccgaaaaaaccttcggggatatagaggctgacgcccagcgaggtgggcactttgcgctcgcgtgatagccaaatgatgtgtttattgtaaaaggccagctgcgtgtggcattgtttgacgatgaaactggaaggcatccacttgtagggaactttgagcggcgacggtaatggcgacgacgcttcatcctctcccggatgctgctctttgtcgtatttctcctcggtcgattggggcagcgtaaatgtggtttgaaaatcgctatcgctagcgaaacgcacgcagtaacgcatattgacggatttctcggctaggatgatggagcctgatgacggtgcggactcttccttcattattaacgtaggggtctcccagaatcgctgaaaacgggagcgcggcagccgcgacagtaccagttgagagtcgattcggtcggttaacatcgtaagcatcgtggcggtggtgtgatggagtggaacacactagtattaggtcttttggttttatcggtagtggcaagttccaacaatacgtcgactgctagcacaccgcgtccctctagttctactcacgcctcaacaaccgtgaaggcaacgactgttgcgacaactagtacaactacggcgacaagtacttcatcgacgactagtgccaaacctggttccactactcacgaccccaacgtgatgagaccacatgctcacaatgatttttacaatgcgcattgtacatcgcatatgtatgagctttcactgtccagctttgcagcctggtggactatgcttaacgctctcattctgatgggagctttttgtatcgtattacgacattgctgcttccagaactttactgcgaccaccaccaaaggctattgagggtggatagatttgcagcccggcggtgttccggcggggtaagatttccatacgcgggtaactggaggctaaagttacggattttatctagaaacagcagcgagtctagatagtcccataggggatctatgaacgttctctgaaacctcgtcgatggtgacgtaggtgtagtttcgttattatcggaagccgtttcgttttccacggacatggtttcgttgtaatataaggagctcatgtcaagagtgccataaatagtgtacggcgtttcgttacgaatcagtacgtgcgtgtttttcataaattctgacacggcggtacggttacggtctggtttacaaaagggttcattccgataccgcagagtagtatatacccatgttgcgagatctcttaactgcgtggccataatggatttcataaagttactatcaggacgataacctgtcgtagatgtggcaacccgcgttacagcagcggtagcactataagtcacgttagtggtgacgttgaaagcggtagacgttgtataggaaagatatggcgtagtagtactttgagatttcttattctttttttgtggttgttctttgacaagcgcttgtttacgtttgagttttcgcatagtgtttttcaacttggtgccgttaatatacttgggaacgcggaataaatttcggctcatggcgttaaccaggtagaaactgcgagtgcagttacgttgcgcgtatcgtaaaagtagggcggttaggcccaaaaagtagattgtctgactatccacgttgactttgttggaacctatgtacagttttgtgttccaacgtggtacgttgaaaaacataggattaaacgtggtgaaattaccgcaacctttttcgccggtatcattgcgtttggaaacatttaacatttcggataggcagttcatagaaggcactgtgccgcaaggtgggggtcgtaacgttattttgtgggccgtgtgattatattcggaatatacgtacttggctggttttcggagttgagtactgtaaaagtcaaaccacatatgggtaatgctatcatttctaatgggacccgctaaaatgtagtcttgaggaaatttatccatgctaataacgatggcatgaaatttttgctgactggggtacattaaaaaccggtatccgtcagatgatgtagacatcaatcgttttaagatatcttccttctgtttcttcagaatctctttacctcgataagatagcacggtatacggccaggaacgtcttgttcctctggagtttaccaatacattacaatttatgagggaaaggagcaagaacgttatagagatcaggagcataattttaggaatgcctttcaccattatcatctcttttttccccattacagaggaggagaccccgcaccgtccgtctgccttgtggtttggtttgcctgcgtgtactcactgctgattctggtcgttttgctgctcatctaccgttgttgcatcggcttccaagacgacctagtctcccgcaccttggctgtgtaccgagcttgtatacagggcccgatatgtaaccaaacccacaacagtacctcgtaaataaagacgcacaaacctcacgcatatagtatcatcacaccgtgtggcgtgtactttattacaatgagcaagagtgcccctaagtattggggcccgtaccgttttagaaggttttgtgcgaatgtctttaacttctctgtcccttttttcataaactgtcaggtcctacaatcagcatgtcttgagcatgcggtagagcagatagatgccgatgatggccgatagcgcgtagacggacatcatgaggagacgactgtcggtggcgtccacgacgacgtcagttacttctagtaccgtaccgtttttcaaaagcatgaggtagtgagttcgcggagatgagaccaccacttcgttgtagggatccagggcgaaaaggacgtcgtccgagtcgtgcatgtacatgatgttgatgacgccttgcgtgtcgtcgtattctagcagggcgctttggcaaaaggcgcagttttctagcgaaatgttgagcgccactgtgatgctgtgtgtggtatgcatgttgcgcgtcagttcgcatttagtttgactgtccgtctgggtgatgatgaggctctggcctacgacggtggtggagacagggtaggagatacctttgatcaggtactggtttgttacgatataactgacgtgttcggagacggtcagcgcggagaaggattcgccgagcggcaagcaaaacaggtcggggaaggtttccagcgtgcttggttgcatggtagataggatggagagggcggcgggaacggtagcggggacggtggcatcggggaagagacgcgtgaggcgttcgagcgagtgatcgcgtcgcccgctactggaacagggtgtgtacaggtcgctgaggtattcgtggtgtggatgagctaacaactgcgtaaagtgtgatagctcggccaatgaacagaggcccgtttctacgatgaagatttcgcgtctctccgtcgtatgtaccagcatggagtggacgaggctgcccatgaggtagagttcttggcgtgcgaaggctgaaagaaaagaggccaggtgcgttttgtgtagttttagggcaaagtcggcgatctgtcgtagtgcccattgggggatgagatgttgctgattctgtttagagagtatgtagaccaggcgtacgaggctggtgatgtcggtgatctgattcggtgtccaaagggctcgtttggccaggtccacggccgtgggatacagcagcaacgtggtgcgtggtggtgtttgtgagaggcaggtgatcataaattcttgtatttgtaagagtgcggcctggcggtctagggcccgtgggacggagacttgggcgccggcctcttcttgtcgggctgctgcgaacagtgctaatgcgtaggcgaaggccatttctaccgtgcggcggtccagcatctgacatcgaccgctcttgagtacatccacggcgtaacggtgaaagctgttacgtagtagtgcgctgaggtctaggtagttgaagtcaagtgcggcgtcaagaaagtccgggtctttgagataagagtgacggttcagttgatctttcttaactagcaccaggagctcgtgtttttcagtttgtcgtagtataaagttgtcgcgttgatagggcgctttgaaaagtacgcgtggaagatggccgaagataagcagcatgggtgtgtcgtcgtctatggacaccgtaactacgaagaagtcctcggtcagtgttattttaacgtaacgtagttcgtcgatgaggtaaaagccttggtgcaaacaaggtgtgacggtgctgaatagtagatcgtgtccatcaaagaggatacaggtctggttaaagtgtggtcggtgtagtcctgaggtggtatgtgattctgtccagccgtgtggagtggtttgcggtggcatccaaacgtgaggtattgacaggtcaatgggcggtggcacagtggtgggctgttcacctaggctgtcttgtgcctttagctgctgcgaaaaagatcggtagctggccaggtctttggataccagcgcgtaagtgttaagtctctgttggtatctttccagggtttcggtcagatctacctggttcagaaactgctccgccagaggacccgcaaaaagacatcgaggcatatggaatacatagtattgattatagctttggaaaaagttgaaactgatggcgttttccctgacgaccgtgctgttacggaggctgctgttgtaggtacactgggtggtattttcacgcaggaagcggatgggtctcccgtaggtgttgagcagtaggtgaaacgctttgtccagcggttcggatacggcttctgcgccatatcgtgacgaaagtaggtggctgaagagacagacggcgaggatgatgaggtaggaggggaggcctggccgcatagcgcggccgcgccgctgggttcagcggcgtgatccaggtggtggttggcgttacacccgagagaaggagagaaaggatcccaggaaggagcacccgggtgtggcgctacgggttacaaaagtcgcgtctccgtctatttaatacgatgtcattggccgctgcgaagggagaagaggggacacgcgagtaagccatgccgtccgggtgtggggacgacgctgattcgacggggaacgctctgcggagattgcctcacgtgcgtaagcggatcggtaagcgcaagcacctggacatctaccgtcgcctgctgcgggtctttccctcgtttgtggcgctcaaccgcctgttgggaggccttttcccacccgagttgcaaaagtaccgtcgccgtcttttcatcgaagtacgattaagtcggcggattcccgactgcgtgttggtgtttttaccgccggactctgggtcacgcggcatcgtgtattgctacgtgattgagttcaaaaccacgtactcagacgccgacgatcagtccgtgcggtggcacgccacccacagcctgcagtacgccgagggcctgcgccagctcaagggcgccctggtggactttgattttctgcgtctgccgcgcggtggcggtcaagtctggagcgtagtgcctagtttggttttttttcagcaaaaggccgatcgcccatctttttaccgggcttttcgctcgggccgtttcgacttgtgtaccgattctgttctggactatctgggacggcgtcaggatgagtctgttgcacaccttttggcggctacccgtcgccgtcttcttcgagccgcacgaggaaaacgtgctgcgctgccccgagcgcgtgcttcggcggttgctggaggacgcggcggtggcaatgcgcggcgggggctggcgcgaggacgtgctcatggaccgggtgcgcaaacggtatctgcgtcaggagctgagggatctgggtcacagggtacagacttactgcgaggatctcgaagggcgcgtgtccgaggcggaggcgctgttgaaccagcagtgcgagctcgacgaaggaccgtcgccgcggacgctgctacaaccaccgtgtcgtccgcgttcgtcgtccccagggaccggcgtggcaggagcttccgccgtcccacacggtctttatagtcggcacgatgccatcacgggacccgtcgccgccccgtctgacgcggtcgccgcgtcagcggccgccggtgcttcttctacctggctggcgcagtgcgccgagcagccgttgcccgggaacgtacctaactactttggaatcacgcagaacgatccctttatccgctttcacaccgattttcgcggcgaggtggtcaacaccatgttcgagaacgcctccacttggactttctcctttggtatctggtactatcggctcaagcgggggttgtacacgcaaccacggtggaaacgagtgtaccatctggcgcagatggacaacttttccatttcgcaggagctgctgctcggcgtggtcaacgctttggaaaacgtgacggtgtatccgacgtacgactgtgtactctccgatttggaagccgccgcctgtctgctagtcgcctacggacacgcgctttgggagggccgcgatccgccggactccgtgacggcggtgttgagtgagctgcctcagctgttaccgcgtctggccgacgacgtgagtcgtgagattgccgcttgggaaggccccgtcgccgcgggtaacaactattacgcgtatcgcgactcgcccgatctacgctactacatgcccctaagcggtggtcgccactatcacccgggcacttttgatcgtcacgtgctggtgcggcttttccacaaacgcggcgttcttcagcatttgccgggctacgggacgataacggaggagctggtgcaagagcgtctgtcgggccaggtgcgcgacgacgtgctttctctctggagtcgacgtctgctggtcggcaagctgggtcgcgacgtgcccgtctttgtgcacgaacagcaatatctgcgttcgggcctgacctgcctggctggcctgctgttgttgtggaaggtgaccaacgcggatagcgtcttcgctccgcgcacgggcaaatttacgttggccgacctgctgggttcggatgccgtagccggcggcgggttgcccggggggcgcgcgggcggcgaagagaagggctacgggggacggcacgggcgggtacgtaactttgagtttctggtacagtactacatcgggccgtggtacgcgcgcgaccccgcggtcacgctgtcgcagctctttcccggcctggctctgttggccgtgaccgagagcgtgcgcagcggctgggatccctcacgtcgcgaggacagcgccggaggtggcgacggcggcggcgccgtgctcatgcagctcagcaagagcaaccccgtggccgactacatgttcgcgcagagctccaaacagtacggcgatttacgtcgcttagaggtacacgatgccctgctctttcactacgaacacgggctagggcggctgttgtcagtgaccctgccgcgtcaccgtgtgtccactctgggctcgtccctctttaacgtcaacgatatttacgaactgttgtactttttagtgttggggtttcttccgagcgtggcggtgttgtaatttccaccacgtgtcgctcgctgcataaagggcgaacgtcctcggagagggtatattcgttcggcgagagcgggcggcggtggtgggtatgtccccttctgtggaggagactacctcagtcaccgagtccatcatgttcgctatcgtgagtttcaaacacatgggcccgttcgaaggctactctatgtcggccgatcgcgccgcctcggatctactcatcggcatgttcggctccgttagcctggtcaacctgctgactatcatcggttgcctctgggtgttgcgtgttacgcggccgcccgtgtccgtgatgatttttacttggaatctggtacttagtcagtttttttccatcctggccaccatgttgtccaagggtatcatgctgcgtggcgctctaaatctcagcctctgtcgcttagtgctctttgtcgacgacgtgggcctatattcgacggcgttgtttttcctctttctgatactggatcgtctgtcggccatatcttacggccgtgatctctggcatcatgagacgcgcgaaaacgccggcgtggcgctctacgcggtcgcctttgcctgggttctttccatcgtagccgctgtgcccaccgccgctacgggttcactggactaccgttggctaggctgtcagatccctatacagtatgccgcggtggacctcaccatcaagatgtggtttttgctgggggcgcccatgatcgccgtactggctaacgtggtagagttggcctacagcgatcggcgcgaccacgtctggtcctacgtgggtcgtgtctgcaccttctacgtgacgtgtctcatgctgtttgtgccctactactgcttcagagtcctacgcggtgtactgcagcccgctagcgcggccggcaccggtttcggcattatggattacgtggaattggctacgcgtacccttctcaccatgcgtcttggcattctgccgctctttatcattgcgttcttctcccgcgagcccaccaaggatctggatgactcctttgattatctggtcgagagatgtcagcaaagctgccacggtcatttcgtacgtcggttggtgcaggcgttgaagcgggctatgtatagcgtggagctggccgtgtgttacttttctacgtccgtccgagacgtcgccgaggcggtgaaaaagtcctccagccgttgttacgccgacgcgacgtcggcggccgttgtggtaacgacaaccacgtcggagaaagccacgttggtggagcacgcggaaggcatggcttccgaaatgtgtcctgggactacgatcgatgtttcggccgaaagttcctccgtcctctgcaccgacggcgaaaacaccgtcgcgtcggacgcgacggtgacggcattatgagcggcggcgctgtacggcagcggggagaaaagtggcagataaatcacgtcaggttcacacgtcgttagccagcgtcggcatatgaagggcgcgggcggccagtacggcctctgggctgagacaggacgaggcagggtgagaaagaggaggatgggggggaccggggtggtggtgctgctgctgttgtgggtgcggacggtgcgggtgccgggacagcgtgccggcgaacgttctgtaatcttccataataaaagtaaaaatgcccgtctcgtgtcgactccgctggatgtcgaaggcgtcgggggtaatgcgcatcttgccggtgccgatgagataaaagtaccacattttttgacagatgatgcgaatcaagggttcgtacgcttcggcaccccagtggcgcgtgaagaaggccgccagacgaaacaagcggtgtccgtagagcgtgcctagggagaagaggatgttgccgttgcgcgccaggtcttcggggaaaacgaccggcaggccggtgtggcgctgcacaaagcgcgtcagcagtccgccgctcaagcgcgggtgacataggcgctggctgagacgggcggcgcgcgtttcatcgaacacggccgcctcaaagtccagccccgggaaggcctggcgcagttcgcggtacagatgaggccagtagggttgcggcgtcttgcgactaagcacggcgtggtccgagacacccaggttgttcatggtttcgcgcagtagcagcgtttcgagaccgcggtgaaagaggaggacgcagatgaggcgtacgatcttgagttcttccaaacgcagcgagctcagcggctgtccgcgcgacatcttctcgctaatctgtaatattagatgattggcgcaagtaaaggagaatttgcccgtgcggacccgcgggacggcggggttctcttcgtcgcgggccatcatcgttcgctcggtgagcgggtagcgacggtgacgacaatgacgatggacgagcagcagtcgcaggctgtggcgccggtctacgtgggcggctttctcgcccgctacgaccagtctccggacgaggccgaattgctgttgccgcgggacgtagtggagcactggttgcacgcgcagggccagggacagccttcgttgtcggtcgcgctcccgctcaacatcaaccacgacgacacggccgttgtaggacacgttgcggcgatgcagagcgtccgcgacggtcttttttgcctgggctgcgtcacttcgcccaggtttctggagattgtacgccgcgcttcggaaaagtccgagctggtttcgcgcgggcccgtcagtccgctgcagccagacaaggtggtggagtttctcagcggcagctacgccggcctctcgctctccagccggcgctgcgacgacgtggaggccgcgacgtcgctttcgggctcggaaaccacgccgttcaaacacgtggctttgtgcagcgtgggtcggcgtcgcggtacgttggccgtgtacgggcgcgatcccgagtgggtcacacagcggtttccagacctcacggcggccgaccgtgacgggctacgtgcacagtggcagcgctgcggcagcactgctgtcgacgcgtcgggcgatccctttcgctcagacagctacggcctgttgggcaacagcgtggacgcgctctacatccgtgagcgactgcccaagctgcgctacgacaagcaactagtcggcgtgacggagcgcgagtcgtacgtcaaggcgagcgtttcgcctgaggcggcgtgcgttattaaagcggcgtccgccgagcgttcgggcgacagccgcagtcaggccgccacgccggcggctggggcgcgcgttccctcttcgtccccgtcgcctccagtcgaaccgccatctcctgtacagccgcctgcgcttccagcgtcgccgtccgttcttcccgcggaatcaccgccgtcgctttctccctcggagccggcagaggcggcgtccatgtcgcaccctctgagtgctgcggttcccgccgctacggctcctccaggtgctaccgtggcaggtgcgtcgccggctgtgtcgtctctagcgtggcctcacgacggagtttatttacccaaagacgcttttttctcgctacttggggccagtcgctcggcagcgcccgtcatgtatcccggcgccgtagcggcccctccttctgcttcgccagcaccgctgcctttgccgtcttatcccgcgtcctacggcgcccccgtcgtgggttacgaccagttggcggcacgtcactttgcggactacgtggatccccattatcccgggtggggtcggcgttacgagcccgcgccgtctttgcatccgtcttatcccgtgccgccgccaccatcaccggcctattaccgtcggcgcgactctccgggcggtatggatgaaccaccgtccggatgggagcgttacgacggtggtcaccgtggtcagtcgcagaagcagcaccgtcacgggggcagcggcggacacaacaaacgccgtaaggaaaccgcggcggcgtcgtcgtcgtcctcggacgaagacttgagtttcccaggcgaggccgagcacggccgggcacgaaagcgtctaaaaagtcacgtcaatagcgacggtggaagtggcgggcacgcgggttccaatcagcagcagcaacaacgttacgatgaactgcgggatgccattcacgagctgaaacgcgatctgtttgccgcgcggcagagttctacgttactttcggcggctctcccctctgcggcctcttcctccccaactactactaccgtgtgtactcccaccagcgagctgacgagtggcggaggagaaacacccacggcacttctatccggaggtgccaaggtagctgagcgcgctcaggccggcgtggtgaacgccagttgccgcctcgctaccgcgtcgggttctgaggcggcaacggccgggccctcgacggcaggttcttcttcctgcccggctagtgtcgtgttagccgccgctgctgcccaagccgccgcagcttcccagagcccgcccaaagacatggtagatctgaatcggcggatttttgtggctgcgctcaataagctcgagtaagagagacgctatatttagggcttccctctcttttttttctacaccgtgataccctaataaagcacaccgcggttattatcaacgtctctgtgtttttattatttagaaataaatacagggaatgggaaaaacacgcgggggaaaaacaaagaagtctctctctagatgcggggtcgactgcgtggggtgctggaagtggaagcggtgctgatgggtgagggtcgtggcgcgggcacggaccgcaacgtgctgctgatgtctgccgcggtacgcacgtcgccgtccatgtcgctgcgcagataagaggtaggtcgtagtgcggcgtgctgcacgctcaccgttaatggtaccaagtcgtcaaggctcgcaaagacgtgccacgaggggatgacgagcgtgagagccccgttgttaccgcttcgacgtctttgtccggtcaggatcagtgcccgggacagtccggcttgggtgtccgagtcctcgtcgccgctggcttcctcgaagccggcaaacatggcttcggacaggggggtcggcgtcggtgtggaggagaggtcatcttcgtcgtcctcttcctcttcttcctcctcttcctcggtgggtggtaatccgggggactgcgggagaaactcggagacggcgccgcgcatgacgttgctccgtggaaagagaccggcgcgcagctgcacctggggacgcttgattttgtccggtttaccgggtgtgagagtccaaaacccacggcggaaaaagtggatgcggcctagcggctgtcggtgttccaaatgaacggcctgatcgccggtcagcgtgacgcggagggtgattcgcacacgatcgggtagcgggccggcttctatggagacgcccgggatgttttccgggaaaaagatggtgtcgtgagtctgattggtctcgaaagcattctggatctgcacgatgtactcgggatgtatgcgcgtcagcgtaaaacttttgggaatcaacagctggaagccgttgtccggcaagcgtcgtaggtgcgggtacggattgtgtcgcgccaccacctcggcgcgatgcgtgtaaaccgaaaagtgcagaaacacgctggtcggcgggtgcggtgagtcgtgatgcagaaacagcatgatccattggcctcgttcgtccgtctccgttttgtggatgtacgtgttagggtccgaacaggccagctgctccagggcgtctaccagcgtcagcgggatggcgccggcgcgaaaggcgaactggctgacaaagatctgccctgcctccaaactgctgtcggttctgcggcgccagttcggcgttacggtcagtcgcacggcccagtggtgagccgtgcggcggatgatggcgcgcgcttccattcgcggccgattttcttcgccgccgcgccgctggctctgaaagaggtgcagtccgctaacgggcacgcggtccagcggcagcgcaaaggccagtaccgagaccgtgttgttttctgagcctggcgtcaggcgtcgtgggccaaagttgttgaggtccaccagcagtcggtcctgttcgcccaccacgcagcggcccttgatgtttaagtcggtcaggtctacggtgtcgtgcggagatttgttctcctgaaaacagcagagaaccgagggccggctcacctctatgttggtacgcaggtccaggagtcgcagacgaccggcttccagcgagccgccttccacgttggtgatgagccgaagcacctggcagtgcaggcgaccaaagcttccgctggcggcttcggcctcgctgatcgcggccgcttccgacgagggtccctcaccgggcgaggacgatgcctgagacattgcgaaggcgggatggggggagggtcaggggatgcgcaaaggtgaacgggtcttcgtgggaggtcgggaagggttccggcaactgtcgcaaatatagcagcggtgacaggtgtggcggccaaaagttgcgtgtctgagtggacgtgggtttttatagagtcgtcctaagcgcgtgcgcggcgggtggctcaacctcggtgctttttgggcgtcgaggcgatgcatggcccgggcaaggcgtcttgccggtggcggcgacgtttgggttgcgcagcgggctgccatacgccttccaattcggcgaagatgcggtagatgtcgttggcgtcccagaagaactcctggtacttcagattctgaccctgaaccgtagccaccatgggcaccaggttgcgggccaggatgccggcctgccagggcggccaggtgaacacggccggattgtggatttcgttgtcggaatcctcgtcggtgtcctcttcgggcgcgacggtggactcggccttaaggcggccgcgtgtcataacgcccgccgtgcacgccgtcgccgaggatgctgatttgcgtttgcggcccgcggaagtggaggcgctcgccatggcgccgccgccggtgacgcggggcgtcttacgctcggtggttacgagttcttcgtcggagtccgatccgctggtccagacgtcgtcgtcgccctgggcggcaccctcgtcgtgccggtcccaggtgtgtcggtactcaagcttgccctggatgcgatactggctggtgaaggtggggtgctcgctgtactgaggcccgcgctgcagcaacaagtcgatatcgaaaaagaagagcgcagccacgggatcgtactgacgcagttccacggtctcgcgtatcgcttgtacctccaggaagatttgctgcccgttcatcaacaggttacctgagatgctcaggcccgggatgctcttgggacacagcagcccaaaatgctcgtgtgaggtaaaagccacatccagcatgatgtgcgagatcttgcccggtttgattatcatatttttgggacacaacaccgtaaagccgttgcgctcgtgggggcgcatgaagggttgcgggttgcgggtcatcgttaggtcctcttccacgtcagagcccagcgtgacgtgcataaagagcttgccggagggcacgtcctcgcagaaggactccaggtacaccttgacgtactggtcacctatcacctgcatcttggttgcgcgcgtgttctccatggagcaaaccagctcgtgcgcgcacaccacgtgccgcagtgccacgtccttggtgggaaacacgaacgctgacgtgtagtagacgtcgggctctttccactggttctgctgacgcgtccaggccagtcccgagaccgtgagacgcgcctgccacatctgcttgcccgacgcgtgaataacagcgtcggctacgggcaggtgtcggtgtttgcgctcggccgccgacgggtagtggtgcacgttgatgctggggatgttcagcatcttgagcggcagcgcgtacacatagatcgacatgggctcttggctggggcagatgcttcggcccgtggggttgtgcacgttgaccgacacgttctccacctcgctgcccgtaaagtacgtgtgctgcacctgcagctgattgtcgccgcggtggcatggcgtcgagtcgggcgtgtactgcgacaccaggatcagcgagggctggctcacgcgtacgtggatacccgtctgcaggagtcgcgtctcgtgcggcagcaccggcgtatcgccgcgactaaacacggctttcagcacgtgccccgaaatgggacccagtacggatatcatttcgggacaacggcgaccgcgcgactccatgctgcctgcgcgtacgggtgtaggcgactgagcggcgcgccctctgcggccgccgccttacataggcaggcgaccaaacgcggaacccgaaataaaaacgttatacacagagacaaccgcggattattgagtgtctttttttattacaaaaaaaaagaggcaaagccccaccgtcaccacaccccatcacacaccaccaccgattttttttgttttaatcccgtattgcgcggacgcctagtgtccgttttccatcaccagggtcctctgtttagagatcgccgcagaccatggctagagtgacaggactcgttttctctgtcgtattttccgtaagcttacagtcttgcggttccgtctccggggacgccagtcgcatgggcagcaggtcctccagcgcgatggaagcgcccagcaccgagagctgctgttgcgacggcgaatgggacgtggaccgcgagtgtagcgtggatttgacttggtgcgtcattgctgacaggcaaccgcgattcagcgtatgctttgacgagataaaatagaggcgtcccaggagcgcgtcccgtgggaacgtggcgccgttctcgtcgcttaccagtacggttaattccaaccaggagcgcggtagccagaccgtaacgggcattttgagtccctgacggttgtgtggtacaaaaacacccagataaggcccgtaaaagcggcggtagatacgtaacgtgtgcgagtttttcagcgtcaattcgtaagggacgcgcacctccagtccctcgtccgccgcgccggagcgtggcggtacaaagtaaggcagtggcgcgtccgaaaagaagggtcgtcgcaccgtttcgcgtcgcagccgcaggcgaaacgccactgggtcggctggcgcctcggtgcggtcgcaggtcacgttgaaacgtaatatgccgtcttggtatagcgtgagtgacgacagcgtcaggtccggcggtgattcgttcgggtctagctccaatcgtccaaagacggagggtcccaatgtcttggcagtggtttccgagaggcgcgccgaaatacggctggtgagtccacgcggccccgagatgccgccttccactcgatgccagcacagcgcgtgtcgtacgcgcaccgtcagtgtgggcgtcagatccgcgtccgttgattccgcggtatcagcgacggaagccgcgttctccgttacgttgtttatatccagcgtcggctcgaacgtgagttctggcagatgcagcgccagacagtcgtgtaacgccgtgtgatgcgcggctttacgtcgtagcggtagccgtttcagcagcggcgtgatgatacggagcgcgaagagattgagtgataagcgcacgatggccatgcgcgtcagttgttggtcaattaccgagcgcaggatatggcagcctgggcgtgcgggaaagagagagaaggccgggcgcacgtcagaatcctcgttagagaccacgcatagaatgccgcgttcacgatcgtcgttgcggtcatcctcgtcctcttcttctttcttctcttctttttccttttttttctcgggctcgtgggaagccgccgtttcttcttcttgcgacgtcgcgggggcggtttgagactcgccgttcgcttcccccaattgcagcggcgtagagagcaaaatctggaagggatcccgcaattcttcgggtcggaggtcgaggtgcaactggatcagatggtaggtgccgcggtgcacccgaggctgacggatgtcgtgtttatccgtcagtgtgaggatggtctgcggtgagccgctgtgcttgtccagctcgtccggcgttttcaggaggagactgtcgtcgtcggtactggcgacacccatcatggtcgtggtggtagtggtggcgaggaaagtgagcggcggcgtcgacagagctcggcgttggcggcggcatttgccgctgtgtcggctgctattgctgccaacgccaccgccgccgcctcgtctggctcgtggccgacgggcccgattccgaaggttggggtcgacgcgtggcatgcttggtgtctgcgggcgcgagagggccggctcagcctttaaatatgcaggtcgcggatttgttatcgggtgaaacgtcacacaccgtgaagacgacctgttcgcggatgaggtcatccagctgtcgcagcatgacgaaaagcgccgacagccgcgcgatctcgtcgtcgggcgacacgtgctgcggccgcgcgggcgtgcgcggctcgccgacgctgcgctcgcggtccagccgcatcagcagctcctggcacttgacgagcagcatggagctgtcctctagcgctaacttgcgcacgtaggtcatggtcagctccgaggctaggttagccaccatggacatggagaggcaggcggtcttcatgtcgatcagcaggtgctggtcgatgaccggatcggggatggtgaaggtggcgtcgcgaaaagtaatggtctgcagctgctgcacggcagcctttacctcctcgtacgaacggtcgagcgagaagaggcccatgatgagtagtcgctggttgatttccagcgccagtggcatgggtacgatccagggcagcaccagctcccactggcccagcgtcagcaggttctcgcgcgccagcggtccgtggaagagcggcggcagcacgcatagcgcgtcgcccttctcccaagtcacgggtcccgtgttgaggacggtgtagagcagtccgtgcgtcggtacgtgtaggaggatctggttgccttctacgcgccgcatcaacgtcagcgtcatattgcgcagcaggccgcgcagtcgtacgtagccgcgggtgtgatctacgaactggtgtaggcccagctggtagtgcttgatgagatgtagacgctgcggaatgggcacaacggccgctactagtttggtcagtttgcctacgtcggcgatgctgagcttgtggtcgaaagtgcagaagatgttggcctccatggccgccatagcggcggtgaaatcctggccgcgacggaggagaagcggagacgaacaacgtctgcaccgggcgcggcgtcagagcgagcgtggcgcgtccgggcccgcgtttgcgtctaggtgactcgccgctaacctgcggtcgtcgccgtcctcctcaccggacggcctcacgagttaaataacatggattgctgcagcgggatgatttcgcctacgacgtagttaccaaagtgcgtttcggacgtagcaaaagccccggcgccacccttgagtttggtctccatcagcgccagcgtggtggtgctgaggatcggtagcgcttcctgcgtcagacggcacgggttttcgatgagttgttccgtgccttcgacgcagacgtactgcgtgtccgtgtcgccgcggatgcagtccttggcgcgtagcaggtactcgtcgatggttttgaagagcgttttgttggccgcgataatctcttctgtgttaaagtactgcgcgcaagggctgtagaatttggagttgtagcctagacgttcgcgatgtcgggtgttgtagagtacgtcgctcagacagccggcttgcgaggcccaggggttgtgtgtggccgcgaaagtctgtgcgtccgcttcgcgatggtcgtagatggccttggtggcggcctccgtgtcgtacggatcgacggccagcatgcaggaggcacgcccgcgcgggttgttggggatcttaaagtaattaacgtccatcgtcaccggcgtaaggattagttcgcacgcggccttttgtccgtgcaccgtggcggcggcattgcgctcggacatgctgccgaacgtcagcatggagatggtctccgtgtctaacagttgcggccgttctacgccggccgcgtgccggatccagcggtccacctcgtcgtgccggtacacgttcatagggaagacgcgaaagaggtcctgcacgcggacgcccatgtcggttcgcacgcggtttacgtaggctacgcaggtatttgacgtgtaacccagacccatgtctacggtgttaatgttctgcgtgacgtggtacgtggtgctgatgtcgcgttcctccttggtcacgatagggttgttgatgataactgacgtgcatgatttgccgctgtagagcagcatgtccacctcgaaggtgtcggtgcgtacggccgtgagtgcgaatcccgggtggatgtgcgccttggtctgcagcaccagtgaaactggtgagattttgtataacatggcggccagcgtcatgactgagtgcaacacgttgggacaggtggccgagtaacgcgaaaagggcgagcgcagccagttgtggtactcgtgcgcgaaggctgtgggtagcgggaaaccaccgtcgtgacggtgatagtgcgggaactcggtcacgtagcgtttaatgtcgtcgctcaacgccgcgcagatggtggggtttgagtagaaacggtggaaaggtacgggtaggctgtactcgatcaacgtcttaggcgccgtcacgacgcagcagccgttgtaaagcacgtgctgacgtgagataaagtccggcaggccctgacgctgcgcgtggtccagaggcgcgcgcacttcgagcaccttgacgtgctcgcccacgaattgcacggccaaaaacagttcacgacaggcctgcagcagcggcgtatgtgcgtcggtggcgacgtcctccaccagctcggtcagcatctcgcctacggcttgacgttgcgccgctatcgagtcttcgggggtgacgccgcttgtgctctctttcgacgtcgtacctgacgtggagaccgcggtggcggccggcatcaggagaaacgccggtcggtaaaagaggtctactagcagcgtcttgaggttgagtcccaggccgcaggcccggttgttggtcatggcgggcatgaggcagagataaaagaccttttgtaacgtccattcgtcgtcggtggcacggtaatcgtccacaaacagcggctcgtcggcatccatggcgcccaaacgcggtacgtccgaaacgccgtggtgtcgcgcctcgatgttggccgggttcaacggttgccggtcggccactacctgtacgccttccatgttacgcggcaggtgcgtaacgaaggggggccacagccggtggtcgtgcagcgcgttcacgtaagccgatagcggttcctcagccagttgaccgttgttaagtcccggcagcgctgagatgcgcgttaccagacgcagcacggcgaccagattgcggtagtgaaagagcaactgcggtggtagggcgccatcagccaggtgttcggcgatcaacgtcaccagcgcgtagctgtgcgcaaaaaccagcagctgacgtgtgtgaaacatgttgacgatacaacgtgctacgaaagtgcggattagcaaaaaagcgtcgacgttgccgtgtaccagcacgtcgaccaggtagcaaagctcggggtaattggggcttgtaacggtggttttgaaaagtcgcaacgtctcttcgtagtcgggtggtggccgcagtcgcatgtgttccatgatctcccaggtgcgcagttcgtggaaggggcccggtgccagtccatctggcaaattaccgatgacgatacgcggtgtacacagcgccaccgtttcgctgttttcctggcagtgcgtaaagtcgaagaaggggtgcagctcggtgtagagcgtgatgttgcccaccttgtagaagtcggtgaccacaaagtcctgcttcatttcgttcaccgtgcgcgggacctcgcgtcgtacgcggtaaaaatgcggtatgcggcgcgccgcaccgcccatgggttcctgctgaaaacgacactcgagcagtcgttgcatggcgggttccgagggtggtccgcgttccgtgaaggtctgtagacagggcgcgggctcgtgcagcaccgggtggcacagcgtcttgagcgcgtccacaaagtctattttttgtacggcacggtcccggtttagcaggtaggccgtggtgggcaacgcgttgcgaacggtgtcgttaagcttaactttgctttccaccgtggtgtaaccgcgatcctcgggcagatacagccctacggggaagaaaaacgtcaggtccacgttacgttctagcggatctttggtatcggtgtttttgtagacgcgccgcaagttttccataatcaccgttttttcgcccagtcggatcacgtccatgctcagcggcgttaagctgtgcgccccggcctgcgaaagcgagtcgttgggcaaatgcggttggcccgaagtcagatgagccttgtacgagttgaaatcggccaggatcgagtgataggatatggcagtgacggcattttcgggactgagtacaaaattgccgtaggtggccggcgccgagaccgtttctttggtgatgtggcttgagagcagcgacatgatgatctgcataacgttggccgtgcttaccatcacgccactgatcttggcccccgagctcgtggtgtacgtggtggggttgtctaggatgctatcggtggccgcttcggccagacgcgtgaggaacttgagcacatagtcgcgatcgcgcgtgcgattcagcaaaaagagcgtggccagcattttggccttgaagctctgcaagatgttgcttcgctggatgcggttcagcgcctgtcgcgccagcgtggcgttctctaccagcgtctgcaccacaaagtacggcggcgccttgcgtagcagtgtctgtaaaaagctgtgaatcaagccgcgttccatggcgtcggccgtgtttttgagcgcgcgcagcaccgtgtgcatagcttccacgttgaggatcttgtccaggatggtgccttcgaacgtctcgcgcagatacgtgaggcaggctgcgctgagctcaaaggggatggtgatgggggatttttcactgtatttggtgaccataatggtggtctgacgactggtaggcaaaccggcgccgctggccacccgcggcacctgtacgtggaacagcatttttcccgtagtcagtttattgaggtcgtggaacttgatggcgtgcgccgccgcggccaagccgctggtcaaaaaataaacccattccaggcgattgcagaaggtgccgaagatggcttcgaagtgaatattgtaacgctcggggtcatcgccgtagtagatgcgtaaggcctcgaacatctcctcgccggcgctggtcttgacgtgcgtcagaaagtcagtgggaatgcctactttaggcaggagctcgagcgccgaccagttctccatcgcggcggcggcgtgagcgcgaggcgtcggagctcggggaaagcagcgcgacccggagaatggccggcgctgcgccgcgccgcctcggctgtgacgctctaatagtcgtcggcggctccgctatgccgcgccgggttttacacgtccccgtgcacgttcgcgcctgcaacctcacccaagagctatcgacgggcgaggacgcccgcttctgtcgtccgcgacccgttaacgtcgaacgggtgcgcgctgtttttgcggctctctaccgtgcctgtccgatacacgtgaggaccgaacccgagcgtgtcaagctggtactgggtcgtctgttactgggacccgtggccgtaccctgtttttgcgacggtgaagtggagggccacggtgaacatctggtacctacgacgcagttttgtcgcgggccgctgctctacgtgcaccgacgttgttgttgcggatccgtgaccgccgggcgcgcgctgtcctaccacgttctcgaaaaccacgtggccacgcatgtgctacgcggattgctctcgctgacggaatggaatcgagaattgccgagcctcttttgcgactgtcctggcggcggtggcgcctcgggaaccgaggaacgctacgctatggcctgcctgccgcgcgacctcagcctgcacctggacgactatccttacctgatggtggaaatcggacgcgtactcagtgtcagcgaggtagacgactacgtaaccgccgtctccggctacctgggcgaggccgcggcgccgcgcatccaggttcactacaagctgctctttggactcaacgtgcgtccgcaagcgccgtgcgcgttggacgctacacgcgacttttttctgctggagctgcaaaagctttggctgggcgttgaatatcaccacgaagtgacgtcggagtttttcggtcgcgtgctggctcagctgcatcgcgaccgcgcccgcgtcatgatggcgcttcgcttgcccgagcagacggtgtgccacctgagcaccttcgttctcagtcgcttcaagcgacaggtactgtacttcaagttacaggtgagctacggcaagtgccggactggccacgctgacagaagtgggggagggggaaacggtggaaatcagggacaccacaacctgctgtgttatcgacgccttagcgtcacgtttgccgacacggacacggtgtggagaaaccttttctacgtttattatgaactagctcgggatctggggtcccatgggacagagaaccgacccgtaaaccgcggttacggtgtttcttgcgctccgaggacgtcgcggctatcaccgtcagaatcgacggtggtttcggcgaacggacacgcgctgtcttccaccgcgctcccgacgacgagcgcgggtcacaagctgtcactgccgcgcgacccggccgccgatcgcgttcgacgttacgtgtgcatcatctcgcgtctcatgtacgctcggtacggggagagatggcgtaaacaccgtcaacggcggtcggagacgggagaagaggaggaggaagagacgctggaatcgggggagactgacgccacgccgccatttgactttacggggcagcagctgcgccgggcctatcaggaacaccgacgtcgtaaacatctagccgtgcagcgttacgcgccgtgtcgtcgtaagctcatcggcgggatggagtttgccgaggtgacgggcgtgagtctggaccgcatcgccgtcaacgctttcaacaccaaccgcgttatcaatatgaaggccgcgctctcgtccatcgccgcgtcgggtctcggcgtgcgcgcgccgcggcttcccaagaacatgacccacagttttgtgatgtacaagcacacctttaaggagcccgcttgcaccgtcagcacctttgtttccaacgacgccgtctacatcaactcgctcaacgtcaatattcgcggttcctaccccgagtttctgtactcgctgggcgtgtaccggctgcacgttaatatcgatcacttttttctgccggccgtggtgtgcaacagcaactcctcgctggacgtgcatgggctggaggaccaggcggtgatccgctcggagcgcagcaaggtgtactggaccaccaactttccgtgcatgatctcgcatactaacaacgtcaacgtgggctggttcaaagcggctacggccattgtgccgcgcgtctcgggcgctgacctggaagccattctgctcaaagaactctcgtgcatcaagaacatgcgcgacgtgtgcatcgattacggtctgcaccgcgttttcacgcaactagagctgcgcaattcgtaccagatccccttcctggccaagcagttagtgctgtttctgcgtgcttgcctgctcaagctgcacggtcgagagaagcggctgcagttggaccgcctagtatttgaggcggcacagcggggtctctttgactacagcaagaacctcacggcgcacaccaagatcaagcacacttgtgcgctcatcggcagtcgtctagccaacaacgtgcccaagatcctggcccggaacaaaaaagtcaaattggatcacctgggccggaacgccaacgtgctgacggtgtgtcggcacgtggaagcccacaagatccctcgcacgcgcctcaaagtgttagtcgaggtgctgggcgtgttgcagagtatcagcggtacgccgcacacgcgcgaagtgatccaccagacgttgtttcgattgtgctcggcggccgcagccacatcgggcctgtgttcatcccctcccccattgtgtgtgtcctcatcttcctccgtcccttctgtcccaacctccgtcagcgttgacggcagttctgaacccacgtcgccgcgagtgcggtttgcatcacgatgatggaagccgcggccgctgccgccgcggcgtttcgtccggaggagcgtccgacgccgggttggcacgacgcggcgttgttaatggacgacggtacggtgcgcgagcacgcgtttcgcaacggaccgttgtcgcaactgattcgccgtgtgttaccgccgccgcccgacgccgaagacgacgtggtttttgcttccgagctgtgtttttattgcagcggtcgttttaaccgcaggtcgtccgtcttctccatctattggcagaagcatagcgatctggtgtacgcgcttacgggcattacccattgcgccaagttggtggtggaatgcggtcagttggggagtagtaggctacggtggcgcgacggtgatgcgagtggtgaggagcgccggggagacgacgacagcagggacgagctgtacgacgtgccgggcatttatatgattcgcgtcaacgacggcggcagcaccggccccagacacgttatttggccgggtaccagcgtgctgtgggcgccggacgttgtgatcactacggtgcagcgacgaatctcggcggcgcgcgccctggtgaacacgttccgccaatatttttttttgctggaacggcgctcgcacgaggagctggttctttgtccgcccgagatggaggagcgtctagcgccgttgttgcagagtgccacgcgaggtgattcggacatgtttgacggtgtggtggccagcgcttatcaccgtttgcgaatgagtaatattccgcgttcatccgcccgtctgctggagcactgcgtggggctggcgggtgctaagaagctgctcttgctcgacgtgccgcgtctggagaactattttctttgtcaagtctgtctttacgagttggacgaggacgagatgggcgaggagatgctgggcatgttggccggaaagcccgaggatgccgccgtctcgggcgcaagcggcggttttctgctacatcgcaagacgatgaagctggccgcctgtctgtgtttgttgctcaattcgctgcatttgcaccaggaggcgctggaggccttggatcctccgccgccgcgcgtcgaggagaacgaccttgtcaacgtggtgctgcgccgttattatcgcagtcacggcggcgtgcaggcgcggacgctggcggcggcccgggctttgttagccgactacgctgaaacgttttcgcctttggggagttttacgcgcctgggttacgatcgtctcgtttctgccgatgccggcgtcagtcgccggcacctggtggctctgctgcgtgcctagctgaccctgaaacggatggcgtgtatatcgtcacacaggtaggtggccatgatgacggcgatgataagatcgtccgagatacgattctggcgcttggccgagtagcgtgccgtcgtgccttcggccagcgtgacgcggtgcaggttctgaatctgctccagaagatactcgatggggtcgtggctcagcttgatggtgtaggagacgagctcttgcgaggctttgatgtagcccgagttgaaacgcgagatgaactgttccacggccagcgccttgtcgcggcccatgaggtagaagggctgttcgatgtggttctggtcgggcgtgtggtagaagagcacgcggatgagcgtgctgctctgcacgctctgtcggatgaggcaggcgatgcgcacggccgccgcctggttggtgttgccctccacggcgatacgcagttcgtccaggtaagggtgcaggctcagcaccgagatgatcatgtgcgccgcgcactcggcgatggctacctcagaactctcggagaggtcgcgcaaaaagaaatgctctaggccgtaaatgagaaactggtgtcggtaggcgcctacggccgccacgcccgtgcccgaggccttgcggttggtggtgaaggccgggtccagatacacgtaaagcgtcttgccgaaataatcgtaggcgttggtgttgagcgtgctgtaacgcaaaatatcgaactcttcgcggctctggtccgtgatgagcacggtgttctgcgagattttattggtaccgccgatgatctcgtccatgaaagcgcccggcataaacatgttggccgtcttgcgcacctgcgagttgaggctgatgaaggtgggcttgtgcagtcggtagcaaggacacgccgtggcgtcgcccttctccgtgaagctgtgcaggtgctcttcgcacacgtaagagaccacgttgagcatgtcaaagggcgcattgttgaggcgcgtcaagaaacacgtggcgtcactggtagtgttggtggacgatatgaagatgatcttggtggtattctgggccaggaaccccagaatggtgttgaaggcctctttcttgatgaagtgcgcctcgtccaccagcagcaaatggaagttttgtcctcggatgctctgtgtagagaggagacagaaaagggactcttatgattacgcacgctcggctggaagcctacagagtcggggtggggccggacaggtgagccaggtgagccgccaggtgaggcgggatcgccgtgtgccaaccgggctgcgacctgaaaaccggaaccaatccgccgacaccggcgccgcgtgacgcgcgcccataaaaacgaaagtgtcgtcgtcgcgacccgccacagccgccatgaactcgttgctggcggaactcaaccgactgggggtcgcgcacgccactacggaggatgtttttatctttgtcgaccgcctctttcaacacttttccttccttttccaggccgaggagtcaggcccgcgccgcttggaactggtcgcgtccgtgttcgagcacctgacggtggagtgcgtcaacgacatcctggacgcctgcagccacccggacgtgaacgtcgtggagacaagcaacacctgtcgtccctgcccttctcctgttccctccgcccccaaaactgtcagcgacgctcagacgtcatgtgcgacgcctcgggcgcctgtgacatgaggcacgtccagaacgcgtttaccgaggagatccagttacactcgctctacgcgtgcacgcgctgctttcgcacgcacctgtgtgatctgggcagcggctgcgcgctcgtctccacgctcgagggctccgtctgcgtcaagacgggcctggtatacgaagctctctatccggtggcgcgtagccacctgttggaacccatcgaggaggccgcactggacgacgtcaacatcatcagcgccgtgctcagcggcgtgtacagctacctcatgacgcacgccggccgttacgccgacgtgatccaagaggtggtcgagcgcgaccgcctcaaaaagcaggtggaggacagtatttacttcacctttaataaggttttccgttctatgcataacgtcaatcgtatttcggtgcccgtcatcagccaactttttattcagcttatcatcggtatctactcaaagcagaccaagtacgacgcgtgtgtcatcaaggttagtcgtaagaagcgtgaggacgcgcttctgaaacagatgcgttccgaatatggaaacgcacctgtattcggatctggcgtttgaggcgcggttcgctgacgatgagcaattgcctctacacctggtgcttgaccaggaggtgctgagtaacgaggaggccgagacgctgcgctacgtctactatcgtaatgtagacagcgctggccgatccgcgggccgcgttccgagcggagatgaggacgacgcaccggcctccgacgacgccgaggacgccgtgggcggcgatcgcgcttttgaccgcgagcggcggacttggcagcgggcctgttttcgtgtactaccgcgcccactggagttgctcgattacctacgtcaaagcggtctcactgtgacgttagagaaagagcagcgcgtgcgcatgttctatgccgtcttcactacgttgggtctgcgctgccccgataatcggctctcaggcgcgcagacgctacacctgagactggtctggcccgacggcagctatcgtgactgggagtttttagcgcgtgacctgttacgagaagagatggaagcgaataagcgcgaccggcagcaccagttggctacgaccacgaatcaccgtcggcggggcggactgcgtaataacttagacaatgggtcggatcgccgtttgcccgaagcggctgtggcttctctggagacggccgtcagtactccattttttgaaattccgaacggagcaggaacctcctccgcgaacggcggcggcagattcagtaacctggagcagcgggtagcgcgtttgttgcgcggcgacgaggaattcatctatcacgcgggtccattggagccgccttccaagatacgcggtcatgagttggtgcagctgcgcctggacgtaaatccagacctcatgtacgccaccgatccgcacgaccgcgacgaggtcgcgcgtacggacgagtggaagggtgccggtgtctcgcgtctccgcgaggtctgggatgtgcagcatcgcgtgcgcctccgtgtgctgtggtacgtcaattccttttggcgcagtcgcgagctgagctacgatgaccacgaagtcgaactataccgggcgttggacgcttatcgggcgcgcatcgccgtcgagtacgtgctgattcgcgccgtgcgcgacgagatctacgctgtactacgacgggacagcggcgcgttgccacagcgtttcgcctgccacgtgccacggaacatgtcctggcgcgttgtttgggaactttgccgtcatgccttggcgctctggatggatcgggcggacgtgcgtagctgtattattaaggcgctaacgcctcgtctgagccggggtgccgccgctgccgctcagcgagctcgtcgccagcgcgagcgctcggcgcccaaaccgcaggagctgcttttcggaccgcggaacgagagcggtccgcccgccgaacggacttggtacgctgacgtggtgcgctgcgttcgcacgcaagtggatttgggcgtggaagtgcgcgcggcgcgttgtcctcgcaccgggctttggatcgtccgtgatcgccgcggacgcctgcgacgttggctctcgcagcccgaggtgtgcgtgctctacgtcacgccagacttggacttttactgggtgctgccgggcggctttgccgtctcttcgcgcgtcactcttcatggcttggcgcagcgggctttgcgagaccgattccagaactttgaagcagttcttgcaagaggaatgcatgtggaagctggtcggcaagagccggaaacaccgcgagtatcgggccgtcgcttgccgttcgacgatctttagtccggaggacgacggctcgtgtatcttgtgccaattgctgttgttctaccgcgacggcgaatggatcctctgtctttgctgcaacggccgttatcaaggccactatggcgtgggccacgtacatcggcgtcgtcgacgcatctgtcatttacctaccttgtaccaactgagcttcggaggtcctttgggtccagccagcattgatttcttgccaagctttagccaggtgaccagcagtatgacgtgcgatggtattacgcccgacgtgatttacgaggtctgcatgttggtgccccaggatgaagccaagcgcatcctggtcaagggtcacggtgccatggacctgacctgtcagaaggcagtgacgctaggcggcgccggcgcctggttgctgccgcgtcccgaaggctacacgcttttcttttacattctgtgctacgacctgtttacctcatgcggcaatcggtgcgatatcccttccatgacgcggctcatggcggcggccacggcctgcgggcaggcgggttgcagcttttgcacggatcacgagggacatgtagatcccactggcaattacgtgggttgcacccccgatatgggccgctgtctttgttacgtgccctgtgggcccatgacgcagtcgctcatccacaacgaggaacccgcgacttttttctgtgagagcgatgacgccaagtacctatgcgccgtaggttctaagaccgcggcgcaggtcacactgggagacggcctggattatcacatcggtgtcaaggattctgagggccgatggttgcccgtcaagaccgatgtgtgggacctggtcaaggtagaggaacctgtgtcacgtatgatagtgtgttcctgtccggtgcttaagaacctagtgcactaacggggtctgacagttcacggggagaagaaacaagaaacaacaaaaaaaaaagaggacatggactcgccacggtttgtggcaaggcgtatattatcatcatggagctactcacgttggtgttgtagcaactggcaaaaagcgccgtgctcttggcgccgcggtggtcgatgctgatcacgttgtccttgttctcgaccacgtagtcgcgcgcgaaggtgtggcggcagcggaactcgacctctttgagcacaaactgcgacacgtgcttttggtgcgccacgtagccgatgctgatgccgatcatgtgcttaagcagaaacgagataatggggatgatgaaccaagtcttgccgtgacgtcgcggcaccaggaacacggtggctttctgcttaaagatgtcgatggaggtctgcgagaggaagtcgatctggaaggcgtggatgaggtactgcagcacgcgattggccagcacggggatcttggtcacggctataaaaaagatgacgtgtatcaataaattcttttgaaacggttcgagtcggatggcttttgcgtcgccctcgacggcggtactgaagccgccgtcgagccactttttaaagtcggtcatgaagttgttgatctgctgaaactgcggatcgcggtagagctcggtcaacgcgtccagcttctggtaggaggcgcgctgctcctcggagcacgggcgaaacgtcagttcatcgagcgcactcttgaggcgctcgtgaaacagcagctcgcgctggctttcctcgggcgagttgtagtcgcggtggcggccgcagaaggccatgagcggcaggaaggcctcgttgcacgagtgggccagcccgagttcggggtgcatcatctggtagcgcttgcggcacagcgccgccacattggtgaaggccgtggagatgcaggaggtggggtggctcttgcgcttctgcagctccgcgtagcgctcctggatcttggcggccgaatctccgcgcaacatgatggcggcggcggtggtgcgagcggaggttaggcggcagcggcgagaggagaggaaaaagatggcgtccgcgaggacgacggaggatccacctgaaaaccacgttgtcgcggacgtggcttgtgggacgggcgccgtcactcgttcgtcttcgtcgtccctagtggtgtcgtcttcctcggcgtcaggctcagacgaatcttcctccgcctctcctctcagtttccccgtctcctctccctcaactgccgtcaggtctccggggtccgccggggtttcgacgtccctgtgctcggtggaacggatggtcgagctgtcggcgcagtctccggccgccgatttctcggtctccgaggcttggcgcttcgaggaggccgtaaatatggcgctggtggcctgcgaggccgtgtcaccttacgatcgctttcgtctaattgaaacgcccgacgagaatttcttgttggtcaccaacgtaattccgcgcgagtcggccgaggtgccggtgttggatagcagtagcagtggtggcgatagcgggccggaggacaaaaagaaaaacgtcgggaataaaaccgcgggggaaaagaacggcggtgggtctcgggccaaacgccgtcgtagacgacgcgctccgaaaaacgacgccgccacgccgtcttttctacgtcgacacgacgtgctggagcgtttcgcggccgcggctgagcctttgccgtcgctttgtgtgcatgattatgcgttacgcaatgctgaccgtgttacctacgacggcgaattaatctacggcagttacctgttgtatcgcaaggctcacgtggagctgtcactctccagcaacaaggtgcaacacgtggaagccgtgctgcgacaggtgtacacgccgggcttgttagatcatcacaacgtgtgcgacgtggaggccctgttgtggctgctgtactgtggaccgcgcagcttttgcgcgcgtgacacctgtttcggtcgcgaaaagaacggttgtcctttccccgcgttgttgcccaaactcttttacgaacccgtgcgggactatatgacctacatgaatctggctgagctgtacgtctttgtttggtatcgcggctacgaattccctgcgccaacgccgcaggcgacgacggcgggtggtggtggtggtggtggtagtggtggcggcggcggggccggcgcttgtgcggtcgagacgagcgcgtcagcaggccgggtcgatgacgccggcgacgaggtgcatttgcctttaaagcccgtctcgctggaccgtctcagagaggtgttacaggcggtgcgcggccgcttctcggggcgcgaggtgcccgcctggccggcctcgtcgcgcacctgtttgttgtgcgcgctctacagtcagaaccgtctctgtttagatctcgcgcgtgacgaggcgcggaccgtgagttatagccccatcgtcatccaagactgcgccgcggctgttaccgacgtcactttgagccacatcttgcccggccagagcaccgtctcgcttttccccgtctaccacgtcggcaagttgctggacgctctctcgctgaacgacgcgggtctcatcacgttgaatctatgacgtcggtcaacaaacagctcttaaaggacgtgatgcgcgtcgaccttgagcgacagcagcatcagtttctgcggcgtacctacggaccgcagcaccggctcaccacgcagcaggctttgacggtgatgcgtgtggccgctcgggaacagacccgatacagtcagcgaacgacgcagtgcgtggccgcacacctgttggagcaacgggcggccgtgcagcaagagttgcaacgcgcccgacagctgcaatccggtaacgtggacgacgcgctggactctttaaccgagctgaaggacacggtagacgacgtgagagccaccttggtggactcggtttcggcgacgtgcgatttggacctggaggttgacgacgccgtctaacaggtatagcaatccccgtcacgcctctgttcagattttattaaaaaaaaaacacaccataacgacagtgtcggtgtggtagctagtgcagccctaggaacagggaagactgtcgccactatgtcctccgcacttcggtctcgggctcgctcggcctcgctcggaacgacgactcagggctgggatccgccgccattgcgtcgtcccagcagggcgcgccggcgccagtggatgcgcgaagctgcgcaggccgccgctcaagccgcggtacaggccgcgcaggccgccgccgctcaagttgcccaggctcacgtcgatgaagacgaggtcgtggatctgatgaccgacgaggccggcggcggcgtcaccactttgaccaccctgagttccgtcagcacaaccaccgtgcttggacacgcgactttttccgcatgcgttcgaagtgacgtgatgcgtgacggagaaaaagaggacgcggcttcggacaaggagaaccagcgtcggcccgtggtgccgtccacgtcgtctcgcggcagcgccgccagcggcgacggttaccacggcttgcgctgccgcgaaacctcggccatgtggtcgttcgagtacgatcgcgacggcgacgtgaccagcgtacgccgcgctctcttcaccggcggcagcgacccctcggacagcgtgagcggcgtccgcggtggacgcaaacgcccgttgcgtccgccgttggtgtcgctggcccgcaccccgctgtgccgacgtcgtgtgggcggcgtggacgcggtgctcgaagaaaacgacgtggagctgcgcgcggaaagtcaggacagcgccgtggcatcgggcccgggccgcgttccgcagccgctcagcggtagttccggggaggaatccgccacggcggtggaggccgactccacgtcacacgacgacgtgcattgcacctgttccaacgaccagatcatcaccacgtccatccgcggccttacgtgcgacccgcgtatgttcttgcgccttacgcatcccgagctctgcgagctctctatctcctacctgctggtctacgtgcccaaagaggacgatttttgccacaagatctgttatgccgtggacatgagcgacgagagctaccgcctgggccagggctccttcggcgaggtctggccgctcgatcgctatcgcgtggtcaaggtggcgcgtaagcacagcgagacggtgctcacggtctggatgtcgggcctgatccgcacgcgcgccgctggcgagcaacagcagccgccgtcgctggtgggcacgggcgtgcaccgcggtctgctcacggccacgggctgctgtctgctgcacaacgtcacggtacatcgacgtttccacacagacatgtttcatcacgaccagtggaagctggcgtgcatcgacagctaccgacgtgccttttgcacgttggccgacgctatcaaatttctcaatcaccagtgtcgtgtatgccactttgatattacacccatgaacgtgctcatcgacgtgaacccgcacaaccccagcgagatcgtgcgcgccgcgctgtgcgattacagcctcagcgagccctatccggattacaacgagcgctgtgtggccgtctttcaggagacgggcacggcgcgccgcatccccaactgctcgcaccgtctgcgcgaatgttaccaccctgctttccgacccatgccgctgcagaagctgctcatctgcgacccgcacgcgcgtttccccgtagccggcctacggcgttattgcatgtcggagttgtcggcgctgggtaacgtgctgggcttttgcctcatgcggctgttggaccggcgcggtctggacgaggtgcgcatgggtacggaggcgttgctctttaagcacgccggcgcggcctgccgcgcgttggagaacggcaagctcacgcactgctccgacgcctgtctgctcattctggcggcgcaaatgagctacggcgcctgtctcctgggcgagcatggcgccgcgctggtgtcgcacacgctacgctttgtggaggccaagatgtcctcgtgtcgcgtacgcgcctttcgccgcttctaccacgaatgctcgcagaccatgctgcacgaatacgtcagaaagaacgtggagcgtctgttggccacgagcgacgggctgtatttatataacgcctttcggcgcaccaccagcataatctgcgaggaggaccttgacggtgactgccgtcaactgttccccgagtaacctggacgcggaacgtgacggttgccgaggggaaaggcgacagagaaggtacaaacccaccggcggggaaaatactgaggcgccgccatcatcatgtggggcgtctcgagtttggactacgacgacgatgaggagctcacccggctgctggcggtttgggacgatgagcccctcagtctctttctcatgaacacctttttgctgcaccaggagggcttccgtaatctgccctttacggtgctgcgtctgtcttacgcctaccgcatcttcgccaagatgctgcgggcccacggtacgccagtagccgaggactttatgacgcgcgtggccgcgctggctcgcgacgagggtctgcgcgacattttgggtcagcggcacgccgccgaagcctcgcgcgccgagatcgccgaggccctggagcgcgtggccgagcggtgcgacgaccggcacggcggctcggacgactacgtgtggctcagccggttgctggatttggcgcccaactatcggcaggtcgagctcttccagttgctggaaaaggaatcgcgcggacagtcgcgcaactcggtgtggcatctgttgcgtatggacacggtctcggccaccaagttctacgaggccttcgtcagcggctgtctgcccggcgccgcggcggcggacggttcgggtggcggcggctcgcactacacgggctcgcgcgccggcgtctcgccgggcatccagttcggtatcaaacacgagggcttagtcaaaacgctggtggaatgttacgtgatgcacggacgcgagccggtgcgcgacggcctcggtctgctcatcgaccccacgtcggggctgctgggcgcttccatggacctgtgcttcggcgtgctcaagcagggcagcggtcgcaccttgctggtggaaccgtgcgcgcgcgtctacgagatcaagtgccgctacaaatatttgcgcaaaaaggaggacccctttgtgcagaacgtgctgcggaggcacgacgcggcggccgtggcctcgctgttgcagtcacacccggtgccgggcgtggagtttcgcggtgaacgcgaaaccccgtcggcacgcgagtttctgctttcgcacgacgcggcgctcttcagggccacgctcaagcgcgcgcgcccgctcaagccgcccgaaccgctgcgcgagtacctggccgatctgctgtatctcaataaggccgagtgttcggaagtgatcgtgtttgacgccaagcacctgaatgacgacaacagcgacggggacgccacgatcactattaacgcgagtctcggcctagccgcgggcgacgccgctggcggcggcgctgatcaccacctgcggggcagcccgggcgattcgccgccgccgatacctttcgaggacgaaaacacgcccgagctgctgggccggctcaacgtgtacgaggtagcgcgcttttcactgccggcttttgtcaatccgcgtcaccagtattactttcagatgctcattcagcagtacgtgctcagccaatactatataaagaagcatccggacccggagcggatcgatttccgcgacctgcctaccgtctacctggtctcggccatcttccgcgagcgcgaggaaagcgaactgggctgcgagttgctggccggcggtcgcgttttccactgcgaccacatcccgctcctgctcatcgtcacgcccgtggtctttgaccctcagtttacgcgccatgccgtctctaccgtgttagaccgttggagtcgcgacctgtcccgcaagacgaacctaccgatatgggtgccgaactctgcaaacgaatatgttgtgagttcggtaccacgtccggtgagcccctgaaagatgctctgggtcgccaggtgtctctacgctcctacgacaacatccctccgacttcctcctcggacgaaggggaggacgatgacgacggggaggatgacgataacgaggagcggcaacagaagctgcggctctgcggtagtggctgcgggggaaacgacagtagtagcggcagccaccgcgaggccacccacgacggccccaagaaaaacgcggtgcgctcgacgtttcgcgaggacaaggctccgaaaccgagcaagcagtcaaaaaagaaaaagaaaccctcaaaacatcaccaccatcagcaaagctccattatgcaggagacggacgacttagacgaagaggacacctcaatttacctgtccccgcccccggtcccccccgtccaggtggtggctaagcgactgccgcggcccgacacacccaggactccgcgccaaaagaagatttcacaacgtccacccacccccgggacaaaaaagcccgccgcctccttgcccttttaactcataaactttcaggtctcgcgtacgattcgcgagtcgggaatgggacacccgtgggtgtttctccgtgtgtatattattttttttttttgtgtgtttgcgcccccgtgtgtctaatgtgctgtttgaaacacgtaaagtagctggtggaagaacagataaacctttaataaaaaaaaaagtatgtgctcccgacccacggtctgcgtgtctcttttttatgtccatgtctccaagtctggtgcgggtggcggcggggttaagcgtcctcgaagtcttcatcatcgtcgtcctcttcttcgcggaggcgacggctttccaagctgtcgtggtgactgagcgcagcgacttcttcgccggaggctgtggccagcgcctggtacttgacactgccgctaccgcgtccgcgaaagtagcggacggcgcgacacgtcgtaaacatggcccatatgaaaaagagcatgccgaacgaccagctgatgccggtgcggtattcgttgctgaggaaggtatcgtactgcacgatggggtagatgaggccgcagagtccaaagaaggcgcccaggtggtagccgaattgcaccttgacgtattgaaaaaagacggcctcgatcagtaaaaagtagatgatggagatgatagcgtagaccacgaagacggctaacaccatgtggcctgtacgcacgaaaaagttgtttccgaagccgtagcacagggccatggctaccacggtggtgttgaaaccaagcgctacctctaccaggttgacgatgagcgtgcggaactgcaccgtacctttgagcttggggtgcagacgcgagaagaaaaagagtgagcgtttgtagctgcggtactgcgtgaccatgctcacgttgaaaatggtcaggcagaaaaagtgtacggcggccatgaaggcgatcatgctgggcagccgaaatgacatggtcagtgtgaatagttggaacgtgtccatgctgagaatgaagaggaaggctgtgaggctgtcgcccatgtacgaaatgtcgcgtgtcgactggtttaggctcatgcctttgtccttgcgcatgctgatcttgatccagcataccaggtagtagatggtcacggctaaaaagacgagctgcatgaacacggcgtagcacaccaactgcaccgagtctaagaaaagcataggcgtgtgcaggtgcattacgttgtaggccgacatgttgagcctttcaaagtccacgacgtgatagtagacgcaggggtagcccaggtgcggaaaattgctcagcactagatgcacgctgacgttgacaaaagtcagcaccatgaaaacgatagaagcgctccatgtccgtgtattcaccttatccacgtgcgagggggccatggcgatagcggcggcccgctcgctcgggaggcgatgggggcgcgccgatgacgacaggctcgcgggtcgttaaatactacgatgggagccgccgcggctcacgacgcggtttgagcacgtccgggcggtcggtgaaaaaagaccccgcgggccttcgcgactctcttctgtccgaggatgaccgctcagccgccgctgcaccaccgccaccacccgtacaccctgttcgggaccagctgtcatctcagctggtacggccttctagaggcctcggtgcctatcgtacaatgtctgtttttggatctgggtggcggccgtgccgagccgcggcttcacacgttcgtggtgcgcggtgaccgtctgccgccggctgaggtgcgtgctgtgcatcgcgccagctacgctgcgctggcctcggccgtgactacggacgccgatgagcgtcggcgcggcctagagcagcgtagcgccgtgttggcgcgcgtgttgctagaaggcagcgcgttaatccgcgtgttggcgcgcaccttcacgccggtgcagattcagacggacgctagtggcgtggagattttggaggccgcaccggcactgggcgtggaaaccacagcgctgtcgaacgcgcttagtcttttccacgtagccaagctagtggtcatcggctcgtatcccgaagtgcacgagccgcgtgtggtcacgcatgccgcggaacgcgtctctgaagagtatggcacccacgcgcataaaaaattgcgtcgcggttactacgcctacgatttggccatgtcgtttcgcgtcggcactcacaagtatgtgctggagcgcgacgacgaggccgtcctggcacgcctctttgaggtgcgcgaggtgtgttttttgcgcacctgtctgcgtctggtcacgcctgtcggtttcgtggccgtggcagtgaccgacgagcagtgttgtttattgctgcagtcggcctggactcacctttacgacgtgcttttccgtggtttcgctgggcagccgccgctacgcgactacctggggccggacctctttgagacgggcgccgcccgttctttcttttttcccggtttcccgcccgtgcccgtctacgcggtccacggtctgcacacgttaatgcgcgagacggcgttggacgcggcggctgaggtgctctcgtggtgcggcctgcccgacatcgtgggctcggccggcaagctggaggtggaaccctgcgcgctctcgctcggcgtgcccgaggatgagtggcaggtcttcggtaccgaggccggcggcggcgccgtgcgtctcaatgccacggcttttcgcgagcgaccggccggcggcgatcgtcgctggctgttgccgccgctgccgcgtgacgacggcgacggtgaaaacaacgtcgtggaagtcagcagcagcaccggcggtgcgcacccgccgagcgacgacgctactttcaccgtgcacgttcgcgacgccacgctacatcgagtgctcatcgtggatttggtcgagcgcgtgctggccaagtgtgtacgcgcgcgcgacttcaatccctacgtgcgttatagtcatcgactccacacttatgcggtttgtgaaaagtttattgaaaatctgcgttttcgctcgcgacgcgccttctggcagatccagagtctgctgggttacatctccgagcacgttacgtcagcctgcgcttcggccggccttttgtgggttctgtcgcgtggccaccgcgagttttatgtctacgacggctattcgggtcacggacccgtctcggccgaagtgtgcgtgcggactgtggtcgactgttattggcgcaaactttttggcggcgacgatccgggtcccacctgtcgtgttcaagagagcgcgcccggcgtgctgttggtctggggcgacgagcggttggtgggtcccttcaacttcttctacggcaacggcggcgccggtggtagtccgctccacggggtggtgggtggtttcgcggcgggacattgcggtggcgcttgttgcgcgggctgcgtcgtcactcaccgccattctagcggcggcggtggtagtggcgtgggcgacgcggaccacgcgagtggcggcggtctagatgccgctgccgggagtggtcataacggcggtagtgatcgggtttctccctccacgccgcccgcggcgttaggtggctgttgctgcgcggccggtggcgactggctctcggccgtgggtcatgtcctgggccggctgccggcgctgttacgggagcgcgtgagcgtgtccgagctggaagccgtgtatcgcgagatcctctttcgcttcgtggctcgccgcaacgacgtggacttttggttactgcgcttccagcccggtgaaaacgaagtaaggccgcacgctggggtgattgattgcgcgcccttccacggcgtgtgggccgagcagggccagatcatcgtacagtcacgcgatacggcgttggcggccgatatcggctacggcgtctatgtggacaaggcctttgccatgctcacggcttgcgtggaggtctgggcgcgagagttattgtcgtcctccaccgcttccaccaccacttgttcttcttcttccgttctctcctccgccttgccgtccgtcacttcgtcctcttcgggcacggcgacggtgtctcctccgtcttgttcttcttcgtcggcaacttggctcgaggagcgcgacgagtgggtgcgctcgctggcggttgacgcgcaacacgctgctaagcgggtggcttccgagggcctgcggtttttccggctcaacgcttaacgagtcacgtaggggaactacgtgggtaagtgacgtggatactagtaaaaaaaagtgcgtcaaagttctcagcgtgtgacgtggatactagtaaaagggacgtcaaagctcactacgtgttgcgtgtttttttttctatgatatgcgtgtctagttcgcttctcactcttcctctccccgttcccagcgcggtggcagcttggggggtgagggcaaattggggtagttggcgttgagcacgtctagcaggcccaggcccacgggccaaccgtccacggtcttacgctcggtcagcttgaggctaaacgagtgtgcctcgtcttgaccggtaaggcggaaaaagaagcgtgctaccagctgcaggcaggtatgccgcgtctgctggaaaagcacgaaggtagcgggcacgtactgcacaatgtgcggttctttttcctcaaagagtaggtagagcgcgctgcagatcagccgccgggcgctgtggtgcagcagccggccgaagctttcgcgcacgttcaccgcgtctaggtactggagcaggtcgtgcaggcacttgcgcgttaagttgcaattttccacgcatgaaataacggtacagagcgcgaagtgcagcaggttgtcggccttgacgatgccgcagcggtgtttgagccgcagatccgagagcctcacctgcgtgacggcgtcttcggtctcgagcaaaaacacggcggagtagcccagaaaggccgaggtgcacagcaactcgctgcggtactcggccatggaaaccagcagcccgtgctccgtgtgcagccacagcttgtcgccgcgcaccgtaaagtcgagcacttgcggctccatgatcatcacattctgtctagtgaaatccgtatggacctccagcacgccgcggatcatcagggcctccatttcgaaatcggccgacacgctctgggccgcgccgctcctcgtctgccgtgatcaagcggcgcggcgcggacctttcaagcgttcctgggccgccgctcgaggcagttcccctttctggcactccgcccgccgcttcgcggctcatttggcgccggcgcgccttctcgcggctgcaaatcaactccacgtatcggcaaaacttgctgtcgtcgtaggcggcggctacgatctcgccgaaggagagctgcaggtaggcctcgggtacggggtccagcgtgcccagcgccaggatgtgacacagatagggcagggtcacgcgctctaccgtgtaattggagtatacgatggcctcttcggccccctgatgcgtgaccagacgccgcaggcgaaaggtgcggaaatactcgttttcccacagctgcgtgaggaagcgttccagcgactcggtgccgggcacgaactgcgagaagaagctgttggccaccaggcggttgtcctccaccgccagcggacggaagggcgccgcgtcgcgcgccttgcgcacggcctccaacacgggcaggtggtacagttcggcgtcgcgcgcgcccaggctcatggagtcctcgcgccgcgaggcgtagcgcgtgagcaggtcgcgcagctcgcgcacgcgattctcccaggtctggttgagcgtgcgcaggtcctggatctcgtccacctgcgactggatctgctcctccaggcacttgatgacctgcttcttaaacaggtcgcggatgtcccgctcgggcgccgccgggccgggtggcggcggcagcagcccgacgtggcccgcgggtcctcccaccacggcgccgccgggtcccaccacgccgggtccacccggaccacgcgcgggtagtagacggttttggtccaccagcgagggggtcaggtcctgcagaaaggactcgacgctgtcctcgatgccgatgcgcgatttgctgtccgagacgttaagcaaaaacttcataatggactttttggcgtcgctgccccggtcgtgctgctccatcatctccaccagcttcttgcagttgagctcgtggcggctggcggtcaccactttcacaggaaaggtattgagcaactggcagatcttttggtggcggcagagcccgtcgtagcgcagaatctcctcgtgcaggtgtgccaccggcgtggtgaacagcagcttgtcgcgctcataagccagcggttcggccgccacgtacaagcggatgtgcttgccgcgcagctgcgcctccagccgctccgagcgcaccttcttgaagacgcgtacctcgggcgcgttggctatgcgcacggcgcccaggcgctcggccacctgcagcagtagcgccaggttagcctgcagcaggtcctgcgccagcgggtgtgtctcggtggcccgctgcacggccgcgcgtacaaattgcgcccgctcggccgcctcgctcggcttggtcttcacgtccagcagcggtaccagtcccaccgttacgcaccaatccacgtagagaccatagtcgtcgttatcggcgtactgatataaaatgtcgcggagcgcgcccagcacgcccgtttgcacgctctggcgcaacgaggcgctccacaccaacagatactgctccaggtcctcttcgtccagcgcgcggtagggaaacaacgccgcgtgtaacttccactcctcggccacgcgccgcaccgtgatggtgtcaaagagcgtcttgcacactccgtagagcagctgcttgcgcagcacgcacgggtcgcgcagcacctggtgcatgctctggccgcgacacgtccccagaaagccgtgcagcaaccgcaggaagctcatcgtctggcccgtggggaaaatgtcgatgacggcctcgtcatccacgccgcggcccacgcccaagtacgacgacgccttgatcctcaacctctcgtcggccgccaagatcgaacggatcgtcgacaaggtcaagtccctctcgcgcgagcgctttgcgcccgaggatttttcgttccagtggtttcgctccatcagtcgcgttgaacgaacgacagataacaacccctctgccgcaactaccgccgcggcaacggcgaccgttcactcctccgtctcctcttctgccgccgctgccgcttcgtccgaggccggcggcacgcgcgtgccctgcgtcgaccgttggcccttctttcccttccgcgcgctgctcgtcaccggcacggcgggcgccggcaagacttccagcatccaggtgctggcggccaatctagattgcgtgatcaccggtaccacggtgatcgccgcgcagaacctcagcgcgatcctcaaccgcactcgctcggcgcaggtcaagaccatctaccgcgtcttcggcttcgtcagcaagcacgtgccgctggctgacagcgccgttagccacgagacgctggaacgctaccgcgtgtgcgagccgcacgaggagaccaccatccagcgcctgcagatcaacgatctgctcgcctactggccggtcatcgccgacatcgtggacaaatgcttaaatatgtgggagcgcaaggccgcttcggcctccgccgcggccgcggccgccgcctgcgaggacctctcggagctgtgcgagagcaatatcatcgtcatcgacgagtgcggccttatgctgcgctacatgctgcaggtggtggtgtttttttactacttttacaacgccctgggggacacgcgactttaccgcgaacgccgcgtgccctgcatcatctgcgtcggttcgcccacgcagaccgaggcgctggagagccgctacgaccactacacgcaaaacaagagcgtgcgcaagggcgttgacgtgctctcggcgctgattcagaacgaagtgctcatcaactactgcgacatcgccgacaactgggtcatgtttattcacaacaagcgttgcaccgacctggactttggcgacctgctcaagtacatggagttcggtatcccgctcaaggaggagcacgtggcctacgtggaccgcttcgtgcggccgcccagctccatccgcaacccctcgtacgccgccgagatgacgcggctttttctctcgcacgtcgaggtgcaggcttacttcaagcggctgcacgagcagatccgcctgagcgagcgccaccgtctctttgatctgcccgtctactgcgtggtcaacaaccgcgcgtaccaggagctctgcgagctggccgacccgctgggcgactcgccgcagcccgtcgagctctggttccgccagaacttggcgcgcatcattaactactcgcagtttgtcgaccacaacctctccagcgagatcaccaaggaggcgctgcgccccgcggccgacgtcgttgccaccaacaacccctccgtccaggctcacggagggggaggatctgtaatcgggagcaccggcggcaacgacgagacggcgtttttccaggacgatgataccaccaccgcgcccgatagccgtgagacgctgctcaccttgcgcattacctacatcaagggcagttcggtgggagtcaactctaaggtgcgggcctgtgttatcggataccagggcacggtcgaacgtttcgtggacatcttgcaaaaggacacgtttatcgaacgcacgccctgcgagcaggcggcctacgcctactcgttagtttcgggcctgctcttctcggccatgtactacttttacgtgtcgccctacacgaccgaggagatgttgcgtgagctggcgcgcgttgagctgcccgacgtgagttcgctctgcgccgctgccgccgccacggccgccgctcccgcttggagcgggggagagaatccgataaataatcacgtcgacgcggattcttctcagggcggccagagcgtgccggtatctcaacggatggaacatggccaagaggagacccacgacatcccctgcctgtccaaccaccatgacgactcggacgccatcacggacgccgaactcatggatcacaccagtctgtacgcggatcccttttttctcaaatacgtcaagccacctagcctggcgctgctttctttcgaggagacggtgcacatgtacactaccttccgcgacatttttctcaagcgctaccagctcatgcagcgtctcacgggcggtcgcttcgccacgttgccgctcgttacctacaatcgccgtaacgtggtgttcaaggccaactgtcagatcagctcgcagaccggctccttcgtgggcatgctttcgcatgtgtcgccggcgcagacgtacacgctcgagggctacaccagcgacaacgtgctcagtctgcccagtgaccgccaccgcatccaccccgaggtggtgcagcgcggcctttcgcggctggtgctacgcgatgcgctcgggttcctctttgtgctcgacgttaacgtctcgcgcttcgtcgagtcggcgcagggcaagagtctgcacgtgtgcaccaccgtggactacggcctcacttcgcgcacggccatgaccatcgccaagagtcagggcctgtcgctcgagaaggtggccgtggactttggggaccatcccaagaacctcaagatgagccacatctacgtggccatgtcgcgagtcacggaccccgagcacctcatgatgaacgtcaacccgttgcgacttccctatgagaagaacaccgctatcaccccctatatctgtcgcgcgctcaaagacaaacgcaccacgcttattttttgacacaacaccgtgtaaggaaaacgtgactttattgagcagggtaaaaaccacgtacaagaaccacgttgtctatccccaaaaaacacacaccgtcagggaacacatcgcctatagatagcggcacttcacataaaaccaccgtacctgcatcacggtggctcgatacactggaaattcaataaaaaccaccgtgtctccgtgacggtacttatcgggtcagcatctttctcttgagatttttgttcgtaaacttatccgtttccccggtccgcggtgtctcctcgtaaggctgacagtctacgagtggtacctgcaagagaagaaacccgggtgggagcgacgccgtcgctgggtatcaaccccgcggctgaccgtcgtccggtaaaggaacaacccgtcgtcgcaagccgggttcgaccaagagaaaaacccgggtgcgggggggagacgggtcgtcctttggttgttcgcggacggcgtacatcccgcgtgggtcagtcgacggcgtcgctccgtgcggtcggtcatcattctgcttcacatatatgggttgtttgtgtttttttttttataatgaatacgcactgatcctatccgtgactgcgcgtgtggcagagaggatgccttataacatgtattttgaaaaattgccaacagctataatttctctcatgtagcagaatagagaccttttgtcgtctttttgtttgtcattacttgttttccagggaattagagagagggaaccgcgcctccggcggcggtgcccgcggaccccggccccttctcgcgtgcgcggtgtgactggttgagcgaatgagcagctaggcttggtggtgctccgcgtgcgggggagaagacgattaacaacaaaaaataagtggaagtggccggtgggtctttgtccgcgtgcgcgcccatccgtcgccgggaccgagcagaaagtgatgtggtggtacattgattttttccttgacaggaaagaaaaaaaaagagttttgttttcctatgtgagaggagaaaggtatgtgaggagatgttcgatgatcgtatgttacagttatgctgtaaggaagcttttatcgtgcgtcctgtttttcatttgatgtatatgacacaattgaaacctatcgataggcgtatatcgaggattcatcaattcttagaatcgtcgtctttttggctaattggactttgcccatgttggttgtcattcgtggcctgaggtcatcgtcgtccatgacgacgtgtctatagcgtgcggtgtgatcattgtgtcgagccagagaaagcgcgcctcgcacgacgtttgcggatcggctcgcgggtgtgtggaattcctaagaacataatcagctggtcgtctttctttgatgtgttgttgtcgtcgaggtcttgcttcgttttcttttttctttttagtcgatggaacttttcttcggtacgggttcttgttatggaagcttgtgttttcgaacatgaattcgaaaaaataaaaaggcctatcttcgtttcaaaaaaaggacagatatcaatcttcttaacttatatcatggtaaattcagaatcctatggtgtcttattatctctaaagtagtcaacattatggtctaatttgtatttccctgacgagatatatatgatccttataacctggctactatcatgaacaacaatatccttacttacagtcatcttcgtgagttaatgaagtataatatcggtcatctatcaacttatctgctatgtaacgtacccttttaggtattttgcgtttcttaacgagtgtacccgcctgtgtgaggcgaaactctgagaagtctaccgagtcgagttacaagtcactaaaacacttacacgagttatctatactaaaatcactatctatgttgtttgcttacctaattattatcctacatgacgaagctacctcccaacgtaaggtagggggagaggagacagaacaataaaaagtaactaatgtttcttagaacttacccgctaaggacttaccaaactatattcaccaaaaaacaacagctacgtgtttcatttgttttaatctaccgaagtaaaaaaaaaaagatgattagctatccagaacctacttacttcttaatgttttaactaaggatgcctatgggattggaaaaaaaatcacagcaacttgctactaatcagttgacagcgaagagactcataacaaagatttctgggtaatacggttataataatgcttatggactaaaggatacttggaaaaaaagaatgggctatgactatagagattcgttgagatatcaaacttcaaataggcggctatcattcatggttgtggtgactatatcgtggagaaaaaatgtgatcgttagttagctaggtgagacttacagctatccatccgtctagtttttcgttgtaatgatgatagtacgtctatggtggtgatcgattttggttagcaatttgttcgtttaaaggcttaatgtacttatgctacatgatgtattattctttgattcatcgttcctcctaagggggtgtatgtatgtatgtactagtcgtatagtgttcctaacatcatgactattcagactatggcttcatctatcgtgtctaaagttcacctattctactattactatatatatgcactactatgtaactaggatatggtcctataaggtgtcttctatcacggtggcttgtttatcgcttggcggttacgagcaagagttcatcacggaccagccgtgaggcagggcacacgcgggtcggcggcgatgatgttccccgcgaaggggacaacaaaaacaagacaagaggccgccggccgcggccacggacgcgtagcggttacacaatgtttggttgagcgttttgtttcatcgtcgtggtggtggttttgttgttctctgtatatatcgtgtggtggctttatcgtcatcattattatcatcattcttgtttccatcatcacgatgagttttctccgttttcctctcctccagtggtagtcgtgtatcatcatcaatcatcgtagtgacgtcgttgctgctgctgctcttgccttcatggcggtatttctcttcctcccccctaaccccatattaactcgtgagtgtgatggttagagtggctgcttgttttttttttcttttctctttggaacaacaaaagaggataaagatggtcggtgaatgtattattattatcatcatcattatgatacggtcgcggtcttcttctccgatgacgaaacctgcgcacatcgaagaaaagacgagcgcgcgaaccgatagccgtccgtctgggacgaaggagaagatgatggggagaggaggagagccccagaagccagagcgagaagggagacgacagacatacgtcgtcaccgtcctctggaggaggcacggcggcgctgtttgttgtttggatgcttgattatatcctgttctatggggtagattattatcaataggcttggttttcaaaggtcagcctgtgtattgtcgtgtcttttttttcgttctcatgatcgcggagaccacacagacgtgcgcgtctcccaatggctaggcgttctttttaggtagtaattttttgatcttttttttttcttaacaagtctggcttgatttcttttatctatgatcgattcttctttttctcgggggttgcatcttccgtgaaagtaaagtgacactactctaaatggtaaccatattatctgttgattaggagaaaaaataattttttcgcacgaaatcgatcctaagtgaggtgatttacttgctatcacacgaaatgattatcttttgctgctaacgtactgaattttttaacagaattgcttctccgtaactatttccgcagattcagacagattgtcaaaaaaaaaatacggcacagaaatagtgggtctgtggcttttggttcgtgtacattcgcgtttgcgtgtcgagatttctacggtatgtttattcttcctgcgatgatgtagggtccttggtgtaagtaggatttcgagtatctctcttagagcgaacaaaataatcaaaaaacaacagctaggaaatcgagggttactctacgataaagtgtctctacaaagtgaagaatgttacgttgtggtggaataataagactcgcgtgatcgatgagtgatcgagagcggctcgaaccttctttaagagctttgtttagtgcaactttaaattacaaggagtagaaagctgaaatgaatctatgaaggtgctattctttgaatatcttactttgtacgcttcacattcgttatttggatagagagttgtctagagaaaatctgtgattctctatgagtgttatttttattatccttttggggactacgatttttcttcttgttctacataccactactactcgtaatcacatacatggacgaaaaaaaaattcgtcaggcagtagataccagattctccgacgttacggcgtctttttttcttttgagagagtatctgctgagattgtccgtggtgtatctagtcgctatttttgttgttactagtagttttgcacacagtttattcagtatagtttttcttcttgccatgatcaattgagcccaccacctttttttttagagaggaggaatttcgtcttgatctccagccggagacaacggcggcggtggtggtggtggcgggagagacttcaaggcaatgaaaaaaaaatttcgttttgccatcaagtggtgacgataacccgtcagattgataattggttcctacagaaactattctaaccgcggaagaaagaaattgaaaaaaaaaattgacaaaaacatcataacataaaggaccacctacctgggacgcgcagttgggcggcggattggggcggcatgctgcggcgatgctgtcggtgatggtctcttcctctctggtcctgatcgtcttttttctaggcgcttccgaggaggcgaagccggcaacgacgacgacgataaagaatacaaagccgcagtgtcgtccagaggattacgcgaccagattgcaagatctccgcgtcacctttcatcgagtaaaacctacgttggtaggtcacgtaggtacggtttattgcgacggtctttcttttccgcgtgtcgggtgacgtagttttcctcttgtagcaacgtgaggacgactactccgtgtggctcgacggtacggtggtcaaaggctgttggggatgcagcgtcatggactggttgttgaggcggtatctggagatcgtgttccccgcaggcgaccacgtctatcctggacttaagacggaattgcatagtatgcgctcgacgctagaatccatctacaaagacatgcggcaatgcgtaagtgtctctgtggcggcgctgtccgcgcagaggtaacaacgtgttcatagcacgctgttttacttttgtcgggctcccagcctctgttaggttgcggagataagtccgtgattagtcggctgtctcaggaggcggaaaggaaatcggataacggcacgcggaaaggtctcagcgagttggacacgttgtttagccgtctcgaagagtatctgcactcgagaaagtagcgttgcgatttgcagtccgctccgatgtcgttcacccagttactttaataaacgtactgtttaaccacgttgcgtcgtgacgttgtttgtgggtgttgctaggcgggctggaaagatgatgtataaatagagtctgcgacggggttcggcgctctgccggctgcggcggcactcgctccacggcctccgacgagcgttgcgctcgcgctttgcgccgccgcgtcatggatctgcctactaccgtcgtgcgaaaatactggacttttacgaatcctaaccgcatcctgcatcagagcgttaatcagactttcgacgtgcgccagttcgtctttgacaacgcccgtctggtcaactgcgtggacggcgatggcaaggtgctgcacctcaacaagggctggctctgcgctaccattatgcagcacggcgaggcttcggctggcgccaagacgcagcagggcttcatgtccattgacattacgggcgacggggaacttcaggagcacctctttgtacgcggcggtatcgtctttaacaaatccgtctcctcggtggtgggctccagcggacccaatgagagcgcgctgctcactatgatttccgagaacggtaatttgcaagtgacttacgtgcggcattacctgaaaaaccatggcgaatcctccggcggaggcggtggttgcggcgccgcgtctaccgcctccgccgtctgcgtgtcctcgttgggtggcagcggcgggactcgcgacggcccttctgcggaggaacagcaacggcgaaggcaggaacagcgtcacgaagaacggcgcaaaaaatcgtcctcgtctgccggtggtggtggaggcggcggcgctagtggtggcggtggcggcggcgggagcggcggtcagcactcctcggactccgccaacggactgctgcgggatccccggttgatgaaccggcagaaggagcggcggccgcctccctcctccgagaacgacggtgagtcccggccctcctcgcgtcacggtgctttccgagtggactcgtgagccccccgtagcgcacgagcgagcaggcgagcggtgttggtgcgctggtggttgtgtggatgataaccatgtgctttttcgtgcgctatgtgtcgtcccgtctgtaggctctcctcccctccgggaggcgaagagacaaaagaccaccgcacagcacgaaggccatggcggcggcggcaagaacgagacggagcagcagtccggtggtgctggcggtggtggtggcggcggcagcggccgcatgtcgctgccgctggacacgtctgaagcggtggcctttctcaattactcgtcctcatcctccgcggtctcttcttcctccaacaaccaccaccaccatcatcaccaccataacgccgtgacggacgtggccgccggcaccgacggtgcgttacttctacccattgagcgcggagcggtggtttcgtcgccgtcgtcgacgtcgccgtcgtcacttctttcgctccctcgacccagcagcgcccacagcgcgggcgagacggtgcaggagtccgaggcggcggcgacggcggcggctgcggggttaatgatgatgaggaggatgaggagggctccggctgaggcggcggaggcaccaccgcagtcggaggaggagaatgattccaccactccagtctctaactgccgtgttcctccgaattcgcaggaatccgcggcgcctcagcctcctcgcagtccgcgttttgatgacattatacagtcattgaccaaaatgctcaatgattgtaaggagaaaagattgtgcgatctccccctggtttccagcagactcttgccagagacgtcgggcgggactgtcgtcgtcaaccacagcagcgtcgcgaggaccgccgcagctgtctccacagccggcgttggccccccagcagtcgcatgtccgccactcgtcaccaccggtgttgtaccctcaggttccgtcgccggtgtcgcgcccgttgccgccgcagtcgaaacaccagctgctcctccccggcccgtgtgtgaaatcaagccctacgtggtaaaccccgttgtcgccaccgccgcggctgccagtaactcttcctcgtcttcttcggctccactgccgccgccaccaccaccgccgggcggacgtcggggtcgggcccggaacaatacccgaggaggcggcggcggtggtggcggtggtagaaacagccggcggcaggccgcatcgtcgtcgtcttcctcctctcggagatcgcgacggagaaacaaccgccatgaggacgaggacaacgatcctctgctccggttgtcgcaagtcgccggcagcggccgccggcgagggccctcgttcctcgaggacggactcgaaattatcgatcccagcgaggaggctgcgatcgccgccgcctcgatcgcggcgtttttcgacgattaaaaaacagagccgagaccggaaaaattatgaaacaggacgcgcttggacatttgggtttccacccctttcggtgtgtgtctatatatattgtggtcactgatttttttttacaataaagtagacatcacagttcaccaccttgtctccccggtgtatctattatcatcaatcacccacagagtcgccagtccatggtctctcggtaatgcgtgtccagatacgcgttggccagtataaagtggtcgttgcccacgaaggcgcgggtggtgttgcgcggcgacgggtggcaggacttgagtaccaagtgccgccgtcggtcgatcaggtactcgcaggtgtgcgcgtcggcgccccacagcatgaacaccagatgctcccggcgctctgacagcctccggatcacatggttactcagcgtctgccagcctaagtgacggtgagatccaggctgtccgtgcaccacggtgaacacggtattgagcagcagcacgccgcgtcgcgcccaggcgtccaggcaacccgaggccggacgctgaaacccgtccaccgtacgcgccagttcgcgaaacacgttgttgagggagggcggcggcggtcggcccgccagcgtgccgaaggccaggccgctggcgctgccgtcgcagtacgggtcctggcccacgatcaccacgcgcacctgctcgggcggacacagatagctccagcggtgtacgtgctcgggtgccgggtacaccatctcgagttgccgcgcgccctccaccgccgccaccgtgtcgcgcagcagcaccgtgtcgtggtcgggcaagctgaggaagcggatccagtcggcgctcagacaaaacacgcgagcctgctcgtcgggggttaacagagagcctttattatcagcaatgttagcgagcatccactgcttgagggccatagcgcgagtgagccggcaggttgacgcgcgtctgcttcagctcgggcggcagtccggcgtagtatttatctaggtggcgtagcagcggcgggtccagctggtgacgcaggcagaattccttcactgcgttgtacaggccgtaaaagagcgtgatgccctcgggcgcggcagcggtgctcacgggcagacgcacggcgcggttggtacgcgtggcttcgttgcgtatggccaccaccacgttaaagagagacggtggcaccagctcgaagcctaacacgtgttccgtgaagatgctgcgcccgtatgacagtcgcgtgaggtcgtagccgcggcacaggtcgtccacgcacgtgtacacggccggcgagccatcgccgcactcgctgtagccgcgcatcaccgtcatccagcgcggcgctgtgtccgagctcaacagcgtcagcagggcccgcaattgatccggattgttgtacagcagggccagagtgtccaggaaagcctcgtccaacagcacggagttggcggcctccggcgtaacgggacggtaacggataagttgcgatagcgggccatcgcgcccggtaacattcaccaacgggcgcagccaactttcatacttgtcaccctcaaacacctcacccaacaagcatcggcgcgttagttcggggcactccgcggggactttctcggcggcggtaggagcgacgctgacggcggctgaggaaacaatgggcagcagaaggcaacaccacagcagtatcaccggtccaggtgagaaagagaagccgcaatccgggcggcggcacatcaagtctgcggcacgatgagagtgtgacggtaaggagccagttggcgccaaaagttggcactcaggtcttcgatccctaaaacgttatatattgcatccagcaggtgagccaggctaaacggattcacgtaccaggtttggttacccgcgacgatgacggccagaccgtgggcgctacagttggagaggttcctgggtacgaaggtaactgagtcgatgtcgcgccacggggggaatgagacagacgactggcgcacgctgtaatcacaactgtgattgacgtattgtagcgtgtaatttaggttgcactcagcctcgaagtagagggggaaccacagttcgtcgtactcgtcgtcgtcctccagttctggctcttcttcatccaccgcaatgtctacgctgctctgagattcctcttcgtacaggatgattgacaggttatggctacaaaggtcctgggcgggaggacgcgtgggagcgcgggtggtggtaatgttttccaggtcaaaagttggagtgtagtcggatgttacatccccgttgttggaggtggtagaagtcgcggccggtgtcacggtggtaagtatggatacagaagaggagggggaagtagcgttcgtaccgatggttgtggtattattattccttgtatttcttgttccagaaaccgttgacgttgagatgagaatcgacgtggcgctggacgtcagattgctgaccgaggaaaccgtggtgggagtggtgacggtgttactcgtggttgaagtgacgttaggggaggtagtagtggtaccggtggtggcgacggtagtgtttgtcgtggcggcggcagcggtggtactggtaacggtggtcgcgttggtttccaccgcttcacacagtaagcaaaagcacagggccaggaaaagcaaccagccccgccatcgccgccgccgcttcatgaggtgggcaggcgaaagctggtgaattcgttgtacagcggcaagtggggcgccgcgatcgaagggtacgtcaacaagctgacgttgatattaaatacgtctggctgcttttctacgatggaagcgcacagggttacggcgtcgaacaggtctttcttggtggcgcccgagacccacatctggtatacacccgtctcgtggtacgaagtagagcgcggcaccaccggacggatgcagtccagaacgcggttgggatcctggtgaaagaatttgaacgtggctacggcctgtggcgtgtgcggcatcgtctgcgtgatgagctgctggcccgctaacacggtgacgttgtgcaacttgagcagggcactcttgagggcctggaaagcgttgccgcacgaggcgctgatttgcagctgcacggccgtggagtcgtgcagccgcatgagacgtgacacctcttcgaagacgtacttatacttactggcaaagagtggcgcgtaccgacagtcggccggcaaaatgtaggtggcgttgccgccgttggtggccacggcgggcgcagcggccgcggaggccggcgtaaacagcgtcagcggccggtggtggctggtaaggtcgatcatgggcggcgtggtgaccgtggcggtggcgggcatgacggggtttgcggcgacgggcactccggccacagcggcggcagcggcggccacggcggcgctggccgagcccacacctgccggcagtcctccgccacccatgacgccgccgggcagagcgtcgcccagacagacttccacagtggcgggcgcgctctcggcggtcagtacggtttgccgatcgacctcgcgacgaaagctggtgaggaactcactatgatccatggccgcagggcccgagatcccgggattctgcgggtgctgaccgagtgcgggccgagttatatggaagacgattagcttggagcggagttttgcgtccctagctgacctgcggatcagcgacgtgccatagggatagactgtgagcggcggccgcaacggcggggtcggccgccgttcgtcgtcacggggcggcgcgagggaggaggaggtggtggtgggtacgatcttgacgtggttaacgtcctgcccgtccgggggaatacgcaaaaaaccccgccgcggcgctaccacgatggtgcgatgggtctttctcttgttggccggggccagggacttgcagatgcgtgtggagccgtagacgatctggacgtggtcctgggagaacatgaccatcgccgccaacgctcagcggggggacgggttgggaacacagaggctgaggggaaaccccgtagaagtcagcgaaataaaaacaacacagcagccgctcctctcgtttcgggccctaccactgcttgaagtagggcaccgggtgtttcttttcttcaacgggctcctccagtctcttataggaccagtcccgccggcgcgccagcatgtaggtcacgtacaaaagaataattaccatgaacaccaggaaagccagcacgccgtaggccagcagccggtcctcgaacagcgggtcgctcttgataaacacgtaggtggtggtaaaacttcggcccgcgatctggacgtggagacgcacgacagtatacgtgccgttgaggtagaagacaaactcgcgtaaccgttgtccgttatacgtcacgttactaatattccacggcggaatgagctggtcgccctgatgcagatgcacggtgctgttggggtgatagaggctgctaccgttgagcaagcagtgttcgtgttcctgaagcagcacgcggacccgcatagtggtagcgttcaagcgagtcccgtacacggcgtaaatgggataggtgaaaaggtcccaagtggcgttgtgatggcggccccagctgaagaaagagcacgtgtactcagtggtctcctgcggcctgagtcccgagataagcagctcttgagcagtagcgttgtaggagagatgtagttttcctgtggaaaaaattaatgagttgtttattttgttagcaggttggcgagggaggaaggggaacaaaacagaaaggtacgtgttacttacctttatcgttggagggaaaagcgctaagatatcccacctgagtgaagggacccttgcagtctgtccgtgcataacaagtaactgataaaatgtctggatttttggtattattcaacaggataactttgcaggtggcgtttagagacacttggtcgtagctgtagctggcttcgcaattcacagtatacaggtgcccctctttctgcgtcgtggctatcacggaggtggaggcggacgaggtagaggtttgtaccgtggtggtgacagcagaactgacgttgttagaggtacttattgacgtagtagacgtgacggtggtattactaggggaagtgacggcgcttgtggtgctacttttcactcccgggtgcatgtcgcccaagagcgcaactacgagcgcgatcgccagcacggaacacatgttgccgtgtgacgagacggcgtgtggacgagctatatgtggcaggaggtcgcgtcacctcttgtgacgcctaaacgtccagctccagataaaagaggcgttaataatgaacactacaaaaaccacttgcgtcaatatgacgatcataaaggctcggtgatcgctgcgcctaaagtatgcgggattctccaccagctcactatcttcgacaaagtggatgaatgtgttagtgttaccggccgttttgttgaccatggatcgtactatgaaagtcccggcgccaaaagttccattagagccccagcaagtaacgctgccgttcacgtaggttcccggctctcctgtcagcatgtgtgtcagttggtgggtataattctgtttaatgttttccatgtcctcgctgtaattaacttttctggtgagaaactgtgtacggtgcgggagaacgatcatcatccctgaggccaaaaagggcgaatcataagctgttgtgttacaaaaaatagtcaggttagtatcattgtgctcatagatataagccatttttacttgaggttcataccaccaccctaccctaattgtagttgccaccgtcaccgagtcccatctcccgaaacttaccaccgccaccactaatagcgtcacccccgcacggtacatagttaccctctcgacgtcgccggctgtcaatgacgtgcctgcgtcagtggctatgatttatagcttttggacacaaccgcaacggatctgtcgtaatctaccttccacagggccgccgtgacgatgctgaacgacaggatcagacagacggcgtacaggagtcctaggtcggcgtcgacacggcaggtgcggatgtctcgcagggtgggtagatgggcgatgcacaactctttctccccccgcccgtacatcccatctcgtatcagcagccgtagcgtggcattgatggtcagcggggtaaccaaagaaatcacatagggatgtgtacaggaagtacagtgatgggtatccgtgagatgtacgtcatcaccctcctcaccctcatcatgaaagaccaggactcgggtgagacgacccgatgaatactggatctcccaccacagtctttggtccaacaccgagagggcgcaagagattctaagtctccctgggttgggggagcagatgtaagccccgtatgtgcctctcgccatcagggccatacacatgaggaggagaaggacaagtatccgggaccacccgcacccccacatcaggagaccagagacggagatgtataaaaaagctacttttattaaacagcattctcaccacacgttaatactgtcacgggaaatcactatgtacaagagtccatgtctctttccagtttctcacttactgagatttgttcctcaggtcctggatggctgcctcgatggccaggctcagggtgtccaggtcttcgggaggggtctcggtgggcttctcaaactgccccacggcgtaggccttcgcggccgtctcgtagataggcagcatgaacccaccctggttggtggagaagatgcgcaccatgacctgtttgggaaacttttgcatcaggggcaggcacaggttgagagcgcccaacaggtccacgggggtggcagcgtggataatcatgttgcggtaatcagaagagcgggggcacaattggtgggtgtgcagttctttgaggttccacacggccttgacaccgtcgttacaagcatcggccgtgcgctgcgccacatcaggagggtgtgtcacaggcatagtgtgctccatgaggaagggagtggagagggccaggttgcacatgctacccaggcgacaccgtacctgatccacctcattcttcacttcatgattgcgggtgtagatgatctgaatgcccttgttgttcacctgcatggttttgcaaactttgatggcctcttctaacacttggtgcatactagggatcatgaatggcagattcttgtactcaagagaacgattggtgtgacggaacatgcggctcacctcgtcaatcttgacgcgaccccgccgagtctgcacgttgggtgtgcagaagggggtgttcttatctttcatgatattgcgcaccttctcgttgtccaactcggagatgcgtttgctcttcttcttgcgaggtccggtgctcgccccgccgctgctctgatggccgcagctcagcagagaggaggaggccgcgccaccaaaaccgccgcgcccatggtggctcgaggtcacggatgctcctccgccactgctgcatttcatctcctcggactcactctccgagtccgaagccgaactgcaggaggaggaagacgaagaggaactatcttcatcgggccggcccaaaggatcgggaagaggagggtggttcatctgggagagcgggtgcgtgggagaggtcactcgcggcgtgccgctgccggtggaaggggaagacgcggtagcaccgcgggtctcgacttcttcaccctgttcttcctcgctatcagagatcacgatacagccggcggtatcgataatcttgttgcggtactggatggtaaagtcgggctcgggcttgatgtcttcctgtttgatgaggggcagcatgataggcgcgggaggcacgggcggtttaataatcaccttgaaaggacgcgtggttttgcgcggtttcttacgcgggctgagctcgggagtagcggatgccccggggagaggagtgttagtaaccgcgacgctggtgggggtcggcttgttaagaggggcgctgctaacgctgcaagagtgggttgtcagcgtggggccggtgctactggaatcgataccggcatgattgacagcctgggcgaggatgtcacctgatggtgataagaagacacgggagacttagtacggtttcacaggcgtgacacgtttattgagtaggattacagagtataacatagagtataatatagagtatacaatagtgacgtgggatccataacagtaactgatatatatacaatagtttactggtcagccttgcttctagtcaccatagggtgggtgctcttgcctccagaggcggtgggttcctcagcaccatcctcctcttcctctgaggcaacttcctctatctcagacactggctcagacttgacagacacagtgtcctcccgctcctcctgagcaccctcctcctgttcctcatcactctgttcactttcttcctgatcactgttctcagccacaattactgaggacagagggatagtcgcgggtacaggggactctggaggtgacaccagagaatcagaggagctggcaccagcggtggccaaagtgtaggctacaatagcctcttcctcatctgactcctcggcgatggcccgtaggtcatccacactaggagagcagactctcaaaggatcggcccccagaatgtactgggcaaagaccttcatgcagatctcctcaatgcggcgcttcattacactgataacctcaggcttggttatcagaggccgcttggccagcatcacactagtctcctctaagacatagcagcacagcacccgacagaactcacttaagagagagatgcccccgtacatggtcatcatacaagcgtcactagtgaccttgtactcattacacattgtttccacacatgtagtgaggatatccataaatatgtgatcaatgtgcgtgagcaccttgtctctctcctcatccaaaatcttaaagattttctgggcataagacataatctcatcaggagagcactgaggcaagttctgcaatgccgccatggcctgactgcagccattggtggtcttagggaaggctgagttcttggtaaagaactctatattcctgtagcacatatacatcatctttctcctaagttcatcctttttagcacgggccttagcctgcagtgcaccccccaacttgttagcggcgcccttgctcacatcatgcagctccttaatacaagccatccacatctcccgcttatcctcaggtacaatgtagttctcatacatgctctgcatagttagcccaatacacttcatgtcctcgaaaggctcatgaaccttatctaagatatctaaggcattctgcaaacatcctcccatcatattaaaggcgccagtgaatttttcttccgtctgggtatattttttcagcatgtgctccttgattctatgccgcaccatgtccactcgaaccttaatctgtttgactgtagaggaggataacaacacatataagtatccgtcctcctgactcatttatcgctatctcgatgccccgctcacatgcaagagttaatcttcactctatctgacatacacaagtaaatccacgtcccatgcaggttagtatatatcacatacatgtcaacagacttaccgagttctgtcaggacatctttttcggggttctcgttgcaatcctcggtcacttgttcaaaggttttgagggattcttcggccaattctgggaacagcgggtctcccaggctcagctgactgttaacctccttccttaacatagtctgcaggaacgtcgtggccttggtcacgggtgtctcgggcctaaacacatgataaacaaagtcataagcacatggatcacatacaggaaatatgtatataacattaaagatataactttttattaaaaaaaggggaacacaagtcccgacacgtaccgtggcaccttggaggaagggccctcgtcaggattatcagggtccatctttctcttggcagaggactccatcgtgtcaaggacggtgactgcagaaaggatccatggaaaggaacagtctgttagtctgtcagctattatgtctggtggcgcgcgcggcagcaacgagtactgctcagactacactgccctccaccgttaacagcaccgcaacaggagttacctctgactctcaacagaacacaactcagctgcctgcttcttctgctgctgccttaagtcttccatctgcgtcagcggtgcaagcccattccccgagctcattttcagacacataccctaccgccacggccttgtgcggcacactggtggtggtgggcatcgtgctgtgcctaagtctggcctccactgttaggagcaaggagctgccgagcgaccatgagccgctggaggcatgggagcagggctcggatgtggaagctccgccgctaccggagaagagcccatgtccggaacacgtacccgagattcgcgtggagatcccacgctatgtttaataaaaactgcgggtactggggacggtgttgttgtatatgtgaatttgtaaataataaatgggaccccatcctgtaaaaatacagagtccgtgtcagtctctgaaggacagagtattggcatatagccaataaagagagttgtggcaaagagccatgttatggattagtaatggaaagtatcgccaccaatagaggagtggtcaataatggtcaataacccacacctataggctaagctataccatcacctatagcataaggaagcgggggtgtatagaccccaagccaaaaacagtatagcatgcataagaagccaagggggtgggcctatagagtctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctctgcttatatagacctcccatagtaaacgcctaccgcccatttgcgtcaatggggcggagttattacgacattttggaaagtcccgttgaatttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccgtaaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacatggcggtcatattggacatgagccaatataaatgtacatattatgatatagatacaacgtatgcaatggccattagccaatattgatttatgctatataaccaatgactaatatggctaatggccaatattgattcaatgtatatatatcgatatgcattggccatgtgccaacttggtatcgcctctatcggcgatatggcctcatatcgtctgtcacctatatcgaaactgcgatatttgcgacacacagaatcgcccaagtcgccaaagtcgtctatcgccatcccccgtaaacgatataagcgttatcgccagatatcgcatatgcccaaaaatcactttttaaaaaatggcgatatcagttacacagaaactcacatcggcgacattttcaatatgccatattttcaaatatcgattcttccaatatcgccatctctatcggcgataaacaccactatcgcgcgacatgaatttagtcggcgacagaaatctcgaaacgcgtatttcggacaaacacacattttattattcactgcagcatatagcccattttagcgcggcacacatccagccgtttgtgtttcttaacgctctccaggtactgatccaggcccacgatccgggttatcttgtcgtattccagattgatccatcaatagggaacgctgccagcggcgcccagcaggtactgcgccttgtcgtttactttgccgcagcgtattcgcccgtcagcttcgaggtataacctacaacacggaggggaaggggggtacaaaacgtgaaattagacttttttttttaatgatgttttgtccctctctgtcttactctcccataggctgtaaggccctcaggaagagacttacggattgtagttgcagctcgtcagtttgttgtgtacgacctggcgtgtcaatgaatgggtcatggtggtgacgatcccgcgaatctcagccgttttctcgggactgtagcagacttcgccgtccggacaccgcagcctgtggattcatgaaaatctactctggcattcccgaggatcgtcgatggaacatggctatcagaaacgtcgagagacagatccagacgcaccacagaacgcagacaatcatgaaaatacgtacgcgacggtgaagcgattgcacattttgaaatcgtaacagcgttccggcgggtggttgacgtttatgaattcgcaacattcttctgcgcgcacccgcggcacgcggctgtgacccaatagcagccacaacgccgtcaagaacggcgtcagatctttgggactcatgacgcgcggttttcaaaattccctgcgcgcgcgacgggctcaaacgatgagattgggatgggtgcagaaggtgtaagtctggttattggcctcggtgaacgtcaatcgcacctgaaaagacacgctgtagtcccggaagacgtgagcccagctctccagcttcatcacacacatctgataacgtgtgccatcgttgacgacgaagcgtagcagcttggtctgcttgggcaccatgtgcgctccaaaaatcttggcgtcttccacgctgatctgcacgtttccgtcgctcggtttcgaagccgttcggggcatccgttggaggatggtttggttccgaccgctcaggtaccagatcacctttttcacccaggtggagcttctctccaccaaggtctggccttcccggttgtacagcagatacagggtctcgttgcgacactcgggacccgttgatacccgctggaaccccgagaattgcaagggggatcgtgggggcgagggatagagaaaaggacagtaaaacgtcgccgcgtcatgcggtttggaatacgtcagtttagaccatggcggggacggattctggtttgctgttagcgtcgaccacggagacgccagacagggcgttgcccaaaccgcgcacagaagcaggcagtgaaagtggtgacgaagcagaagccgcagcatattatttcccgtgacgcaggctagttggcaaagagccgcacgctgaactcgaggctccgggcgtgtggcgccagcgaaccggcggcgttgaacgtggtccttttgttggtgccgccgcgacggttctgacgtctaaagtcgctgatgagcaacgacacctcggtcacgttgattctgcaagcacaggttccgaacgtcatttcataccccatgcggttacttacccgttacccgttcgcccttaccttcccgttgtcatgcatctttagcgcgtaccctcacctcttgagcacgtcaaagttgtccaagccgtggctcgcatcgtagtggtagttcaacgtgaggtccacgagctgttccacatacttgtaacgggtttggtcgggcagcgcgcgagagcacgcgtcccagtaatgcggtactcggtaataatcgtttttttccgcggtttcccgctggcactgacccagcaccacggcgcacagacaaacagacagccacacccgacacagccgcatgttgcagactgagaaagaaagctttattatgagacatcatacacatagtataggcgaggtgatggggcggggaaagagttggaaccgaaagacaaaaaaaaaagcctagtcgtactcgggatctctgagcgagacgggttgcatggcaactttcattagtttgggaatctgccagctggtgctgttcgaaggttcttccatttccgaggcggtcagttcatcgtacaccgaaacgtagtacctgatggggtcctcctcattgtccgagaggtgagattcgatggtcaaaggcgagcctctcccataattgggattcacgaacgacgtgtccaagttgccatcctttctgaaatagatgacgttctcaggatcatgtttcatgcgctcgcgggccgcggacgcctcctcctcctcgtcccagtcccgagtttccaaccgctgataagggctcgaggaacaaaatccggcggggatctgagaacctcgtcgggaaccgctgccaaacgggctgctgccgccactgtcgtccgtgtcgtccaacaggttgacggcttcttcgtcggcgaaacgaaagcgacccgggtgcttgcaacacgaggagtaaactaccgcgaccagtaccgctatgaagctgaaaatggaggtgcctgtcacgatgtagaagaggatagccagcactttcatgatctcgttattgcgcacgttgtgaacggaagactcgtgggtggtggtcatgttgatcccggtcgtgggtccgctactcgtggcgttgtcgacgctatttctgttgctggtgctagtagggacttttgtgctgctggtcacattcgtaacgtcgctgaggtctatctgaagcagcaacccgaacgcgaccagggccaggaatgttgcgcgaaggggaccccgcggggccggcattctcgagacgtggcgacgtggatttcttgctatgtccgcgaacgacgtgtgacgaggacgtggtttccgcaagcctctaccgacgccgcgacaccaggtaggttatcaaaacgcgagcccatatcgccgccatcattgtaatcagcaatgtgttgaggtactgcacgatgaatctgtctagtgacaccagccaaccctctgcttttgcgggcaagcgcgctttcggtgacagggtgtatcgtacgtagccacgggtcaggcgcgcgttgtagcggtacacgcagaaatctatccacaagccaacgcccggttgtagcttcggatggtggataatagcgcggtgacgtacgccgcggggctttagaatctccacctgtaaggccatctcctccaggtagtgggtctgactgcgacgcagcgtccagttcatgtaaaagtcggtctcgccgtgtccggccacgaagaggctgcttactaaatcgggcgccagagctaggtcaggcgtatcaaattccactgtcaggcgacctgattctaacggttccacgatccgggagagcgtttctagatatagagcaaagcgtaccacgtctacctgcggtgtaaaaaactgttgtgggcgttcaccgtcgttgaccacgtaggccacgtagaggccaacattttccaccacgggttctagctgcaggcggcacgtaaagcttagaaacgacggctgtacggtttggttcccgtgaagctgaagcgtcacttccttgccggggctcaccgtgctgtaacgccgcaccgagtcggtcatctgctccagatcggtagaccagaagggcgtgcaatgcatactgtcccagtcgcgacacgcagcccagcctagctcggtgaagggtcgacgcacacccgagaaagtgtgcttgaagaccagggggtcgcctcggtagctcagtagtcgaacatgcacatagtcgcggctagcgtcgacagacggtccgtagagggccagcagtacgagcgtgaacagcaagcgcaacatgctgcgcgggttaggaaatgcggcgtgccggccaccgcccgactcataaacgctaccagcatgacgtctcagatcacacaagtgacgaggagcgtaccgcaaatcactagggaaaaggccagcagagcccgatagtcttgctcttcgcgaacgatctcgtccggttcctcgcaatcttcgtggtccacagaagatgaggagcaggaattttcgttaatctctgcgaggatactagtgctgtaccacaccagagcgcttagtgtgcccagagctaccgcacggtaaaatagggacatgatcaccagcgcagtctaaagtagtggtaattcagtttcttggcgtatttccagagaaaggctttgtaggccgtagggactggccaggcaccgaactcaatatttgtagacactacgtcgtaaatgcgttgttcctcgtctaagactaaccgaaaaaatagccggttgatgtgacgacgcacggcttgcgcgttaggattgagacacttggtgcccttgtcctttaaaatagccagcacttcctgacgattgcagctttcgctcgctgcgattggcttaagcaattcggttccgaccggcagggtattcaacagaatttggttattacagcgacaccgcttgtcgtaatcttctagttctaaaagacggacggctatgggacatatggcaagtaacatatatgcggtcaatgacaggtatcgtaccgataaaagtttaatgcgcgaattcagaatcggatgatgtaaccatgttagcaacatattgaaaacatgatattttctgctctaacaaacttgtctgtttaaaatatatactaaatattattccttcagacctactagggttacagttatttttcccggccctcgttccggttgtcttgttacattaacattataccacctgttatcgttgcgtttgtctagccattttgaaaaagggtgatggggcgataaacatactccaggtccatgtttttttcctccgcctagatacaagaaatattcattgttattgcatctgggaccaccagattcgcgatgaaaccaaaaattacccaacataattgttttgggcggcagttttttaccatcaagacatttgcagcgtaattccgttccatgcacttcataataatacatatacgttaaagaaataatcaacgcaccaaaaattaatcgcattataattttattatttacgtcactaccaataattcgtaatatccggtattcccggaaaatcactcaaaactgcgtccatgacacatcaattcccgataagtacccccctttgaaatcggatccccccacataccaatcaatcatacaacacacaggtttaaaaatcgatcacacgtcaattaggtttcaaaatcgataccatttattatcaggaatctagactaattctacaatgacagctctgaatttctctctcgtctttcttgtcaggttctcatcatcaatcttcacttccacccatcggggagtcatcgtcgctccaaaaccctttggggtcactggttggaaaagtctctgacacgatccaggcaccccgtacccagtccgactgatctagcctacggagcatctcaacaggcatgagctgcagggccacggctgtcacggcactgtatcgatgtaacactagggactttctttgcgatgtagccatcaacacggcgtatgccccatagttcgcgtgatacgacgcatgatgggttaaacgttcccatccggcagtgccgtctcgggtccgtgcacacaacagctgcacagcgttatgatgcttaaaattaaccataacgctgggactactgatgaaggagtagtaatgagccaggacgccgtacatcgaaggcaacaagaaagagtgacagcacgatagcaccgggctcttatgtaggcgacagcttatttttcctgacgtcggcaaaaagtacctaaattccccacagatattcagacacggttccgtaaagtgcttctttttttagtgcaggaattggaaaaaataataaaaaatatgaacagctcatctgtaattatctgtgtgacttcatcgtaccgtgatgtaaaaacaacaacaggaagcttacagggtgcggtagaaaattttgccgattgagcaacactgttggcatctctcactccgataggcggctataagatagagaattaaaagtatgatacccacaagaaagataaagagagacaaccaggctagagtatgacgaccgctttttccttgtttgacggttatatgtgcggtatgattttgctgtcgttgcttgtgatgttggacgcctggagtggaaaagtacgtatggttcttaggcgcgcatacggtattattggtggaagtgcagttacgaatcatgacttgagtgacgttacattgagtgcaatcggtacagttgtaaagtcccgatacatacgtgccgttggggcaaggggtacacgttacgctggtacgctccgtgcatactttagtaactctttgtcccaaaccacacggaggacagcattcgttgcccagttgcacttcattatgctgacacactttagtcaccccaagctgcaataatatcacaccgaagcagatgagcatcaccagaggcttcatgcctcctaccggaagaataaaaataactcatggggccgaacggtgtcatcctctccgcggtttgtaatacgagatcgtaaacgtaaataaatgacataacttcactaacccgcatactacaaagtccacctacgacgctgaaagtttttccaggacagaacaggatagtcagccatcttcacagtctacctcttaggccgtatctaggagcataggtaatcagtttgcagccacagtacagcgagcccaagagaccgcacacggtccctgctgggaacacgtaccaccacatcgattcgtcgtgccgtataatcgtagagttttccgaacttttatacacgccggtggcgttagggccgtgtgtgctgctgtgattggacgttttgtgagctaggtaacagctgtgatttcacctgtcgccaagactgacagcgattacccaggtggagcacaatcacatagctgatagacgttaattgatccgttgattcccatggacattttaacggtaacaatacagctcccgttaaacattagattaatagacgttagtggataacagcatgttattcgcccgtgatcgtggttatgcactttcttgttttttgctcatatgctgtaaggtgttcgagaatcgtggggagtatatgtgttgaatcagagtcatctttactgaccgcgccatacttcgtatacgaacttaaccggcgtaaagtgtttcccgatatataaaccggcgcctattgtagctgtagcgcccataggtatggcatatacccacggtgatgttgtgttattcgttttttgtgataaaacgtagcttatgtttagtgtgtgttccgtcacgttatgtgtgtcgttaaaagacggcgtctgtacagtatggctttgagttgtatctttaattgttattgcatttggaggtgttgtgtacagagttgttattgcgtgttcaggtgttacgttttgaggtacagctgtggtgtacacgggctccaaggtgtagttacggagtctttctatgcaggtagtgttgagatatttgtgaatgctggttatgttcgattctgtgaggttaaagtgtgtactatttatggcggtgtaatttagacggtcttgccatcctgaggatgttagtgttaggtaattcgtgttgttcacgtttgcttgatatgtataagtaggtgtactgtttgtgaggtcgcaagtgtgattctcttgcagagattttatccatcttgtgtgaaaatattgagatacgcgatgaatgttttcgctatctatattgtaaagcgtttcggtggtacttaggggttgtttgctgtaactcttattttggacccagggtgtgaaccatgactccaatgtttgtatagtaaggtgtcctattaataaagacgaactgattcctaccgtaatgttatatcgcacacctagggtgccgtttacaaacacggaaatgtttccgttacaaaccacgttggcagatgaattagattccaggtggtaacgataggataatgaccgttcgctcccaacggatgacacaaagtatccgaataaccaacacgcccattcaatccgcatattttaatcacactattcacatttcacacactgcattttttaacatcttatttttttattttatgcgtgttctcacctcttcatctttttaacaccggggtaactatcgtaagtcggtaggcgtcgatagccctcaccgcctcgtcgtccccttcccggcgtggggcaccagcgtccacagcactgcaggtaacacaggtagcataggaaacatacggtgaaaatactccaaaatcccaaaaatgccgcgattccccgagtggcccagggagacatcccggtgtctatgtcggccggcggtgctggcgtcaccggtaaaaatttcggcgggtgtggctgcgaacggtagcagtcgccggggagccggtaacgctgtatcactgtccaacagcggtcgggttcctcgtccggacatgcgggtttccagcaatcctcggcgtcggcgcggccgatatagaagtagttgcgttgaaaaccgcggtacatcccgcagtcgtgattccgtagacgccagggcgtcggcgaccagatctggtctcccagcgagtagcgacctaacgccggcgtgcagcaaggttcgtcgggccggctgagcgtctccagttgcgtcagaattacgaagcgttgcatgatgaggccgtggctatagttgcgcagcacgcattcgtacatgccggccgtgtccgtcgatacgttgaaagtcagcgagaatatttggccgagatgcaactgcgagaaattccaagtggcgtacggcaggcggtattgaagtccattcatcagcctatggcctttgacggcgtccaggatgagctcgtcgctgccgtcgtgggaacgacagaaacgtgcgcgaatggaaaccatgggccaggagtgtgtcatgaccgtgcaggggatggtaacttgctctccctcggcgaccaacaccggcgccggcgacgtggtctcatagttctcggcccacatcttttcggcgatgtcagcggtggcgaaggggaacgaagaggaagaatattcgaggagtcgcgggcagctcaacagcacccagaacagccacggcagagttcggagcgactcccggcggcacatgatgattcttttcttccctttttcgcagagacgctgcccgcctgttcctgctccgtgtgtcggccgctcaaacgtcgggccggcgtggtggtgaccaccgtgcgacgcagcttctcgcccgggatgcccgcaactgagcgtccggtttttttacaggtcttttttgctgcctctccctcgccgtcgcggccgacgtggtggaccagcaccgcgcaggaactctcgcgtcgccggcggtacgcgacctgtctcattgctacctcggatgtttaagaaggaacgtttatctgcgtcacagggtctgatgaagctgccaagagtcgtggctgtggcgtagcgcgttttgtacagcgcgtttcaccgctttctgcatggccgctaccacatcgggtgggagcggctccggcggaagctcgatgagcagttgctgcgaatctcggcgttcggtgtccgccgtttcgtcggacgtggcgtaaaaaaccgaggtggtcgcccagtcgtccacgctgtcgacggcttctgtcagtgccgggttgtcaaaaccgccatcggacgcgggtgataaaagaacgtacgatgacacgctgttagtacgactctcgtcgtcgctttgggaacgacgtgatggacgacggtagatgacctcgtcttgccacgcgtcgaagcggtcgcagcagcgctggatccaagcgcagcgaagcagcttacggaacacgtcgttgttccaaaagtagagcataaagagaaagaaaagtagcgtaacgatgaagccgaaaacgacgagggtcggcagggcactaccgccgctgccgttttttgcgccgtgcgggtgcacggtggtagtgccgttagtctgagcgggggtcatgacaagtctgaagagatgagagcgcgggtgctcatcaggaacagttgaggtgtctccctaccgaagccttagcctctacggtgttttatgatcaacgtgtctacgaacgtcattgtgaaagtgacgtctcaggctttccgaaaccgcgtcaagttcaacgttggtttcggtttagcctgcgtcaccgaggcggaggtggaaatgagccgtcctgtgggggagtgtacgaccctgtagtgcccatgggtaacgttgcatcggaagaagtgaatgcggcattggtgtacgcgtgagtggctttgctctctgactcggaggagttgccgcagcagctgcagactttacgtactagccaaaaacagcaaaggcagcaagtaaatatgagaaggagtccagataatgtccagccgctagcggcaagtagcgcgagctgtggcgcccccaaatcactgccgttagaagcattaatacatgctgtcgatggtgtagtcgtgttagtggtaccagcagaagtagattgactggaattagagctggtacctgtagtggtttcactcgccgatgcggcaagtgcaaataaaactaatatccacagcatgttcgttactatataattgatatacgaacccctttgtcgtgacaatcagcgttatatacgctgtatcggcatcgttttaccggaaagtttatcgtaatgtaacccgcgttgtgtacattcgtactgaaagggaacccccggtgatgtgcacattatactctttcattctggggtttcccaatgacgtaaaaatttccactacacaataaaattactgactcatgtgaaaagtgtgctttttattaacagagcagagggtttacagtagatatatgtttgccagggccaccgttttctaacaccgatcaccgccaccattaccacccgttgaactccacacccgggagccgcctgatcgccagggactcctcaccgtccatcgtccgaacaagctcccgtcaccgatgctgccaccatcaccgagagaaagaaccgcttgctgcagatacgcttgggctcgcctccgtgcggacgccgtttcgtgcagacgctgagtagatcgagcagagaatgtcaaaacgacattaccgcgatccgctcccctcttttttctttttctcattcacgtgtattcttgatgataatgtaccatggctacggtggtgaactgcgtcgcggatcccgtcacgggtttcaacagatcgacgtcggtcagcggcgccgtcaccgccatgtccggcggaggcacgctgtttctctggttagcgacgtggaccgacgacgaagacgatgaacccgcgcggcggtctgttatccgcgacgacgcgtagctgcactgggaagacacttcctcccaacggaccaagatctcatcgggtcgttcggagaaacggtatcgtctgtccgactcccgccgtacggcgccgaggcccagcgacgacaggtccgcgaaccggcgctcgtattccccgtacagctcgcaacagcggatcagccagcggtagctcaaaaacatgcgcaccagtttgaaggtgtcgtgccaatggtaagctagatagcagagaatggccacgatcagcacgagcatcacgccgatgatgggtaacccgacgttcagcggcagatcgtccatggtgaccgtcctctgtccggatctacgtcccagtctctctcttttgtacagcactcgcgcgggaacggccccctcaaccctcttacgtagcgggagatacggcgttctcccgcgggccacttacttgcacggtcgcttgaacggcggcttggaccgccacatgtaccgcatccatccattctggcagcagcgcgttcgacgacgtcgtacgagtcgcggatgatgttaccccgccagcacctccgccggcaaccgcgtcgtcgttgctatcgtcgccggtttcgggcgatgacagcgccggcggcgcgggtctcgtctcgtccaccatttccaccgtgtcgaagcgacagccgctgccgtagtacatggccccgttcaacggccggcgggccgggtcgccgagttccgggtcgggcacatccatggctcgccgtctgcttctctgccgctcgtggtgccgacggcacttctcaggataatgacagccgcaaaatagatcgtggagcatgtctcgccaactgtcctggtggtaatatcttaagtacgcgatgagcgcgccgatggccataatcataagcgtaagcaaaacggcacagataacgtgaaacaccgcggtcatccaagtcgggcggcgtcggggacgcggtgggtcggtttctcttacgccggcgtcactcagccaccacacccgtagtcgacattcccagaaccggtgaatgcgactcaggacctttcgacgccgccatttatttccaacgtccaagtcccacgtcatttctggcatctccacgcccttgactgacatactctctttctctctcttagctgcggtgaaaaagagggaaggcgtgtgctgctatacaactgtacaacggacgcgctcgctgtttcggtctcaggtcatctgcattgactcggcgtccttcatgacgctctgcaccgccttttccaagagttcctcgatgtccgaccatcgaggaggcggggctaactcggaaaccgacacgataggcagcgtggtcggctccgtcggcgtgcggggtcggggacagggacacgagagtcccaccttcgagagattctccagcccgacggtgcgcggcagtctcggattccgcggtggcttttgtggcgtcggcgttttcgggaagggcctgggcgtcaccggcggtgtccagccgaccggcttgggtttcgtgggcggcggtgttttcttggtgggcggcgtgctcaggttcttacgcggcgcgggtatcggcgtcgggggcctgtgcgacgacagccgcgtggtgggggcccggaccggcggcgtaggcggccgcttcttgcgcccgggcggcggaggtggcttccaggatggcggcggctgatgcagtaccgtgtcgacgctggccgaggacgacaaagagctcgacgaggagcaatgcgacggagatcggccgatgctggtcggcgttcccggcgtggatacgtcggggatctcgaatcgcgccggaggaaactcgggtttatctatcggcagaccatcctctcctatgtagagcgacgtacaccgcggcacctgcggcgtcggcgggtgggtggccacccgcatgagccccagttccagatccagcggctcaacgacgtcttctttcggaattcgatagcagcacgcgcaggcaccacgcttatcagaagcagcacccgggagccggcctcgcgacgaagtctcgtcggatcgcttgcggcctcggcgctgggtaaataaggaaatggccaggaccagggaagccagtccggtaccgccgaggagcccgacgccgagccacagccacaccatgatcttctctcctgcttggaatctcaaactccgtgtcgggaagggccggtgtacggacatttatgccttggatttctggaaacgtcattttttggcaaggaatgtgtttattgtccaaacactgaggaaggagatgtgagccaagtcggaaaattccttatcacaccgggggcgggttacgttccggtctgatgctgctgctgttgttgtagagccgcggccatggccgcctgcacggcagcttgtaccgcctcggccacgccgggtggcatctgcggcatggcggggggagacgcgtcgggcggaccgccgggcatcgccgtcggctgcgacggtggttgtgaactcaccgtcggctcgcacggaggtttgttcttcggtctacccttcggtttgtctttcgccctacctttcttcggtttgggttccgatgtcggtgttggcggttgcggtgggatgacgggctggtgggactcctccgacggcggggggacgaacaccgtcggcgccgaaaccgggggactctcgactatctcgcagatcaccctgtcaggatcgtcgccgtgtccgggacgccgtcgatgaccgtattggaccatgtcgtaaatcatcgtctccttgtaacacgctgaacagcagcggctacaggggcccgagatgcatttgcagctgcacttacagctgcagctgcagtagcgaacccatcggcaggtaaggaggtcgattacggagtctttgaagaattcccggtaacggatgagatacgcgcagaggaaaatcatgaaaacagaacagccgactacggctgcgatgccgggtcccgaagagacatccgccgacgatcccgccaaacaccaaattcctaaagccgcgcatgttatccaggccacaataatcgtgggaacgccccattggcattgccacgaaggatcgtgcacgtcgcaacccattgctactgcgttctcccacaaacgccatcgcactatttatctctacagcggctgccgagtcacgtccgccggcgcccatcggccgcggcgatctcctagtaacactcgtccgacacttccaccatctccagctcggccggcggttcggcgtcctccaccagcggcgtcgtctcatctttgccacagcagcggacgcacaccttctccaggcagaacgccaccagctgccgccgaacgtaccacaggtacacgtgcagacctgcgaacaggactacggaggtcatgaccaccacgacacacacgggaatccagggatcaaaattgctatcggaactcatggctatcgccgccgacgtgcgcgcgtgtgtctcaccgccgctcgcccgttgtcgcgcggcttgttatacgctagcccgtcgccgcctcggggcacggtgccctcctacccacgtaacttcctccgtgacttaaagtcgcgtgtggtagatctcctgctccgtggacgaaccgtccggcaggatagcggttaaggattcggtgctaaggccgtgtcgccaacgtcgaatgctacgttgcaacagcttcgacggacggccatcctccctctcatcgcaataataaaacaccagcagcgcgcacgacgcgatcacggtaacccccatgactagacccacgcagatagccagccccgctagcgtatccagcgccatcccgttcgctcccgtcgtcgtctcctgaacaaagcaacaactccgcagtccccgttttcaaccgtttttgtttccttctccgcgagcaaatgttaactcccgcggtctttccggccgtgctctacctcctggcgcttgtcgtctgggttgagatgttctgcctcgtcgccgtagccgtcgtcgagcgcgagatcgcctgggcgctgctgttgcggatgctggtcgttggcctgatggtggaagtcggcgccgccgccgcttggaccttcgtgcgttgtctcgcctatcagcgttccttccccgtgcttacagccttcccctgaaacccacgttaaccgaccgtcccgaaaacgccggtgttaacacaggaaaaaaagaaaccacgcaggaaccgcgcaggaaccacgcggaacatgggacactatctggaaatcctgttcaacgtcatcgtcttcactctgctgctcggcgtcatggtcagtatcgtcgcttggtacttcacgtgaaccaccgtcgtcccggtttaaaaaccatcatcgacggccgttataaagccacccggacacgcgccgcggcacttgcctacggcgctgctccagggaaactcctcttccttctgctcttcctccttcaccgcagggatcgtttccctcggccagggacataccgaagcaactaccggaacaacctggaggagtcgcggcatgacggcgcccaagtgtgtcaccaccacgacctatctggtcaagaccaaggagcagccctggtggcccgacaacgccatcaggagatggtggatcagcgttgccatcgtcatcttcatcggagtctgtctggtggccctgatgtactttacgcagcagcaggcacgcaacgggagcggcagcggctagacaagtcccaggcggctacagctccaagcgccgtagccggcccgcctgccgatcgcgacgtcgtggaccatcgaacagagagtcacgcgtacgagaccccgaggtacgccacgcggtgcctaacgcggtataccacacccgtacggtctgcagtgcggcgtacaacgtgtggaaaacgcgttgcgtcgcagagtccgccacgtccctgtcttgtcgctccccaatcgtctcccgcacaccccccgcggcacccagagggcgggtgaggcaagtattcttaaggccgttctccgttccatagcccataaattgttgattccggagctcgttggcgcggaaatagccggataaggggagcaacaaccgtcggcgaaagccgtcccggtcattcagtccgggtttcgcgtccagtcggacgtgtgaccgttgggcaacggaacggcgtttcactgccaaaattgtatcgggtagtgtacgagacgtcggcggtgcagaatgcgactcgcggcgtagctcgccgtcgctatgcggctcgtcgccgtgtggcgcggcctggccggctgtctgcgcccagatctgttggccttttggttcctctggctgctgctgcgtgtgtgctttggcagacgcggtggcagtttgcggtctgcggtaagtgaggatgttgccgagcaagcgcacttgcggcgcgtgatcggcacgcgtgttattgtaggttcgttgccagatggcaagtgctgtcaacagcagacgttgtgggcggtcggtgtatttttgtgggttgcggtgagagtcggcactcggtgttttgtgagtgatctcaacagtttgtgttgcttttagcagcgtccaaaacagcgacgcgactttggggatggcctcgtgctcaccgccgcggagagtgtcgccggacctgctcgtcagcagcgagctacgcagacggaatatctggaggagagttacgtgtgtcacaggagagcgcgggtctccggcggtaacgacggcggtgtcgtcgacacgtgtgcggcctgctgtgctctgcggaaaagcgccggtctcggagaccgtggacgaaaaagagaacggagcagctaccgctggcggcggcggcgttaatgctgccgttgatgttagacgttgtgagtactcggaaacagcggtgaggcagaagctcgatccttcagggaacgacagtcgatgtgtggtagccgcagcaggtgaggttggggcggataacgtgttgcggatcgtggcgagaacgtcgtcctccccttcttcaccgccccacccaccctcggttggtgtttcttttttcttgtgtcctgcagatagttccacggacagcgacggcaagtccataatcgccggtgtgcaagtggtggaccacgacgaagatatcatcgcgccgcagagtttgtggtgcacggcgttcaaggaagccctctgggatgtggctctgttggaagtgccgcgttgggcgtggcagggctggaagaggtggcgcaacagcgagtctgggcgtcgatggagtgctgggtctgcgtcggcttccagcttgtctgacttggcgggcgaggccgttggagaattggtgggatcggtcgtcgcgtacgtgatccttgaacgtctgtggttggcagccaggggctgggtgtgcgaaaccggtgtggaagccgaggaggctatggcgcggcggcgacagcgcatgctgtggcgtatgttctctcgtggaggcgacggcgaatgcagcagacggtgttcgatggagatggcgtgcgaggaagaaagcgccgtgttgtgagcagacgacgttggatgcgggacgtcggagcacatgggccatgtgtggtggcagatggcggtgtccacttgtgcttgtcgcggcagtgcacagacgaagcaacatgtcgctgtgaagagatagagtgtgagcatagctgtatgcagcgttgcgtgtagaagcggggggatgaagacgttaataaagagtagcggcggttgtgatagggcgaccgctgaggcgagctgcgtgtgcgtgccgtctgtgttccccgtgtccgccgcgaaaggcccccgtccccgtccccgccgcaagagtcccccgtccccgccacgcaacagctcgccatcccgcaactccccgtccccgccgcgaaatgcccctgtccccgtcctcaccaccgtccccgccgcaagagtcccccgtccccggcacgcaacagcccgccatcccgcgacgccccgtccccgcacaccccccgtccccgcacaccccccgtccccgcacaccccccgtccccgcacaccccccgtccccggcgcaacccccgtccctgtccccagcgtaactcccgttaccggcgccggcgcccagcacgcccgaaaacaacgccgtcgccgccccgaaaagcgaagcgctgcgcaaaagctgcgtagaaacgccgcacaaacaccgtagaaacacccgccgccaacccccgagcgcccgcaacaccccgtccccggcgctggtccgcgaaaaaaaacaccgcgggacgccacgcaacggcagtgcgcacaaagcgccggacacagcacgccgcaaacgcgctgaggacgccgacgcgcttacttatgtcacgcaacactccctcagccctgtccagtgtcggactggcggaacgacaagtgctgtggagccacacgcaccggcagcgcgcagaaagcgccgtggacagcaagccgcagaagcggcggagcgcttgcggcgccataaaggcgcttagccctgtcccgcaccggcggcggtcggggtgtgtcgggggcgcggcggggtgggtgtgtgccgggtgtggcgggtgtgtcagggtgtgccgcgggtgtgtcgcgggcgtgtgccgggtgtgtcggggtgtgttggccgggtgtgtcgcgggcgtgtgccgggtgtgtcggggtgtgttggccgggtgtgtcgcgggcgtgtgccgggtgtgtcggcggggtgtgtcaggggtgtgtcggggtgtgttggcgggccgtgtctgcgtgtgtcctcgacgcgggttgtgcagtgtgccccggggcccgcgactcctcccttgcgcccgcgtcttgtctggccgttgttttgcgtgtgtccccaaggacccgcgctgccgtcccctggggactcaaacagacacagacgcgcgtctgcttttcgccgtgcgcgccgcacgtcgcttttattcgccgtcgccgtacccaccgcagcacacgcaactagtcgccgtcgccgtccacacacgcaactccaaatttcacccccccgcagaaaacacccccccgcccctcggggacccagcacacggcccggaatggatgtcgggcgtccacctaggagggtgcgcgctcggggacccagtccgcggccctgttgcgcgtgttcctccgggttcctgccttttccagtcgagtgcgtcgtcggctgccgggtggttttccacggccttccagactgcacggccccaaggcggcgccagcaagcgccatacacgtcgctgcctataaaagccaggtgcgtgtctgccgtggcacacggacgacggagccgtccgcgtgtgtaaacggcgtggtcgctgacgcgggtttgcttcctatatagtggacgtcggaggtgtccggcggccatggcccagcgcaacggcatgtcgccgcgccccccgcccctcggtcgcggccgcggggccggagggccttcgggggttggttcctctcctccttcttcttgtgtgccgatgggagcgacgtcaacagcgggcactggtgcgagtgctgcgcctacggcgacgccgggccacggcgtccaccgggtagaaccccgcgggccgccgggcgcccctccgagtagcggcaacaacagcaacttttggcacggcccggagcgcctgttgctgtctcagattccggtggagcgccaggcgctgacggagctggaataccaggccatgggcgccgtgtggcgcgcggcgtttctggccaacagcacgggccgcgccatgcgcaagtggtcgcagcgcgacgcgggcacgctgctgccgctcggacggccgtacggattctacgcgcgggtgacgccgcgcagccagatgaacggcgtgggcgcgacggacctgcgtcagctgtcgccgcgggacgcgtggatcgtgctggtggcgaccgtggtgcacgaggtggaccccgcggccgacccgacggtgggcgacaaggccggccatcccgagggtctgtgcgcgcaggacggactgtacctggcgctgggcgccgggttccgcgtgttcgtctacgacctggcgaacaacacgctgatcctagcggcgcgcgacgcggacgagtggtttcggcacggcgcgggcgaggtggtgcggctgtaccgctgcaaccggctgggcgtgggcaccccgcgcgcgacgctgctgcctcagccggcgctccgacagacgttgctgcgcgccgaggaggcgacggcgctcggacgggagctgcgccggcggtgggccggcacgacggtggcactacagacgccgggaaggcgactgcagccgatggtgctgctgggcgcgtggcaggagctggcgcagtacgagccgttcgcgtcggcgccgcaccccgcgtcgctgctgacggccgtgcgtcggcacctgaaccagcgtctgtgctgcggctggctggcgctgggcgcggtgctgcccgcgcggtggctgggttgcgcggcggggccggcgacggggacgacgtcgccgccagcggcgagcggcacggagacggaggccgccggcggggacgcgccgtgcgcgatggcaggagccgtggggtctgctgtgactatacctccgcagccgtacggaggcgccggcgggagcgcgatttgcgtgccaaacgcggacgcgcacgcggtggtcggggcggacgcgacggcggcggcagcggcagcagcggcggcgccgacggtgatggtgggtccgacggcgatggcgggtccggcggcgtcggggaccgtgccgcgcgccatgctggtggtggtgctggacgagctgggcgccgtgttcgggtactgcccgctggacgggcacgtgtacccgctggcggcggagctgtcgcactttctgcgcgcgggcgtgctgggcgcgctggcgctggggcgcgagtcggcgcccgccgccgaggccgcgcggcggctgctgcccgagctggaccgcgagcagtgggagcggccgcgctgggacgcgctgcacctgcacccgcgcgccgcgctgtgggcgcgcgagccgcacgggcagtgggagttcatgtttcgcgaacaacgcggtgaccccatacatgatcccgtcgcatttcgtctttcggacgctcgaactctcggtctcgacctcaccaccgtcatgacagagcgtcaaagtcaattgcccgaaaagtatatcggtttctatcagattaggaaacctccttggctcatggaacaacctccacccccatctcgccaaaccaaaccggacgctgcaacgatgcccccaccgctcagtgctcaggcaagcgtcagctatgcgctccgatacgatgatgagtcttggcgcccgctcagcacagttgacgaccacaaagcctggttggatctcgacgaatcacattgggtcctcggggacagccgacccgacgatataaaacaacgcagactgctgaaggccactcaacgacgaggcgccgaaatcgacagacccatgcctgtcgtgcctgaagaatgttacgaccaacgcttcactaccgaaggccaccaggtcatcccgttgtgcgcgtccgaacccgaggatgacgacgaagatcctacctacgacgaattgccgtcgcgcccaccccagaaacataagccgccagacaaacctccgcgcttatgcaaaacgggccccggcccacctccgctgccgccaaagcaacggcacggttccaccgacggaaaagtttctgcgccccgacagtcggagcatcataaaagacagacccgaccgccaagaccgccaccgcccaaattcggggatagaaccgcggcccatctctcgcaaaatatgcgagacatgtacctcgatatgtgtacatcttcgggccacaggccacggccgccagcacctccgcggccgaaaaaatgtcaaacacacgcccctcaccacgttcatcattgaaagtctctccagtccctatgttgtcaggacgtgctgtcgttcttcgcttgctgcgaagcccgttcttccgagtcgtgtcgctgcgtccagcgtcgcgcccaagatgggaatttgggtcttttcacgcgtagcctcctccaccacggctgctgatcgccgtcactaaggaccgacacggaggatgacgaggagcttctccccgactccgcggtccgcgaccggctacgtagcgcgtgtccctgccagtctccgcagttacaccacacgtcgtgagcagcgtgcacctgctgccgccactgggcctcggcgtgctcaggccacccgccggagcccggtctgagctccgacgcaggatgcgcgtactcaacgtgcgccttccagtccatacagcaacaccataggtcgtgtgagtcgtcggctacccgccgccaggccagttcccgcatgggaaggctggacacgccgaccgagaggtcaccgagcccggacgccatctcttcttcctctccgtcgctgtcattaagcagccaggtcacctcctccgctccgcggtccgccggtctcgacggaccgcgccgccgtcggcaacacggaaaacagcacgccagcccgagccgctaaggccgcatgcccctgccgcccaactgaacacgcataccccgctcaactgcgttttgccacccctgccagtgctctcgctcgagcaccaccccgtatctcccaacctttttccaataaacgaaaccgacatgacatacgtaatgggtgctcgtggctacatttattgaaacaaaccgcgatcccgggcgtcttagcacacgaaaaaccgcatccacatcatagacaagttacagtccacagtcacatacacgataaacaataccaacagggtaatgtttatggagtaaaacactattgtccaggccacatgcgtgtatgacttccgcaccatcccgtactgcatgttccacatgtacgcgctagacgtgtaatccactcgcagttcggggacgcaacgcagccagatcacatccccttgcagtaccagacgcagggctagcgtctcgaagatcggcatcacatctaagttccgcacgttccactttaacgactccccgggaacgaactccacgtcgtcggcgtgtacgtacaggttctctcccacgccgccataatcggccttcggatcgaagacgaaccgactcatgttgcccacgatgctcccccgagcaaacaacttgccgttgtcaatgtagcaccggttgtcctcgatctcaaaccaggggtgcttggccgtggacttccagggccggagcgcgtcttccccggctttagtgatgccatcgggcaggcggatcaagggacccatggaggtccaaagacccacccaggctttccagagattgttcatggtgaaacagcgtgtggactgtacgctctttcccaagttatatcccagagtagtgacgtgagcccagccacctcccagattcctgacgttttggttagctttcctgccaattcctcccgtagacttatgattctcctagcccattcccgataaaaatacacggagacagtagatagagttacgaataaaccggtttatttattcaagtgtctcaggagattattgaacgagcgtggataccacgccatcgtcagttcatggtggcattgagcagccatagcaccagagtcccggcgcccggtatcagacatgctgacctaccgggcgcctccgagtccatatcccgcggcctgggtgttagagtccgtacctggcagcccaggtaggtttcaggtaccagctggttcgtacctgttaaataaatcgcagacgggcgctcacccctacggtcaggagcacaagaacaaccagagagaacagatatacgagcagggttctgaacagcagaccccaattgtcgtctctcatgcttcgctgaaggtaccagttgatggtctgagagctatagtccatcctcacctggggaacacacgcggcatatttcttggggtctccccacctcgtagacaacgtgatgtccaccatatccacggtgtgcgacaccgggtacccaccgatgttccactcgaaataggctccgcgctcatcatggtggtactgctcaccggacacttgcaatctgtccatgtaagattgagagacgatacccacgttcacaaagtgtttcttggtgaagttgcccgacatcctccccttgaagtacagcatgcccatatggaaccagcattggttctcctccacccgaaagtgggccgatttgatctccgataccaccacattcaggggccggggcaccgagtccgcgagtctcaggaacaggacggccaggatcgcgagcaccaacaccggcttcatggctccgaaggtccgctgctcggctccgctcaccgctccggtctggctgcagcagtgcttcgctgagaagtagcgtgtggactgcacggtgtttttgaatatatagcgtttcttggtgacgttgtttcccctacgtagtaggcaactacgtgccaaaagaggcgttacggtactttccgtaccgggatttccaaaccgcgactttccacacggcggtttcaacaccgggacttttcacacggtgatttcggcaccgggactttccacacggcggtttcgccaccgctgacgttctcatcgccgcccacgtcaacggtggcgacaccgtactttcccatgcggtttataaacgtcaagagtcacgtcagtcgcccacccccattacacggcgatatcccgatagggcatgaggggacccgggtgtcgcgacatgtcgacgacaggtgcggattagtggtcgtgtcgcgacatggacgtgcagggggatgtctgtcgcgatagagttgatgtgacagcccgctacacctctctgtcgcgacatgcatacacaacgggccggcttgtcggcgattgtcgcgacatatcgttatcagttagcgaccggagttgtctatcgcgacatatcgtcgactatcgcgacagaaaaaataccgttcgtagagaatgccgtgttgaaggaacgcgcttttattgagacgataaaacagcatcaggagccacaacgtcgaatcccacgtccagtcgattcgtatgttatgctgcacagcaatgctagaataacaaccagcagggtaatcccgcaacataaatacaaagtcacagcgaagaatccgtgtcgttctatcaagcgaaacgcgttccaaacggccccgtcacagacgcagttattcataagcgttaacaaccggtggctaggatgaatatccaaatcacagggcagtagccgacggactcgttgacaggtcagcctaccctcaaggttcctatcgttcggacgggatttgtgcgttttaggcctctttttcgccgcctgcaagcattggtgcgcaaagtcctcacccagctgtttccagctatcatctgcatctgtgcagtcccctgtatcgttgtaacaaacgggtctgtgcgactttgttctcggaacacaagcttgtcgcggagacagagagagaagggttttcgggtcacgcgaagaccgctcaccgggggtcggcaacgcacacatcaacagaaaaccgagacggatcaagaggtccatagtgaagaaggagcgatatcgacgtacttacgaaacggcgattatatatgttctcaacaataccgccctacgttgtatgatgtaacgtgtgacgtgagtctgatccaacactgaacgctttcgtcgtgtttttcatgcagcttttacggaccatgacaagcctgacgagagcgttcatcggggcatgaagtacgcattacacaaactccatatatttgttacgatagaatacggaacggaggaggctttcgccacacctatcctgaaagcgttgcattctttatgataggtgtgacgatgtctttaccattcccacggctgctttgcgtgatgatgacattcatcatgtatttccattcacacataccttttgtgcatacggtttatatatgaccatccacgcttataacgaacctaacagtttattagcccttgacaggataggtcaaaagattatatgtaggttttccggtaaaccgaattgtgatatttctctgcaggaaatagaacagcctggtacctataaaacggacaatgcagtactgtagcagcgtaaccaagtaggtccacatgaacacgtacaaaattatggtaagccatcgtttttcataccacagcctgtagctgtcgtacatgaatgaggacggtcgaggaacccagggtagttgtaattgggggcgacattcgtactgtccagaagacaattgcacgggtttcagtgagatgagtactttagcgatgtcggcgggggcgctacgtttcaccgtgacggtgagaacttgaccgtcgttttgtacttcatgaggcacgttatacaagccactggtatcatgaaggatgacctctgatgcgatgtgaggattaaattgtccctcaaaccgccaaacgctggtcatgtttccaccgtcaattacgcagctgacggtgtgagataccacgatgttggacttaggtttgggggctaattgcctttttacaaattcccttctgtattgcaggtcctgctgccactgcttttccgtgcggaaagtcgccatgtcttccacacgtgtggcgacgatagacgccaccaaggtagataccagaagcagctggatccgcatggtattaccgtatgtcaattagaaagttgagcggacacggttatcgttcctggcggatataagtatataaacgcgagttagcctttcccgtccgttttgtacacccgttccccacacaaatgacgaatacgaccttttttttttataaaaataaaccacgtgtattatagaaaaacatttacatagaaaagagacacacggatcaacataaggacttttcacacttttggggtacacaggcgtgccaccgcagatagtaagcgctggatacacggtatacagtcctggccagcacgtatcccaacagcagcaccatcgccatctgtatggcgatcacgaccccgagctctaagtgtctgtattcatagtgtagtcgtcgcaggttatccactgaattcccgtaactgaaataacgtatatggtaccgaggctggcaccacatgggtttgcatttggtgcacggcaccaaatgcagagtgagatggtccaagtccgtgggcacccactggcgcaaacggaatacggcttcggtggtctccacgaggcactccggggcgtgcagacggccccactttcgtccgcgacggcccgaccagccgacccgagccactatccctttctcgggatagaacgtaccctgtacacgccacacagcgtccaacacgccgtccttgacgacgcagctggcctgatagctggacacgttgttaagcggcggaaagcgaaactgacgtgccggcggagccacatagttcggttcaccgtgttgtcgcggttcgtcctccctatagtaatagtagtcgtcgtcctcataggggttgccggcgtgagccagcgttacccaacagcagcccaggccgacgaggaggcgcagccaccgcctcatggcggcttcgccagtcaatcgtctttagcctcttcttcccgtgaagtccttccggtggcgcggtgccgacctcggacccagggacgtatccacctcaggtacacacagcaggctacctggacaccgaagctgaacaaggctacgtgtttcacaaactgcaccagtaccacatagaggaatgtcaggtagcgtctctccgcaaacagccgttccaagtctgagggcgttacccgcagcggcaaccagggcagcctggacgccggccggcaatggagcacgctccggttacaggcactgcaggggtaaacggttaacatcacgtaagagagtcgtgcgtccacctgtgggagctcagtttcgtaacgtagagccccgtcattttccagctggggtgcgccgaccttgaaatgggtcgcgctccgctcgttaccccaggtgccgtaggctctcggggccgtatcggagaagttgccacgcacaagccaggcggccacgagtaccccgtgctggacgtaacattcggacacggaactggagacacggtagccggacacgtccccaaacccgcgagggtactggggcagacgaacggacttgctatttgacaacggacagatacgagacgacgaggacgcagacgactcgtcgctggaccacgacaaccggagcgactccttggagcggctcgagagtacacttactgcgatcagacaccagtgccagaagaaggaacaggtggacggggaccacaggatcatagccgccggcaccgcggccggccgcaggaagccgcccggcgcgtcgtctgtgtgcgggagccgaaacaccgtgcctctttatatcgtcccgacgtgacgcgagtattacgtgtcaggggaaacccccgtcacgacgaacgtgatttgtaagtgacgcggggtgctgacggggttcggcccgagaggtgacggagcgcctcacgtcagtatgatgtccgatccgcgtcagccccgacgtggttgtggtcaccgaaacccacgtttatatggacgttgagagcagcgcctgaccacatgattcatcataccatttctcggaatcgggcccatgccgggaaagcacattccttttcagtaaacaacaatgacatcataacaaatcattttattcgcgaggtggataataaccgcatatcaggaggagggatcgggtgatgacgcaggccccgcagaacagtccgaaataaatttttagtattgccccatagtcgcctagataccagaggtacgtcaagttcatcaaaacgcccatcggcgtcccggaatcgtataccgggcacacgaagcgttcataacaatcccgggaggcgagtgttagggtagcagagtagtttcggggtcggtttccttccggcgacgacagttccgtgggcagcagaatgtacagcgcctcggtagctgtcgcggtgccttccacgaggatgggctgccggtgcctttcgtgattttccccgtcgtgtagccaagccgaggcccgcaaagtcttaggcgaggggaattgtccatagagtttcaccgcacccttcagtacatggttctgaataacacagccgcacgtgaagtaggtaggttctctcgtctcctccgtggctgccgccaccactcccagccaccacaacaggcagatcgccagagggttccggaggcttccccggcgtagcatggttttgggttaaagcaaaaagtctggtgagtcgtttccgagcgactcgagatgcactccgcttcagtctatatatcaccactggtccgaaaacatccagggaaaatgtcggtgcagccaacctttcacatacagcccccaaaacacttgaatcactgccaccatcatcagcgtatactgcgccgacttaatcgtgagcgcgtagtacgccattagacggcgatcttcgaacaatagtcgttcgatgtcctctaacgagctccacaggggaacccaaggcacgaggcaccggggttcgcactctacataataagtttggcattgatgacagggggaaaagtagaacaacacgagttttgtgcgttggggaacacgatagtcccggagccagtagcgttttgcgacgaggctttcggagatgtcctccaccggcgtcggcactcgatccgcgtagccctccagcgtctggtagtacacccggggtgtcggcgtgggcacggacaggttcccgcgcagggtccacagagcctccagtcgaccgcccgatcggagcacgcagcgcgcctcggaatactctactcggtactccgaaacatcgggcagaggcggtaacggctccgtctccaccaagggcggaggttcatcgaaaagagtcaaggataattcaggcatactacccgcgaccggggcccagagggctagaataagcattacaagattcattctgtcttacaagggaaggctgttcccctgtctagactcaaaagctgtaaggctatcttatagcatgtagtcttgcacgtcacggggaacagggtggtgatctagtgacgtcgggagaacacggtgttttagggtgcgggggacaaaggacagtacgacagattaggtgatagaaacgtttttttttatttatgaaaaagccagtgtgccgtgcggcctagggccccggcgtagtttggataccagatgggggccgtcaggggtactaccacgagcagaaacataatgacttggtccatatatagcagcatagcggtgcgcagcaggtcgccgtccgtgtagcaatttgacggtgagcgataaagcaccgttaatgtgtcgcggataagcacgatcttgaggccgtagatgaagctcacagtcagtgctaaaatgatgcgttggtatggttcccaggactgcacggcgatgaagagccagagtatgggaagcatgaaacttagcaaacagaggatggctaaccgtcgttgcatgttccaggccatgagccaggctaggcccgtacaccagacgcagagcatggatgacaggacataggcctggattaccacggtgcgatcgaaacacagcccgatggtggacacggatatcgtagtgagggtggtatataccatgaccagcatcagggtcccgggtcggcgctgacgttccagccagtacgcgtggcaacgcagagcacagggtagcagtgtgctccagaagggcagtgtatcgcgcaggtagggggttgtcacgcgccacggtatgagcatgaaaaggatggtagtggctatggtggcgctggtctggaacacgacggtgccgtagagacgtaccatccagagaaagtgttgaacgctccgcagggtgtcttcatctttggtgattacggtgactcgacggatcggcggtggtgacggcggcgacacgggtgggggtttctctttcttatggccgagtggctcgccttggtgaaactggatctgtaccatgacgggtgctcgacgaacagtcgtcggggcttcaggtacccggcaagttttatagagaaagggggacgatgggtggtggctacgagccaccgccaccttcgcaatacgaggatctgaaggcggcaaagacggtcgtccagggcaggcgccagaggttgggactgagcacgatcagcgtgattttaaacatggtcaccagtcctacgtagatcagcagcgagccgcgtaacgtctgagcagccggcagttcgtcgcggatgtaacgcgtgccgtagaaagtcacggtcatcataaggaagacgatggcgccgtagccgtagagtagaatacgctgatgatggaacacggtctggtcgccgataacccagagcgtgatgaaaaaaacgctggtgagcacccgtgagcatatgagctcccaacgcttagcgcgaaaactgtccccaaccatgacagcgccggtgcaagctatccacagcgtgaggaccagtgtgtagtcgatgaggatggcgggcaggtcggagcaccaggtgtagaaaaccgtggtaacggagaggaggcctacgtagcccatggtcaataccacgtcgtcggggtgcctttcgccctgtatcaagaccaaacaccagagaagggagggggcaaaaaccagcagcagaggggaagattcatgttgacatatgttgtgggaatcggggatacccagccaaatcattccgcagaaagccgtactgatggcgatgtgaaagaccactagggcgtagacccggacgaggacagcaaaacggcgcagccacataaggccgtggtgcagctgcaggagggaagcccattgcggcgaatgtagcgacggcagcggcgggtccatgaggcgggtgatgcgcccgagtgaacgggtgagcgtctcggtggagtcttcttataaaccagcgggtctcaagcaaccctgctctggaacgtcgcggtggtgctgttgaggatgacgctgagcgtgccgttgtcaacccggtaatgatgataggtgcccagcttggccaggtagctgaacatttggtcccagcgtgccgaccacaccacgggcgtgagcatcaggagtgtggtgtgatagatgagtgtctcggtggcgtaaagtaccagcgagctgcggatgatgtggctcacgggcattttggtggcgatgtagcgcacgtcttggaaaaggacggccaggatgcagcccacgaacacggtgtagagacacagcagagtcttatgcaaccaggtgtaagtagaagccaggacgctgaccatcaccgtcaaaagtgtggaggtgaaaagcgcgtcacgccacacagagctgaggcggtgttcccaagccacgccgttgcaggccacgaacaacgtccacgttaggatgaggctggaaacgccgatgggcgctgtggcgcacaggttgagcccggcggtggtgaacgagagaagcgccacatacagtgcaaacaccaggccgttgctggggtgtctgtggtcggtgagctccagcgcgcccagaaccaacaccggtgtgcagctaagcaatagcggcgagggatcgtcgcggcactcgtagcccagtgaggggtaacccagccaaaccagcgcgctaatgagtacgctgaaagcggtttccagcgtcagcaatccgtagacacgcatgacgatcgcggtccgacgtagccaacacaccgcatcttcggaagctgtggacgctgtttccgaataccgggaggagatcgtgcttccctcttccaaggatcggaaagtagcgtccgtcgtttccgcggacgcggcttccctggtacgctccgtttccgacgacgcggtttcccgctgcgtggaaactgtctccatgtcgggaccgcagcgcccggcggcgtatccgcaaggtctcgaagctacagcttgtcagaggaaaagtaggtttgcaaaaaggtgcgcagggtcatgattctcagcaccatcagcagagtgaaaaccaggctgagaaacaccttgacggccgccaaaagcgcgcgttccagcggcgtctcgtagcgtacagccagggccgcttcgtggaaatgcgagacggctagacaggtaatgagcacgctgaaggacaagacgatcttaaagcaccaggaccaaccacgcctcaagatgaccaccacgattgccgtgaaggtcaacgtgatcaaagcatggatgaccacgatctgacggcggacggtacgttcgggagccaacaacgctacgccggtgcagctgagaaaggccagtaaggtgaacaacgcggccgagatgaccaacgtaccgtccaggcagagacatattacgatcaacggcggcacgtgaagcagcgtgtaaaagagcagaacgccgatattgctgggatgcgatgtttcgtaacagtgaatgaagatcaccgacgtgacgggtatgacaaagacgaggctgggcgaggactccgtgagacacagacgggaatggtgaaaccacgtcgcgggcgccgcgtagcagaaggcgctcaacaacgcggtcaagccggccagctgccaacccacggcgccataggtgtgcagcgccacgcggcaacagtcgacccaagccagactgcgggtcgccagccgggtctcttggatcccggggggcacgtagatgaccgtgccatcggtgggtacttgaaaccctttttctcttctcatggtgcgctgcgttctctggaaacggctgctctgtccgaaaaccagttccgaacgaaaatctagggcgagagggtggacaacggcgttgacgacgaagcatgggacaggtcgttcggcgttaacgtcatcgcgtcggacgacggtagttctaagagacgtagatcgctcagcaggtcctgacagttgcggattcgcaagatcagaaaaaaaagggaaatgaacgtaataaagagctgtagcgacgtatgcgccacatcgcgtggcataagaacgtgacggacgaaaaggacctgctgcgaaaagtggccggcgaagataaggcccaccgtgctgtagaagcccaaaagcagccgcaggggccaagtccagggccgcgtgaagacgatgagaacgttagccagaaagaccacgacccagacgccgttgatgagggcaaattgatcggacagggtgcagttgtcgcgacagatgaagactacttccgcgcagagcaaggtgatgaccaacgtgagcacaaacgacgtcaacacctcgcggggctcctggcaggcacacgtgacacctagcgccgggatgtgcgccaggaggccggcgagtaatagcaccagctgtcggaacggacgacggcagcgcgggtgccggtttcgctgagcgagaaccggtcgctcatagcggaaatacacgaagagcgcggaggccacaggcaccaggaggagcacctcgggcgcccagacaacgtgacaaggaaagcccggacgcgacttgagagtcgctgtagggaagaccagagagaagctacccaagacggccaccgccgtggagatttggaagaggagcaagccggcgattcggacgacaacctcgaagcgatgcacccagcccagcacggccaccacggccgcttcatcatagtcgtcgttgttgccgctgtcgaacagccgccgaaacacgatctgtcgctgggtcgcggtgggaaagcgcagacccatgacagccggaggctatatgaccgcgcgtctaagacgcgagatccgtggggggacttttagatgtttgggcggcccgcggttctaacaggcttgattggtggagacggccggcgcggcgggtgggggaaacgacgagtttttccgttacgccatggttcgcgtgaggtttctctgtacctcccgcaaaaggtcacagcccgaaatggaggccgcgttggtggccccggtggcgcgtgacgataaccaggtcatccaagcgatgagtttgtctaatgagtcctcggtggtgaaaaggatgagaatgagcaggtacaggtacaccaggttctcatagagacacaaggtgagcaggtcggcctcggaccacgcgatctcaaacaggcgcgtggtgtcaaagaccgtgacgaccagcatgaagctgagcgccatggcgtaatagcccaaaaaaagtttgtgccccaacggtacgggctgcaggtaaagtgcgatcaagaacgcgataacgccgatcacaaacagcgtgacgatgacctgccatcgacggtgattatggccggctagacccgtgacgcagctgcagaggctaaaaagcacgcaagccaagaggcccgagaaggtcaccagcgtagaggaggagcaggcgctggccacgatcaccgaaagcgtcgtgagcacgctataaatggtgagcaggcccgggctcggcggcgacgtgaacgatccttcatcgcgtttgccgtgcagcagggccaaacagatggtgggcaccatcaaactcaagggcggcataaagccggtgcaacagagaaagacggtgcctttaagatgcggaaaagccagcaccaggcccagacagagcaagaaggtgcaggtgccctgcacggccacggtgctgtagacccgcatacaaagtaaaaagcgacgtacgtcgttcgtcgagacggaggaaatcataatgactccgcgcgagggtcgcgggggtgggggcgcccaggccgtcccggtggcctctgagttcggagacatgacggcggtggctatcaaaaggcgcgtatgagaaccgtttatagagtgtaatataatcaccgtcattcccacacggcgttcccccataaagtcacgtcacactcgagtaagcgtgaaaaagctttattgttgaataaaaaacacgagtacaacaccgagttgcggtgttctgtctgtctactgggtgggggaggttcatcgtctgtctctagagggaaggtggggaacgtctaagcgagcgggagcgtgtcatctcccccatctttttacaacaagctgaggagactcacgccgtcgatgcgtccgccgtgtttctcggcgtactgctgcacccagacgtggccgctaaagatggcgacgctcatgtttaggagactcatgacgatggtgtacaacacgacgctgacacagacgctgtttttagacaacgttccacgctggtagatgagatccagggtctcgtaaataagcacggccgaagcggcggtcaccaccaggacgtagagtccgctgtagatcttgctgacccacagcacgggcgaaaagtaaagcaataggtaaaagacgatgacggaccagccgtagccaatcccgatgactttccagcgcgtgggattgttgccggccaggtaggtgagaccgctgcagagaacgaaaaagaccatcaccagggcaaacgacagaccgatgacgcgcctttctccgcaaaagcccgtgcacacggtgatgccggtgttgatcagcaagcacgccactgtgagatgagcaaaattggtggtgtgtgggcgaaactcggcgaaaccgcgtagcatagccagcgtggacacgggtacgatggaggatagggctggcactatgccgttggcgcactgtccctgcacatcggggaaggcgagccaagccagcaagcagaccgtgagggtacaagccagctgccacacgagcccgtgatagacctccatgagcagcttaaagcgtttcaaccattggaagagctgctgttcggccaccagcgcgtggctgcgatggagcggcacgatggtgaccgtcggcgactcatggtgttcggaaaccgaggcggtgtcgcccatgctgccgcttacgaccgctgtcggtctaaggtaggcgtcgatgaaacagtccgtcttatcagcacccggttaccgcggatttgattgacgtcacgagtgtggtcaaaccgtggcggcaccctgtatccgacccgtcgtcatgggctccacaaccagagcctcagaagatggtacatgccgatgaataaagccacattttcgacatagaggcgtagcgagggctgaaaactctccgggaaagaactctgacaggtgatcagggacagatcgtgaattagcatcagcgtcaccgtcaacagcgtcgtcgcgtgtaaaccgagaaagaacggggccgcggcccgcagcagccaaagtcccagcgccgtagcgcagagcagagacaggaccgacggtagccacagccgccggagagacgcgccaggatcgcaacccaaaagcgaggcccccaggcagctgagatctaccgccagggcgagaagagccgcgccgacaaaggcctgcggcgacggctggcacatcagcaaggtcagaaaggctagcgcgtgcggcaggcagtaagccaacaggagtgggagtttgcggggacaacggtcgatcgacggaccgcgtagcagcaggaacaggcagccgacgggcacgacgaggctgagatgagaaagcgacggtgggtcgtcgtcccgtccccgctcgcatagctcggccaccggtggcggcatgagccaccagctgagcacgctgagggcgacggtggcggtaagctggaaggcgacgaggacggaggcgcgcagccataccgccagcctctctaggtaggggactacctcctcgacggtccattctagcgggacgacatgaagcatggcgacaagcgcggctgctgtgaaaacgggcgcggttttataggcattaggacttccccgtcgtactggcggctgtcaaagtcccgttgtccaaaggcgcgccgtccgaaagactaatccaacggggacccgagagcatgagcaacaacgtgagaaagatggccatgctgtccaggtagagacagacggcgtgacggatgcattggttaggtgggcagaaaaagatgaccatgagactgtcgtaggccagaatacccaaaaagaagctgatagagaaggcgcacaacgtcaccactatcttctgcagccaatcggcgtcgcttagcagagcgagcgtgaggaacgaaagcagcatcaccacgtagacgcagctgatgcatttccagcgacgtcggtcacggccacctagaaacgccagccccgtaaaggagataaacaacgccagggtcatcacgtaggaacctactagtacgcggctttcagagcacatttggaagatggccgccgtcaggctgttggccaacagatagatgaaaagcaccgtggcgttactagggtgttcgttgcccaacgtgtacgtgatgaacatgcagacgatgggcacgagcacggtgagaaagaagctgtagttctcgacgcaaaagttgcggttttgtgggaaccccaaccaaaaaacgcttcccaagccgaagctgaaagccagctgaaagatgaagatggcgtacacgcgcagccatacggtgaactttttgaaccactcgagagcctccatgcgggagagcagcagcgcgttagcctcctgcgcctgcatggtggcgacggtctcggcacaaagccgctgcggcgcacctacccttctcttatacacaagcgagcgagtggggcacggtgacgtggtcacgccgcggacacgtcgattaggagacgaactggggcgacgccgctgctgtggcagcgaccgtcgcagcgaccgtcgtctgagcagtgtgggcgctgccgggctcggaaggcatgaagtagagcacggagacaaagaggtacatgaggtccatgtacaagcagagcgcgcccgggatataactctcatactcgatgtcgtgcaggatgtcctgcgtatcgcacaccaccgaggtcacgatgacggccaaaccggctatcatcaccaggatctcacttaccgcctcgggaaaaagagaaaatacggcgaatagtaagagaatcagcgtggatgcgcccgtcaatagggaacgctgtaattccacgtcgcgggcaaacagatacgtagcgagcgtgaggaaacaaaatagcgtcactgtggccaccatggcataaatgactgaacgatgactaaagtggaagcctgacgccgtgacagccacgctggtaagcaacgtgtacgtcagtaagatccatacgtttttgggaaagttgggctcggcccaacgcaacagacctaggcacacgatggagatcattaagcaagacagcgtcagacgcacgctggaaaagagctgctccagccggtgcggcaacaccagccagcaaaaggcgcagacgctcataaggatgaggcattgcacccagataaggatgtagatgcgcaacaggaagaccgaccgggctatctggacctgaccgcggagcgacatggcggcaacgccggcggttatcgccgagattcgtctaaatacacgaagcgaactagaaaacgcacacacgtgatttgcaaaaagaaagcagctgccggcttattattttattaaaaatttatctgtgcagaatcataagtttatgatgaataaaaacggggaaagggaatctgcttttagggacccgggtctggtccgtcgtctcccatctggtcgggttcggggatggggacctgtttcagcgtgtgtccgcgggcgtgcatggcttttgctcgccggccgcgctgtaaccaggcctctttctctgtggtcggcgagtcttccgacgggtagggagcctgggagtccatcgcttcaggcccaccgctcgttccctcgaccgtcgtgtcgtcctcgttttcgctattacacggggtttctggagtatcgcctatacggttggcaattctccgggggcggccgctttcgtcctcgtcgctgctatcgccgcccggtaattcgacgccgcattcgttgtacggagcgcggcacatgggcggcggaaagaacttgggcatgcgaaagcagcgttgtccatccacggtctgcgtggtttcatcgttatcctcccataatcccccctgtagcgccggcagcgtttcgacgctgtgagaggggaaggcccagttctggttgtcttgcagcgcgcccgtgggcagtaggtccgtgcggccccaggcgctgctgttgttgggtaccttgtcagtgccgcgagtaggtcgcagaaaccagtccagagcgctctctagctgcgagcgtgtgatggtgcccagtgcgccgtgccagcgcagcacgtctcttttcagcgtgtggtgacagacgggcagctcctccaaccgacactcgccgcgcaatccgcggtcgaagcggcagagaccacgcagtttaagcagaccgcacttgagaaacatgtgaaaattatcggcaatgcgatacaggtctgagtcctcgatcttgtgtaggtagaccacgccaaacttgtcgagcagcaccatgccgctgggcacaaaaggcccgtatgccaggtaatagcccacgaggccgacgacgtaccactcgcagcacaagcgttgacgaataaagttcaaaagatcgcgaaagtccgcggccggcatgtggtcaaaaggccggcaggcgcgcaggccctcgatggagcccagcatgagcaacggctccacctcggtgcgacccggcgtgcggatgaccaggttgagaccgttcatttcgcgggccgtcttggccacggccgcagcgtcagtggggtcggtgcagaggaatttttgcacatgatagcgcggttcggtggtggcgaacggcgtttgtgggtgccgatacacatattcgcaccagagtaggccgttcttggaaaaggctttgatatcactggccacctcgtagagcccgtcggtctcccagtcgtagacgtagacggtgccgtaatgacttagcatgagcacgcagggcagttcctgcgcctgcttggtgtttcgtgttagatcgctgtcgggtggacgtacggctagtacaccgacggcttccagggtgtcatcgcagcagagatagtcggcggccagagaacgtgcgtaaatctgcgggatagcggcctgttcgcgcatcactaggaaccagttggcggggttgcgcagtgctacggtggttccctggtggcgctgcacgtaggttctcagcgccggaggatcgtactggcgcagatagaggccttgcagcatcgataacgtcttttgaaagacggtgtttctaaattggaaaacgccgtagtcgcagcggatagcatcttcgcagcgctcgtcgcgctgtcggagataggtgccccaggcttcggcggcggctttggtgagtagggacatgccggcaaagccgtctcgacagcgagtcggataaagcgcgctgcgcgaaagcttaatataggagcagcgtcagacgaatcgcggctggtggcccagggggtgggacgcgccgcctacacaaagtgctcccgaaaatcgaaactcttgacccactccggagacaaatccgtattcagattgatgcgtcgcgcttccacttcggcttccgaaacctcggcctccgtccggtaggcgttaacgatacgctgacccaggtgccaacgttctttctctgccaaacgccgttgctcaaaccattcgtctacgtccttgaggtcaaagacagtgtcctcctcaaggtcaaagcctaggtcttcccactcgtcgtcatcgctctcgtggccggcggccatacgcgcggcaaccgcgtcttcccctcctcttctatcaacgttgggtaccacgttgttttcttcgggttccataggttctgcgccactgtcgtcatcatcctctccctgctcctcatcgtccgccaaggcgtcgtggatcacctccaggttctgattgtcgggtacgacgtggttatcttcgtcgtcgtcgcgtggcatgggcggcggccgacggcggacgaccggcatggcgcggccgtcgtttccttcgtcttcctcttctccgtctcccagggaacgcggtcgacggcgttccgcgaagtcgccgcggaccacgcgcgcctgccagatggtaaacgcgtcccaaccatcccagttatttagcatttcggcgcggaaacggtcgcctcgacagagccagcgaaactgccgcgcgtagtcgcggtctacgccgctgtcgaacatggtaaagtgaagacgcgccgcctcgcccatgtgtacgcagcctccgttgcgttccagcctggccgcgcgccgcagaccgtgttcgtagcggcgacgcacgtacaccttcatgaggccggcgcgaaagagttcctctaggctgtcggccagacggtagatttcaccggctagacgctgcaggggcggcgagcggtccaggtgcgacttgacgattaccacgtaaaaacgacagaaacggtcgaagatgatgaggaatgacgtgtcaaaaaaaccaccggcgcggtaggagcccacggcgcccagcaggtaccagcggcaacgcagttgcagcgtgacgtacatttcgcactcggccaagcgggcggctggcgctacctcgaagggccagcagtccgtcaagcagccgaaactggtcaggagtttcaacgttttggcatggcgtccaggtgtatgaaagttcacgtcgcgtccgtggtgttcgccaacgcaggcggccaacgcgtcggtgtcatgaccgtgacgcagcagcatcgctaccacgtcgtgcggtacccgcgtagcaaacggcgtctgtggctgacggtatacggcttcggtgtacatcataccgtaacgcgccagttcgtccagatgacgcgcgcacagcagcagaatctcttgcgagggttcgtagatgtagaggcgcgtaccgccacccatgcagagcaccagctccgtctcttcatagtgatcgtccaccatgatcacgcatttgcctagcacgataaggcgttcggggcaacaaattacgtcgtccagcagttggtcgcgcagctccggcatggtgctgccgggccgcacctgcaggaaccagttgtgcggaatgccgagcgacaacacctggtcgacgtggttacggacccagtcgcgaagcacgtcggcgctgtactggcactcaaagatgccctgaaagtcgcccatgacccgcagaaaagtttcgtagcgcgtgtggcaatagaggaattcatcgtttcgcgtaaacgtgggagctccgtcttcccagcgtgtacgccacatgtcaaaagaggccgccagctagacaccccagaaaagaagcagagaaagagagttctttgtgcgacacgttttattccgcgtcctccgctcgacgctcaaatctggatgtactcgcgcacacccgtcaggctctttaagggaaaagggtccgagtacgtcactaaccgcgactgatgcaccagggcggtaatcacccgctctgcgccctcgcgcgtcgacgaacgcgtcgtcaccaggcagtgcagccgcgggcccgtatcgtcctgatgaccagcggcctcgcgctcggctgcttccacaccgacaatgtcgggatccaacacgtagctctgcgagttggtgtcgtagcggtgtagcaccaacgtgttggggtccagacgctcccacgcgccctcgtgcgggtcaaaacgctccgttaaacagagccagtcatactgctgctgcagaatacgccgctcgcgctcgcgtcgctcatcgggcaacgcggcgtcttcgttgaagagaatgtcccgcttgtggtctacggcacgctcgtggtggtgcgggcacagatgacggtgttccatacgcgtctgacgttgacgctcgcgctcaaaacgccggtgtcgaaagaccattttcagcaaccccatgcggaaaaactccgtgatggtgttggcaacgcgccgcacgtagtggttggggtcgtccatctggatggcgtacacggcaccgaaccagtccaacagtaccagcacttcggccacaaaactgcgtcccggccgcggacgtcccgtcacgcctagcacataccacggcgtggccagattagcacggacagcccaccaccaacgacggctctccacctcggtgagcgcacaaaagggccaaatgcggtgtaactgctgcaccgttttcatcagccgcataatcaccgtgccgtaacccggtgtatgcaacttcacgtcgcaacccaggattcgttcggccgtggcgtacgagccctcaggcgttgtgtcattgagaaacaaaacatgcatggtacgcgcgcccttagggtatcgtcgcggaacaggtaccgtcattctccgcagagtggtgtgaatcacgtcgcgatacgcaatctccgaacgtgacacaccgtaacgtgccagttcgtccaggttgtgcgataccaacaccatgtacttttcacgagtgtcgtaggcgtagacgcgagaaaagcgacccataaaaaccacgtacggggtagccaccatgccatcatggtgatcgcgacgtggctcgggcaacaaaataacagcgtatcccaacggcgtcagcggctcgcggcaacagatgagctttgacgccgcctgtttggcggcggtaatgattccgtcctccgtacgtaacatcacatgccagcccttggggggacccaaggacagacagcgtccctcgttacgatgaacgtaacgcgtgatttccattggctccaggcaaaagaacagttccttaaaatcccgcaacacttgtcggtataacgccatgggatcctcagccgccacaggcagcgcggggagctccggcggcacaactgcagcgccgtcagggccagaacccgcagccggatccatcattgcgcgacactctcagccggacaaccggcgtcactgacagaagccgagccaaatacagagaaagcaacgctacaccgtcaccccgctcccaagcgccgcggaaagtgctccgatttttcaccgtcgttcgcgacgttgatttgcctcggtctgagaaccgacctagcgttcggaccggtgcgcagaaacagccggcggtccgagccactgagcggttcacagccccggccgccgatagttaccggagagacgttcgagctgcaggtacatcggcgctccccgctccgccaccccgcgcccgccccagtttatactctccgacgccccgtccaacgcgcctgtggagggccaatcggaccgcgggagctctccaagtggatgacaggcacagccgggtgcccgaccgtgaagagccctcatccacctgaacagaccgctaaccgaaggaccccgaatcgcgtccgtcggtcccgacgtccgtcgccatctggttccctgctgttggctacctctcggatttcaaaaaagagcacgtgccgatgacggtgcacaggaaagagccaaagtgtcacggcgtctttttttatttgtgttcctttcctgttttgtactcgtaaactgttgacgttgtttttacatccaaaagggcaagtaagaaacaggatgaggcatggtaggtttgggcgtggggcggccctccagcacggcggcccgggccgcccggcgggtgagcacccggcgttgcgccgtatctatcttgtgtttcttctgtgtctttttcctatcttgttccgcgacggcctctttcatcacgttcagcatgcgttcctcgacgccctccagggatcctggggaggagggagtcctagtgaggcttccaatgttgttttgtggattttcggtttccttttcttggtcgtcatcgtcggacgtgtcgtcttcctcttgatcctcttcttcgtccgagtagtagacgcatagtccctggttcatcaggctgggattcatcaggttctgacggggaatccgctgttgtagacgtttaaccgcccgttccaggcgagagctcatgccgcaccagacgctgtaacgccgcacgggcccgtagcgggctgtttgttcgcgtacatgatcgttgagctcttgccaatattgtttggcacactccagatcggaggtttgtggatagtcgggtcggatccgcggatcccaactgacatcggcggtgccagagacttcgtccagactgttacgcatagagcaccagtcgggtcggacgataaacctgtccttgcggattaaccatttataacgtagttcgtgatggcgtgtagaggcccgtacacgctccacggtcccaaagcggtcccagaagggaaagttttcgtgagggcagcgacccggcacttccagacgttcggcgtcgtccacggcgtagtgaaaacgccggccggcctggtaaattttgagcagacccacggttaacaacatatccacgctgtcagccaaccgccagatctcgcgtcgagacacgtcaaaatagaaaaattcacaggctcggtcgaccaggatcacgaaatcggcgtgaaagacgccggagggtagcgactcgcccaccacacccattatcatggtttcgcagcataagcggtccacaaagaacttcaacaggtcgttgaattgctccgtctccatacagatgaagggccagacgcctttgaggttctcggcctggccgcagagcagcaacggacgcgtcatctcgcctggagtgcgcagaggcacgcattcgccgcgataacgacaggtcacacgctgcagttcgctgatgctgttgtcgtgcaggcgaaggtcgcagataatatgatccggttgcgtggttagcagcggcgtgcgcatctgctcgccgtagatggcctcgcagtgcaacagtccgtgtcgcgcaaaatcatccagactgtgcgccaggtagtaaagcaccccgcaatcgcggtctaaacaccacacggtttcgtaacgtcctagcaggagcaccagacgggcctggctaggtggctcaatttcctctacatatacgaaaaagtcgtcatcgtccgagtcctcgtcctcagaagaggaccgcggcccgtgtactctgggcaacacggtggtagagaactgcaggacgcccagagactcgagcgactcttcgcagcagatgagctgaccccagggcgtttcgggcccgtcggtgacagccgcgctgccaaagatgtcctcaaactctacaaaatctagacgccatccgggtggcgctgaaacgggaaggctaatgttcatatcagcatagctacgaactaagtggcggatgtcctgccgcaagtcttggcagagaatgagctttcgtaaacccttgagggtcctccgaacaacggccccagacgcgtagcgataggactggcgcatggtgccgcggcgtggagcggcacttggcagcctattttatggagtttcttcagtgacgtggcttgttcacgtcgttcgtgggctgcggttggcagctccggtctgtaaaccacccgaaaagactgacatcgacgtcaaagactcacgtaatttggaacatgtgcgaccgcaaagtgcgtcagaatagcacgtggctttaggacataaaaagtaccgtgaggtctagacgtggtttttgtgattgacacttacaccaggtaagccaagggacggtgaaactgtatgtgaggaacctgggtgcttagacaactaacgtgtaatgctttttacaggaccgttcaacaggtgatactacctgcaaggtaatgactacatctactacaactaccactaatatcatgctacaggtgagcaacgtaacgaatcacaccttgaatagcaccgaaatttatcagttgttcgagtacactcggttcggggtatggttgatgtgcatcgtgggcacgtttctgaacatgctggtgattaccaccatcctgtactaccgtcgtaagaaaaaatctccgagcgatacctacatctgcaacctggctgtagccgatctgttgattgtcgtcggcctgccgttttttctagaatatgccaagcatcaccccaaactcagccgagaggtggtttgttcgggactcaacgcttgtttctacatctgtctttttgccggcgtttgttttctcatcaacctgtcgatggatcgctattgcgtcattgtctggggtgtagaattgaaccgcgttcgaaataacaagcgggctacctgttgggtggtgattttttggatactggccgcgctcatggggatgccacactacctgatgtacagtcataccaataacgagtgtgttggtgaatttgctaacgagacttcaggttggttccccgtctttttgaacaccaaagtcaacatttgcggctacctggcgcccatcgtgctgatggcgtacacgtacaaccgtatggtgcggtttatcattaactacgtgggtaaatggcacatgcagacgctccacgttcttttagttgtggttgtatcttttgccagcttttggttccccttcaatctggcactatttttagaatccatccgtcttttatcgggaacgcaaaacgagactctccaaaccgttattactttctgtctatacgtcggtcagtttttggcctacgttcgcgcttgtctgaatcctgggatctacatcctagtaggcactcaaatgaggaaggacatgtggacaaccctaagggtattcgcctgttgctgcgtgaagcaggagataccttaccaggacattgatattgagctacaaaaggacatacaaagaagggccaaacacaccaaacgtacccattatgacagaaaacatgcacctatggagtccggggaggaggaatttctgttgtaattcgatcctctctcacgcgtccgccgcacatctatttttgctaattgcacgtttcttcgtggtcacgtcggctcgaagaggttggtgtgaaaacgtcatctcgccgacgtggtgaaccgctcatatagaccaaaccggacgctgcctcagtctctcggtgcgtggaccagacggcgtccatgcaccgagggcagaactggtgctatcatgacaccgacgacgacgaccgcggaactcacgacggagtttgactacgatgaagacgcgactccttgtgttttcaccgacgtgcttaatcagtcaaagccagttacgttgtttctgtacggcgttgtctttctcttcggttccatcggcaacttcttggtgatcttcaccatcacctggcgacgtcggattcaatgctccggcgatgtttactttatcaacctcgcggccgccgatttgcttttcgtttgtacactacctctgtggatgcaatacctcctagatcacaactccctagccagcgtgccgtgtacgttactcactgcctgtttctacgtggctatgtttgccagtttgtgttttatcacggagattgcactcgatcgctactacgctattgtttacatgagatatcggcctgtaaaacaggcctgccttttcagtattttttggtggatctttgccgtgatcatcgccattccacactttatggtggtgaccaaaaaagacaatcaatgtatgaccgactacgactacttagaggtcagttacccgatcatcctcaacgtagaactcatgctcggtgctttcgtgatcccgctcagcgtcatcagctattgctactaccgcatttccagaatcgttgcggtgtctcaatcgcgccacaaaggtcgcattgtacgggtacttatagcggtcgtgcttgtctttatcatcttttggctgccgtaccacctgacgctgtttgtggacacgttaaaactcctcaaatggatctccagcagctgcgagttcgaaagatcgctcaaacgtgcgcttatcttgaccgagtcgctcgccttttgtcactgttgtctcaatccgctgctgtacgtcttcgtgggcaccaagtttcggcaagaactgcactgtctgcttgccgagtttcgccagcgactcttttcccgcgatgtatcctggtaccacagcatgagcttttcgcgtcggggctcgccgagtcgaagagagacatcttccgacacgctgtccgacgaggtgtgtcgcgtctcacaaattataccgtaataaaaaagcgctacctcggccttttcatacaaaccccgtgtccgcccctcttttccccgtgcccgatatacacgatattaaacccacgaccatttccgtgcgattagcgaaccggaaaagtttatggggaaaaagacgtaggaaaggatcatgtagaaaaacatgcggtgtttccgatggtggctctacagtgggtggtggtggctcacgtttggatgtgctcggaccgtgacggtgggtttcgtcgcgcccacggtccgggcacaatcaaccgtggtccgctctgagccggctccgccgtcggaaacccgacgagacaacaatgacacgtcttacttcagcagcacctctttccattcttccgtgtcccctgccacctcagtggaccgtcaatttcgacggaccacgtacgaccgttgggacggtcgacgttggctgcgtacccgctacgggaacgccagcgcctgcgtgacgggcacccaatggagcaccaacttttttttctctcagtgtgagcactatcctagtttcgtgaaactcaacggggtgcagcgctggacacctgttcggagacctatgggcgaggttgcctactacgggggttgttgtatggtgggcgggggtaatcgtgcgtacgtgatactcgtgagcggttacgggaccgccagctacggcaacgctttacgcgtggattttgggcgcggcaactgcacggcgccaaaacgcacctaccctcggcgcttagaactgcacgatggccgcacagaccctagccgttgcgatccctaccaagtgtatttctacggtctacagtgtcctgagcaactggttatcaccgcccacggcggcgtgggtatgcgccgctgccctaccggctctcgtcccaccccgtcccggccccaccggcatgacttggagaacgagctacatggtctgtgtgtggatcttctggtgtgcgtccttttattagctctgctgctgttggagctcgttcccatggaagccgtgcgtcacccgctgcttttctggcgacgcgtggcgttatcgccgtccacttccaaggtggatcgcgccgtcaagctgtgtcttcggcgcatgttgggtctgccgccgccaccgtcagtcgcaccacctggggaaaagaaggagctaccggctcaggcggccttgtcgccgccactgaccacctggtcactaccgccgtttccgtccacgcggatacctgacagtccgccgccaccgtaccagcttcgtcacgccacgtcactagtgacggtacccacgctgctgttatatacgtcatccgacatcggtgacacagcttcagaaacaacgtgtgtggcgcacgctacttatggggaacccccggagcccgctcgatcgacggctacggttcaggaatgtaccgttcttaccgccccgaattgcggcatcgtcaacaacgacggcgcggtctctgaaggccaagaccatggagatgcggttcaccatagcctggatgtggtttcccagtgtgctgctgatactggggttgttgacacctccgagtaacgggtgcaccgtcgatgttggacgaaacgtatccattcgagaacagtgccgccttcgaaacggtgcgacgttctccaagggagacatcgaaggtaacttcagtgggcccgtcgtcgtggagttggactacgaagacatcgatattactggcgaacggcagcgacttcggttccatctcagcggactcgggtgtcctacaaaggaaaatataagaaaagacaatgaaagcgacgtcaacggtggaattcgctgggctctatatatacaaaccggcgacgccaagtacggtattcgtaaccagcatttgagtatacggttaatgtatcctggggaaaaaaatacacaacagctgttgggttctgatttcagttgcgaacgtcaccggagaccgtccacgccgttgggaaagaacgccgaagtgcctcccgcgacccgcacgtcttctacatacggcgtcctcagcgcttttgtagtgtggatcggatccggcctcaatatcatctggtggaccggcatcgtgcttctggcggcggacgctctcggacttggcgagcgttggctgaggttggcactgtcccaccgggataaacatcacgcatcgagaaccgcggcgctccagtgtcaacgcgacatgttacttcggcaacgtcgacgggctcggcggctgcacgccgtttctgaaggcaaactgcaggaagagaagaaacgacagtctgctctggtctggaacgttgaggcgcgaccctttccgtccacacatcagctgattgtgctgccccctcctgtagcgtcagctcctcctgcggttccctcgcagccccccgagtattcgtctgtgtttccgcctgtataaaaataaagagacgggaggctgatcgcggccttcagcgtctcatttgtctttactctcgagtgcggtcggtgtctcatcggtgagacgaggccgccgcccgacaagttcgatctcatgtcgctcttggagcgcgaagagagttggcgtcgcgtagtcgactactcgcacaacctgtggtgtacgtgcggtaactggcaaagccacgttgagattcaggacgaggagcccaactgcgagcagccggagcccgcacactggctagaatacgtggcggtccagtggcaggcccgggttcgcgattctcacgatcgctggtgtctctgcaacgcctggcgtgatcacgccttgcgcggccgttggggtacggcgtattcctcgggttcctcggcctcttcctccggtttcgtcgcggagagcaagttcacctggtggaaacgactgcgccacagtacccggcgctggttgtttcgccgccggcgagctcgatacactccgtctaactgtggggaaagtagcactagcagcggccagagtagcggtgacgagagtaactgcagtctacgcacccacggcgtgtacacacggggtgaacaacactaatcgataagtcgcgtgtaggcgactggctacatcaaccggatatctgcggggatttaaaaagacgacccgttgtcatccggcttagagcaaaccgtccttttatcatcttccgtcgccatggctatgtacacatccgaatccgaacgcgactggcgtcgtgtaatccacgactcgcacggcctgtggtgcgattgcggcgactggcgagagcacctctattgtgtgtacgacagccattttcagcgacgacccacgacccgagccgaacggagggccgccaattggcggcgacagatgcggcggttacaccgtctgtggtgtttttgtcaggactggaagtgtcacgcgttatacgccgagtgggacggcaaagaatccgacgacgagtcgtcggcgtcttcctcgggcgaagcgccagagcaacaggtccccgcttggaagaccgtgcgagccttctcgcgggcctaccaccaccgcattaaccggggtctgcggggcacgcccccaccgcgcaacttgccgggatacgagcacgcttccgagggctggcggttttgcaatcgacgggaacggcgagaggacgatcttcgcacgcgggctgagccggaccgcgtggtgttccagttagggggagtacctcctcgccgtcaccgggaaacttacgtgtaagaacacggcgtgacaataaacaacatagcgtaaatccccgtgtgatgtgtgtgattgacgttcgggaaacatgtccccatcatcagcgtcacaactgacgtgggttggtcactgacgtgcaggatgttacgcgagtcagagaatcgcataagaacggggtggtgagcgggttcccacaggagtctctggcgcaaaagcaccatgagcctcaggttccccgagagggcgggttacgagaaactgggataccgcccgcatgccaaacgcgtgtgggtgcatgacccgttgggattgacgcggtttatcatgaggcaactcatgatgtacccgctggtgttgccgttcacttttccgttttacgtgccgcggtcctagcacgtcagtggtgacgctgataattgcaacatggcccatgacgaacccgcttgggacgaacgtcaataccacgtcaaaccgccgtgacttggctgaacgttgaaacataaagccaaagcgccgtcggcacttggcttcagagcagcgcctcggggcgatgcgacggcgatgaacttagagcaactcatcaacgtccttggtctgctcgtctggattgccgctcgtgctgtcagccgcgttggtccgcatggctccggactcgtttatcgtgagcttcatgatttctacgggtatctgcagctggaccttctgggaccagtggtggcggggaatcgctcagtccggacctggagagagcaggcggaccgagccagagggaccttcgttcggcgttcaggccttaatactagccacatcttacctgtcggcggcctgtctgggggctccggtaccttacccgccggcctgtatcgtcccgaagaagaggtgttcctcctcttgaaccgctgccatgggccactgtcaacgccgaaaagcgcttgtctggctgaggttggtgtcgctaatgccagttttttatctcgcttcaatgtcggtgattttcacggagcgtcatgggaaaacggtaccgctcccgatggagagcccggggtatgctgaaattcttcttaaaattacgtaaacgacgtcgtccagtcgttgtgccgcgattcgtacggttcatcgtctacgtcgttttgttcaccgtcgctgtgcaacgcgtgaaacaagagcgtgatgcgcaccttcggcggtatgaagaacgattgcagaaaaaccgtgcacggcgtcggcagagttttccgtgacttggggcggtgggtccgagctgcggtatgggtcacggcggcgtgcgtcttattgacaaagatgccgatgtgtgactaaaaaacgtcccagccccagagcgatgtgtttcaataaaaattatgtagtatcatattatgcgtgtcctggtttttcattttttggatgtatttgtcgcataaaaggcggtgggatgtggggatgaaatatatccagatacgcagttttgttatcctaacaaaacccgtgtcatgctaaaaacggtaatgcaggatgaaagtcccgtgtggggggggggggcatatagtagtcgcttttaccgctgggcatacgctatgcttgtatttgtgactatactatgtgcagtcgtgtgtcgatgttcctattgggaagggtgtgaatgtaggaggtataaagaatggtgggacgcaggaagacatcgctagacacagctgtattgtgctagccccgcttagcgtcatgggtaaaacggtgataaagcgtcaaaacaccatggggggggggggcaggaagcttggtggcggtgttcattaaatgcattctgtgtatttattggtacatttgcaaatcgccgagtataccggtataatgtggcaataatcgtattgtgtgtactatgcagcgaagaggacaatatcagtgtaacgtgaagcaagtgtgggaacaatgccagtgaagaatatataaaagccagaaacatacataaatgaattgctagatacagggttctttgtgtactagcccaatcatgtcaatacaatgtgtacagaaaaaagacgcaacaacgacggggggggggggggcgtacgattaattctacatattacagtacaggctaccgcgtggtgttgtgtatgttacgatgcggtgtgcctgtcggtgtaattggatgtatgttacttatccgtggcgttgtgatagtgttgtgaaaaataattgtcgtgagcataatgacagctgcaatataaaatcactttattaagcattgtaatgataatgcgtggctacattagaaaacgtgacgcgtcgcatgtcgcggcacaatctggcagcggggtcggggtagggtacggtgggaggcatgtacacagatggaacaaaagcagaagtaacgtgagacggagcatatagtccagtatccagcggttcctgagtagcaccacccatcaactgaatgccctcatgagtaaaagtctgcgggcggcagcccttggggaccgttggcatgggacgatcaatctccaaaccacagcgtaacaccgttttcttccaacgtcgttgatacacgtcgtttttacggttactccccagaacccagaaagtctcgtccaagtcgtaccaggaatcttctccagggacacgcgacggtttccaatcctcgtcgtctcgtctcaaagcacgtcccaaactggcttgaggagtcaacggtggttctgtgggtcgggtgtagcgcgagtgctttcccttcatgaccgattcgtcttccttgcctttaggctttttggtctttttgtgtatcatctggccaccggcttccataaccaccgtggccaagtccagtcccagagcttgagcgtcggcgcggcgtctggcgtcttgcagatagtcttccacatttgcacagatgaccggatgtttggtggctagggtgagcacctcagcctcgccgcggcccggacgtagcaaaaaagctaactgcccgtgcggctcgcgcgcccacagcgcggcgcgcgggtgcaggtgcagcgcgtcccagcgcggccgctcccactgctcgcggtccagctcgggcagcagccgccgcgcggcctcggcggcgggcgccgactcgcgccccagcgccagcgcgcccagcacgcccgcgcgcagaaagtgcgacagctccgccgccagcgggtacacgtgcccgtccagcgggcagtacccgaacacggcgcccagctcgtccagcaccaccaccagcatggcgcgcggcacggtccccgacgccgccggacccgccatcgccgtcggacccaccatcaccgtcggcgccgccgctgctgccgctgccgccgccgtcgcgtccgccccgaccaccgcgtgcgcgtccgcgtttggcacgcaaatcgcgctcccgccggcgcctccgtacggctgcggaggtatagtcacagcagaccccacggctcctgccatcgcgcacggcgcgtccccgccggcggcctccgtctccgtgccgctcgccgctggcggcgacgtcgtccccgtcgccggccccgccgcgcaacccagccaccgcgcgggcagcaccgcgcccagcgccagccagccgcagcacagacgctggttcaggtgccgacgcacggccgtcagcagcgacgcggggtgcggcgccgacgcgaacggctcgtactgcgccagctcctgccacgcgcccagcagcaccatcggctgcagtcgccttcccggcgtctgtagtgccaccgtcgtgccggcccaccgccggcgcagctcccgtccgagcgccgtcgcctcctcggcgcgcagcaacgtctgtcggagcgccggctgaggcagcagcgtcgcgcgcggggtgcccacgcccagccggttgcagcggtacagccgcaccacctcgcccgcgccgtgccgaaaccactcgtccgcgtcgcgcgccgctaggatcagcgtgttgttcgccaggtcgtagacgaacacgcggaacccggcgcccagcgccaggtacagtccgtcctgcgcgcacagaccctcgggatggccggccttgtcgcccaccgtcgggtcggccgcggggtccacctcgtgcaccacggtcgccaccagcacgatccacgcgtcccgcggcgacagctgacgcaggtccgtcgcgcccacgccgttcatctggctgcgcggcgtcacccgcgcgtagaatccgtacggccgtccgagcggcagcagcgtgcccgcgtcgcgctgcgaccacttgcgcatggcgcggcccgtgctgttggccagaaacgccgcgcgccacacggcgcccatggcctggtattccagctccgtcagcgcctggcgctccaccggaatctgagacagcaacaggcgctccgggccgtgccaaaagttgctgttgttgccgctactcggaggggcgcccggcggcccgcggggttctacccggtggacgccgtggcccggcgtcgccgtaggcgcagcactcgcaccagtgcccgctgttgacgtcgctcccatcggcacacaagaagaaggaggagaggaaccaacccccgaaggccctccggccccgcggccgcgaccgaggggcggggggcgcggcgacatgccgttgcgctgggccatggccgccggacacctccgacgtccactatataggaagcaaacccgcgtcagcgaccacgccgtttacacacgcggacggctccgtcgtccgtgtgccacggcagacacgcacctggcttttataggcagcgacgtgtatggcgcttgctggcgccgccttggggccgtgcagtctggaaggccgtggaaaaccacccggcagccgacgacgcactcgactggaaaaggcaggaacccggaggaacacgcgcaacagggccgcggactgggtccccgagcgcgcaccctcctaggtggacgcccgacatccattccgggccgtgtgctgggtccccgaggggcgggggggtgttttctgcgggggggtgaaatttggagttgcgtgtgtggacggcgacggcgactagttgcgtgtgctgcggtgggtacggcgacggcgaataaaagcgacgtgcggcgcgcacggcgaaaagcagacgcgcgtctgtgtctgtttgagtccccaggggacggcagcgcgggtccttggggacacacgcaaaacaacggccagacaagacgcgggcgcaagggaggagtcgcgggccccggggcacactgcacaacccgcgtcgaggacacacgcagacacggcccgccaacacaccccgacacacccctgacacaccccgccgacacacccggcacacgcccgcgacacacccggccaacacaccccgacacacccggcacacgcccgcgacacacccggccaacacaccccgacacacccggcacacgcccgcgacacacccgcggcacaccctgacacacccgccacacccggcacacacccaccccgccgcgcccccgacacaccccgaccgccgccggtgcgggacagggct

SEQ ID NO: 4 - DNA, 229483 bp, Human cytomegalovirus
gtacaggtgttggccgttgtgcccggacgggagatcgagtcccgtgatcggatcgccaagatatgcgacaattttgctattagcaaagtagcccgggatatggagcagttgttggccaccaaaaatttggagaagccactggagcagccggagaatgggtacacctacaaggccacctggttcatgcagttccgggcggtcctgtggcgatcctggctgtcggtgctcaaggaaccactcctcgtaaaagtgcgacttattcagacaacggtgagtggttccagtggaaacaaatgatataacgcttacaattcttggaaacaaattcgctagattttagttagaattgcctgattccacacccttcttagtttttttcaatgagatgtatagtttatagttttgcagaaaataaataaatttcatttaactcgcgaacatgttgaagatatgaatattaatgagatgcgagtaacattttaatttgcagatggttgccatcttgattggcctcatctttttgggccaacaactcacgcaagtgggcgtgatgaatatcaacggagccatcttcctcttcctgaccaacatgacctttcaaaacgtctttgccacgataaatgtaagtcttgtttagaatacatttgcatattaataatttactaactttctaatgaatcgatgcgatcgctggttaattaagatccagacatgataagatacattgatgagtttggacaaaccacaactagaatgcagtgaaaaaaatgctttatttgtgaaatttgtgatgctattgctttatttgtaaccattataagctgcaataaacaagttaacgggcccgctagcacgcgtaagcttaccggtcttaagctgcaggcggccgctttacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggtggcgaccggtggatcgatcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagaaggtacctaaccaagttcctctttcagaggttatttcaggccatggtgctgcgccgaattgttaattaagacaataagtctacgtagaagactaggccggccatcgattcgatttaggtgttcacctcagagctgccagtttttatgagggaggcccgaagtcgatggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgctctagaactagtggatcgatcccccgggctgcaggaattcgatatcaagcttagcaaacagaggatggctaaccgtcgttgcatgttccaggccatgagccaggctaggcccgtacaccagacgcagagcatggatgacaggacataggcctggattaccacggtgcgatcgaaacacagcccgatggtggacacggatatcgtagtgagggtggtatataccatgaccagcatcagggtcccgggtcggcgccgacgttccagccagtacgcgtggcaacgcagagcgcagggtagcagtgtgctccagaagggcagtgtatcgcgcaggtagggggtcgtcacgcgccacggtatgagcatgaaaaggatggtagtggctatggtagcgctggtctggaacacgacggtgccgtagagacgtaccatccagagaaagtgttgaacgctccgcagggtgtcttcatctttggtgattacggtgactcgacggatcggcggtggtgacggcggcgacacgggtgggggtttctctttcttatggccgagtggctcgccttggtgaaactggatctgtaccatgacgggtgctcgacgaacagtcgtcggggcttcaggtacccggcaagttttatagagaaagggggacgatgggtggtggctacgagccaccgccaccttcgcaatacgaggatctgaaggcggcaaagacggtcgtccagggcaggcgccagaggttgggactgagcacgatcagcgtgattttaaacatggtcaccagtcctacgtagatcagcagcgagccgcgtaacgtctgagcggccggcagttcgtcgcggatgtaacgcgtgccgtagaaagtcacggtcatcataaggaagacgatggcgccgtagccgtagagtagaatacgctgatgatggaacacggtctggtcgccgataacccagagcgtgatgaaaaaaacgctggtgagcacccgtgagcatatgagctcccaacgcttagcgcgaaaactgtccccaaccatgacagcgccggtgcaagctatccacagcgtgaggaccagtgtgtagtcgatgaggatggcgggcaggtcggagcaccaggtgtagaaaaccgtggtaacggagaggaggcctacgtagcccatggtcaataccacgtcgtcggggtgcctttcgccctgtatcaagaccaaacaccagagaagggagggggcaaaaaccagcagcagaggggaagattcatgttgacatatgttgtgggaatcggggatacccagccaaatcattccgcagaaagccgtactgatggcgatgtgaaagaccactagggcgtagacccggacgaggacagcaaaacggcgcagccacataaggccgtggtgcagctgcaggagggaagcccattgcggcgaatgtagcgacggcagcggcgggtccatgaggcgggtgatgcgcccgagtgaacgggtgagcgtctcggtggagtcttcttataaaccagcggagctcaggcagccttgctctggaacgtcgcggtggtggtgttgaggatgacgctgagcgtgccgttgtcaatcaggtaatgatgataggtgccgagcttggccaggtagctgaacatttggtcccagcgtgccgaccacaccacgggcgtgagcattaggagtgtggtgtgataaatgagtgtttcggtggcgtaaagtatcagcgagctgcggatgatgtggctcacgggcattttggtggcgatgtagcgcacgtcttggaaaagaacggccaggatgcagcccacgaacacggtgtagagacacagcagagtcttatgcaaccaagtgtaagtagaagccaggacgctgaccatcaccgtcaaaagtgtggaggtaaaaagcgcgtcacgccacacggagctgagacggtgctcccaagccacgccgttgcaggccacgaacaacgtccacgttaagatgagactggaaacgccaatgggcgctgtggcgcacaggttgagcccggcggtggtgaacgacagaagcgccacatacagcgcaaacaccaggccgttgctggggtgtctgtgatcggtaagctccagcgcgcccagaaccaacaccggtgtgcagctaagcaataacggcgaaggatcgtcgcggcactcgtagcccagcgaggggtaacccagccaaaccagcgcgctaatgagcacgctgaaagcggtttccagcgtcagcaatccgtagacacgcatgacgatcgcggtccgccgtagccaacacaccgcatcttcggaagctgtggacgctgtttccgaataccgggaggagatcgtgcttccctcttctaaggatcggaaagtagcgtccgtcgtttccgcggacgcggcttccctggtacgctccgtttccgacgacgcggtttcccgctgcgtggaaactgtctccatgtcgggaccgcagcgcccggcggcgtatccgcaaggtctcgaagctacagcttgtcagaggaaaagtaggtttgcaaaaaggtgcgcagggtcatgattctcagcaccatcagcagagtgaaaaccaggctgagaaacaccttgacggccgccaaaagcgcgcgttccagcggcgtctcgtagcgtacagccagggccgcttcgtggaaatgcgagacggctagacaggtaatgagcacgctgaaggacaagacgatcttaaagcaccaggaccaaccacgcctcaagatgaccaccacgattgccgtgaaggtcaacgtgatcaaagcatggacgaccacgatctgacggcggacggtacgttcgggagccaacaacgctacgccggtgcagctgagaaaggccagtaaggtgaacaacgcggccgagatgaccaacgtaccgtccaggcagagacatatcacgatcaacggcggcacgtgaagcagcgtgtaaaagagcagaacgccgatattgctgggatgcgatgtttcgtaacagtgaatgaagatcaccgacgtgacgggtatgacaaagacgaggctgggcgaggactccgtgagacacagacgggaatggtgaaaccacgtcgcgggcgccgcgtagcagaaggcgctcaacaacgcggtcaagccggccagctgccaacccacggcgccataagtgtgcagcgccacgcggcaacagtcgacccaagccagactgcgggtcgccagccgggtctcttgtatcccggggggcacgtagatgaccgtgccatcggtgggtacttgaaaccctttttctcttctcatggtgcgctgcgttctctggaaacggctgctctgtccgaaaaccagttccgaacgaaaatctagggcgagagggtggacaacggcgtcgacgacgaagcatgggacaggtcgttcggcgttaacgtcatcgcgtcggacgacggtagttctaagagacgtagatcgctcagcaggtcctgacagttgcggattcgcaagatcagaaaaaaaagggaaatgaacgtaataaagagctgtagcgacgtatgcgccacatcgcgtggcataagaacgtgacggacgaaaaggacctgctgcgaaaagtggccggcgaagataaggcccaccgtgctgtagaagcccaaaagcagccgcaggggccaagtccagggccgcgtgaagacgatgagaacgttagccagaaagaccacgacccagacgccgttgatgagggtaaattgatcggacagggtgcagttgtcgcgacagatgaagactacttccgcgcagagcaaggtgatgaccaacgtgagcacaaacgacgtcaacacctcgcggggctcctggcaggcacacgtgacacctagcgccgggatgtgcgccaggaggccggcgagtaatagcaccagctgtcggaacggacgacggcagcgcgggtgccggtttcgctgagcgagaaccggtcgctcatagcggaaatacacgaagagcgcggaggccacaggcaccaggaggagcacctcgggcgcccagacaacgtgacaaggaaagcccggacgcgacttaagagtcgctgtagggaagaccagagagaagctacccaagacggccaccgccgcggagatttggaagaggagcaagccggcgattcggacgacaacctcgaagcgatgcacccagcccagcacggccaccacggccgcttcatcatagtcgtcgttgttgccgctgtcgaacagccgccgaaacacgatctgtcgctgggtcgcggtgggaaagcgcagacccatgacagccggaggctatatgaccgtgcgtctaaggcgcgagatccgtggggggacttttagatgtttgggcggcccgcggttctaacaggcttgattggtggagacggccggcgcggcgggtgggggaaacgacgagtttttccgttacgccatggttcgcgtgaggtttctctgtacctcccgcaaaaggtcacagcccgaaatggaggccgcgttggtggccccggtggcgcgtgacgataaccaggtcatccaagcgatgagtttgtctaatgagtcctcggtggtgaagaggataagaatgagcaggtacaggtacaccaggttctcatagagacacaaggtgagcaggtcggcctcggaccacgcgatctcaaacaggcgcgtggtgtcaaagaccgtgacgaccagcatgaagctgagcgccatggcgtaatagcccaaaaaaagtttgtgccctaacggtacgggttgcaggtaaagtgcgatcaagaacgcgataacgccgatcacaaacagcgtgatgatgacctgccatcgacggtgattatgggcggctagacccgtgacgcagctgcagaggctaaaaagcacgcaagccaagaggcccgagaaggtcaccagcgtagaggaggagcaggcgctggccacgatcaccgaaagcgtcgtgagcacgctgtaaatggtgagcaggcccgggctcggcggcgacgtgaacgatccctcgtcgcgtttgccgtgcagcagagccagacagatggtgggcaccaccaaactcaaaggcggcataaagccagtgcaacagagaaagacggtgcttttgagatgcggaaaagccagcaccaggcccagacagagcaagaaggtgcaggtgccctgcacggccacggtgctgtagacccgcatacaaagcaaaaagcgacgtacgtcgttcgtcgagacggaggaaatcataatgactccgcgcgagggtcgcgggggtgggggcgcccaggccgtcccggtggcctctgagttcggagacatgacggcggtggcgatcaaaaggcgcgtatgaaaaaccgtttatagagtgtaatagaatcaccgtcatccccacacggcgttcccccataaagtcacgtcacactcgagtaagcgtgaaaaagctttattgttgaataaaaaacacgagtacaacaccgagttgcggtgtcctgtctgtctactgggtgggggaggttcatcgtctgtctctggagggaaggtggggaacgtttaagcgagcaggagcgtgtcatctcccccatctttttataacaagctgaggagactcacgccgtcgatgcgtccgccgtgtttctcggcgtactgctgcacccagacgtggccgctaaagatggcgacgctcatgtttaggagactcatgacgatggtgtacaacacgacgctgacacagacgctgtttttagacagcgttccacgctggtagatgagatccagggtctcgtaaataagcacggccgaagcggcggtcaccaccaggacgtagagtccgctgtagatcttgctgacccacaacacgggcgaaaagtaaagcaataggtaaaagacgatgacggaccagccgtaaccaatcccgatgactttccagcgcgtgggattgttgccggccaggtaggtgagaccgctgcagagaacgaaaaagaccatcaccagggcaaacgacagaccgatgacgcgcctttctccgcaaaagcccgtgcacacggtgatgccggtgttgatcagcaggcacgccaccgtgagatgagcaaaattggtggtgtgtgggcgaaactcggcgaaaccgcgtagcatagccagcgtggacacgggcacgatggaggacagggctggcactatgccgttggcgcactgtccctgcacatcggggaaggcgagccaagccagcaggcagaccgtgagggtacaagccagctgccacacgagcccgtgatagacctccatgagcagcttgaagcgtttcaaccattggaagagctgctgttcggccaccagcgcgtggctgcgatggagcggcacgatggtaaccgtcggcgactcatggtgttcggaaaccgaggcggtgtcgcccatgctgccgcttacgaccgctgtcggtctaaggtaggcgtcgatgaaacagtccgtcttatcagcacccggttaccgcggatttgattgacgtcacgagtgtggtcaaaccgtggcggcaccctgtatccgacccgtcgtcatgggctccacaaccagagcctcagaagatggtacatgccgatgaataaagccacattttcgacatagaggcgtagcgagggctgaaaactctccgggaaagaactctgacaggtgatcagggacagatcgtgaattagcatcagcgtcaccgtcaacagcgtcgtcgcgtgtaaaccgagaaagaacggggccgcggcccgcagcagccaaagtcccagcgccgtagcgcagagcagagacaggaccgacggtagccacagccgccggagagacgcgccaggatcgcaacccaaaagcgaggcccccaggcagctgagatctaccgccagggcgagaagagccgcgccgacaaaggcctgcggcgacggctggcacatcagcaaggtcagaaaggctagcgcgtgcggcaggcagtaagccaacaggagtgggagtttgcggggacaacggtcgatcgacggaccgcgtagcagcaggaacaggcagccgacgggcacgacgaggctgagatgagaaagcggcggtgggtcgtcgtcccgtccccgctcgcatagctcggccaccggtggcggcatgagccaccagctgagcacgctgagggcgacggtggcggtaagctggaaggcgacgaggacggaggcgcgcagccataccgccagcctctctaggtaggggactacctcctcgacggtccattctagcgggacgacatgaagcatggcgacaagcgcggctgctgtgaaaacgggcgcggttttataggcattaggacttccccgtcgtactggcggctgtcaaagtcccgttgtccaaaggcacgccgtccgaaagactaatccaacggggacccgagagcatgagcaacaacgtgagaaagatggccatgctgtccaggtagagacagacggcgtgacggatgcattggttaggtgggcagaaaaagatgaccatgagactgtcgtaggccagaatacccaaaaagaagctgatagagaaggcgcacaacgtcaccactatcttctgcagccaatcggcgtcgcttagcagagcgagcgtgaggaacgaaagcagcatcaccacgtagacgcagctgatgcatttccagcgacgtcggtcacggccacctagaaacgccagccccgtaaaggagataaacaacgccagggtcatcacgtaggaacctactagtacgcggctttcagagcacatctggaagatggccgccgtcaggctgttggccaacagatagatgaaaagcaccgtggcgttactagggtgttcgttgcccaacgtgtacgtgatgaacatgcagacgatgggcacgagcacggtgagaaagaagctgtagttctcgacgcaaaagttgcggttttgtgggaaccccaaccaaaaaacgcttcccaaaccgaagctgaaagccagctgaaagatgaagatggcgtacacgcgcagccatacggtgaactttttgaaccactcgagagcctccatgcgggagagcagcagcgcgttagcctcctgcgcctgcatggtggcgacggtctcggcacaaagccgctgcggcgcacctacccttctcttatacacaagcgagcgagtggggcacggtgacgtggtcacgccgcggacacgtcgattaggagacgaactggggcgacgccgctgctgtggcagcgaccgtcgtagcgaccgtcgtctgagcagtgtgggcgctgccgggctcggagggcatgaagtagagcacggagacaaagaggtacatgaggtccatgtacaagcagagcgcgcccgggatataactctcatactcgatgtcgtgcaggatgtcctgcgtatcgcacaccaccgaggtcacgatgacggccaaaccggctatcatcaccaggatctcacttaccgcctcgggaaaaagagaaaatacggcgaacagtaatagaatcagcgtggatgcgcccgtcaatagggaacgctgtaattccacgtcgcgggcaaacagatacgtagcgagcgtaaggaaacaaaatagcgttactgtggccaccatggcataaatgactgaacgatgactaaagtggaagcctgacgccgtgacagccacgctggtaagcaacgtgtacgtcagtaagatccatacgtttttgggaaagttgggctcggcccaacgcaacagacctaggcacacgatggagatcattaagcaagacagcgtcagacgcacgctggaaaagagctgctccagccggtgcggcaacaccagccagcaaaaggcgcagacgctcataaggatgaggcattgcacccagataaggatgtagatgcgcagcaggaagaccgaccgggctatctggacctgaccgcggagcgacatggcggcaacgccggcggttatcgccgagattcgtctaaatacacaaagcgaactagaaaacgcacacacgtgatttgcaaaaagaaagcagctgccggcttattattttattaaaaatttatctgtgcagaatcataagtttatgatgaataaaaacggggaaagggaatctgcttttagggacccgggtctggtccgtcgtctcccatctggtcgggttcggggatggggacctgtttcagcgtgtgtccgcgggcgtgcatggcttttgctcgccggccgcgctgtaaccaggcctctttctctgtggtcggcgagtcttccgacgggtagggagtctgggagtccatcgcttcaggcccaccgctcgctccctcgaccgtcgtgtcgtcctcgttttcgctattacacggggtttctggagtatcgcctatacggttggcgattctccgggggcggccgctctcgtcctcgtcgctgctatcgccgcccggtaattcgacgccgcattcgttgtacggagcgcggcacatgggcggcggaaagaacttgggcatgcgaaagcagcgttgtccatccacggtctgcgtggtttcatcgttatcctcccataatcccccctgtagcgccggcagcgtttcgacgctgtgagaggggaaggcccagttctggttgtcttgcagcgcgcccgtgggcagtaggtccgtgcggccccaggcgctgctgttgttgggtaccttgtcagtgccgcgagtaggtcgcagaaaccagtccagagcgctctctaactgcgagcgtgtgatggtgcccagtgcgccgtgccagcgcagcacgtctcttttcagcgtgtggtgacagacgggcagctcctccaaccgacactcgccgcgcaatccgcggtcgaagcggcagagaccacgcagtttaagcagaccgcacttgagaaacatgtgaaaattatcggcaatgcgatacaggtctgagtcctcgatcttgtgtaggtagaccacgccaaacttgtcgagcagcaccaggccgctgggcacaaaaggcccgtaggccaggtaatagcccacgaggccgacgacgtaccactcgcagcataagcgttgacgaataaagttcagaagatcgcgaaagtccgcggccggcatgtggtcaaaaggccggcaggcgcgcaggccctcgatggagcccagcatgagcaacggctccacctcggtgcgacccggcgtgcggatgaccaggttgagaccgctcatttcgcgggccgtcttggccacggccgcagcgtcagtggggtcggtgcagaggaatttttgcacatgatagcgcggttcggtggtggcgaacggcgtttgtgggtgccgatacacatattcgcaccagagtaggccgttcttggaaaaggctttgatatcactggccacctcgtagagcccgtcggtctcccagtcgtagacgtagacggtgccgtaatgacttagcatgagcacacagggcagttcctgcgcctgcttggtgtttcgtgttagatcgctgtcgggtggacgtacggctaatacaccgacggcttccagggtgtcatcgcagcagagatagtcggcggccagagaacgtgcgtaaatctgcgggatggcgacctgttcgcgcatcactaggaaccagttggcggggttgcgcagtgctacggtggttccttggtggcgctgcacgtaggttctcagcgccggaggatcgtactggcgcagatagaggccttgcagcatcgataacgtcttttgaaagacggtgtttctaaactgaaaaacgccgtagtcgcagcggatagcatcttcgcagcgctcgtcgcgctgtcggagataggtgccccaggcttcggcggcggctttggtgagtagggacatgccggcggagccgtctcgacagcgagtcggataaagcgcgctgcgcgaaagcttaatataggagcagcgtcagacgaatcgcggctggtggccctgggggtgggacgcgccgcctacacaaagtgctcccgaaaatcgaaactcttgacccactccggagacaaatccgtattcagattgatgcgtcgcgcttccacttcggcttccgaaacctcggcctccgtccggtaggcgttaacgatacgctgacccaggtgccaacgctctttctctgccaaacgccgttgctcaaaccattcgtctacgtccttgaggtcaaagacagtgtcctcctcaaggtcaaagcctaggtcttcccactcgtcgtcatcgctctcgtggccggcggccatacgcgcggcaaccgcgtcctcccctcctcttctttcaacgttgggtaccacgttattttcttcgggttccataggttctgcgccactgtcgtcatcatcctctccctgctcctcatcgtccgccaaggcgtcgtggattatctccaggttctgattgtcgggtacgacgtggttatcttcgtcgtcgtcgcgtggcatgggcggcggccgacggcggacgaccggcatggcgcggccgtcgtttccttcgtcttcctcttcaccgtctcccaaggaacgcggtcgacgacgttccgcgaagtcgccgcggactacgcgcgcctgccaaatggtaaacgcgtcccaaccgtcccagttattgagcatttcggcgcgaaaacggtcgcctcgacagagccagcgaaactgccgcgcgtagtcgcggtctacgccgctgtcgaacatggtaaagtgcagacgcgccgcctcgcccatgtgtacgcagcctccgttgcgttccagcctggccgcgcgccgtagaccgtgttcgtagcggcgacgcacgtacaccttcatgaggccggcgcgaaaaagttcctctaggctgtcggccagacggtagatttcaccggctagacgctgcagaggcggcgagcggtccagatgcgatttgacaatcaccacgtaaaaacgacagaaacggtcgaagatgatgaggaaggacgtgtcaaaaaaaccaccggcgcggtaggagcccacggcgcccagcaggtaccagcggcaacgcagttgcagcgtgacgtacatttcgcactcggccaagcgggcggctggcgctacctcgaagggccaacagtccgtcaagcagccgaaactggtcaggagtttcaacgttttggcatggcgtccaggtgtatgaaagttcacgtcgcgtccgtgatgttcgccaacgcaggcggccaacgcgtcggcgtcatgaccgtgacgcagcagcatcgctaccacgtcgtgcggtacccgcgtagcaaacggcgtctgtggctgacggtatacggcttcggtgtacatcataccgtaacgcgccagctcgtccagatgacgcgcgcacagcagcagaatctcttgcgagggttcgtagatgtagaggcgcgtaccgccacccatgcagagcaccagctccgtctcttcgtagtgatcttccaccatgatcacgcacttgcctagcacgataaggcgttcggggcaacaaatcacgtcgtccagcagctggtcgcgtagctccggcatggtgctgccgggccgtacctgcaggaaccagttgtgcggaatgccgagcgacagcacctggtcgacgtggttacggacccagtcgcgaagcacgtcggcgctgtactggcactcaaagatgccctgaaagtcgcccatgacccgcagaaaagtttcgtagcgcgtgtggcaatagaggaattcatcgtttcgcgtaaacgtgggagctccgtcttcccaacgtgtacgccacatgtcaaaagaggccgccagctagacaccccagaaaagaagcagagaaagagacttctttgtgcgacacgttttattccgcgttctccgctcgacgttcaaatctggatgtactcgcgcacacccgtcaggctctttaagggaaaagggtccgagtacgtcactaaccgcgactgatgcaccagggcggtaatcacccgctccgcgccctcgcgcgtcgacgaacgcgtcgtcaccaggcagtgcagccgcgggcccgtatcgtcctgatgaccagcggcctcgcgctcggctgcttccacaccgacaatgtcgggatccaacacgtagctctgcgagttggtatcgtagcggtgtagcaccaacgtgttggggtccagacgctcccacgcgccctcgtgcgggtcaaaacgctccgttaaacagagccagtcatactgctgctgcagaatacgccgctcgcgctcgcgtcgctcatcgggcaacgcggcgtcttcgttgaagagaatgtcccgcttgtggtctacggcacgctcgtggtgatgcgggcacagatgacggtgttccatacgcgtctgacgttgacgctcgcgctcgaaacgccggtgtcgaaagaccattttcagcaaccccatgcggaaaaactccgtgatggtgttggcaacgcgccgcacgtagtggttggggtcgtccatctggatggcgtacacggcaccgaaccagtccaacagtaccagcacttcggccacaaaactgcgtcccggtcgcggacgtcccgtcacgcctagcacataccacggcgtggccagattagcacggacagcccaccaccaacgacggctctccacctcggtgagcgcacaaaagggccaaatgcggtgtaactgctgcaccgttttcatcagccgcataatcaccgtgccgtaacccggtgtatgcaacttcacgtcgcaacccaggattcgttcggccgtggcgtacgagccctcaggtgtggtgtcattgagaaacaaaacatgcatggtacgcgcgcccttagggtatcgtcgcggaacaggtaccgtcattctccgcagagtggtgtgaatcacgtcgcgatacgcaatctccgaacgtgacacaccgtaacgtgccagttcgtccaggttgtgcgataccaacaccatgtacttttcacgagtgtcgtaggcgtagacgcgagaaaagcgacccataaaaaccacgtacggggtagccaccatgccatcatggtgatcgcgacgtggctcgggcaacaaaataacagcgtatcccaacggcgtcagcggctcgcggcaacagatgagctttgacgccgcctgtttggcggcggtaatgatcccgtcctccgtacgtaacatcacatgccagcccttggggggacccaaggacagacagcgtccctcgttacgatgaacgtaacgcgtgatttccattggctccaggcaaaagaacagttccttaaaatctcgcaacacttgtcggtataacgccatgggatcctcggccgccacaggcagcgcggggagctccggcggcacaactgcagcgccgtcggggccagaacccgcagccggatccatcattgcgcgacactctcagccggacaaccggcgtcactgacagaagccgagccaaatacagagaaagcaacgccacaccgtcaccccgctcccaagcgccgcggaaagtgctccgatttttcaccgtcgttcacgacgttgatttgcctcggtctgagaaccgacctagcgttcggaccggtgcgcagaaacagccggcggtccgagccactgagcggttcacagccccggccgccgatagttatcggagagacgttcgagctgcaggtacatcggcgctccccgcttcgccaccccgcgcccgccccagtttatactctccgacgccccttccaacgcgcctgtggagggccaatcggaccgcgggagctctccaagtggatgacaggcacagccgggtgcccgaccgtgaagagccctcatccacctgaacagaccgctaaccgaaggaccccgagtcgcgtccgtcagtcccgacgtccgtcgccatctggctccctgctgttggctacctctcggatttcaaaaaagagcacgtgccgatgacggtgcacaggaaagagccaaagtgtcacagcgtctttttttatttgtattcctttcctgttttgtactcgtaaactgttgacgttgtttttacatccaaaagggcaagtaagaaacaggatgaggcatggtaggtttgggcgtggggcggccctccagcacggcggcccgggccgcccggcgggtgagcacccggcgttgcgccgtgtctatcttgtgtttcttctgtgtctttttcctatcttgttccgcgacggcctctttcatcacgttcagcatgcgttcctcgacgccctccagggatcctggggaggagggagtcctagtgaggcttccaatgttgttttgtggattttcggtttcctcttcttggtcgtcatcgtcggacgtgtcgtcttcctcttgatcctcttcttcgtccgagtagtagacgcatagtccttggttcatcaggctgggattcatcaggttctgacggggaatccgctgttgtagacgtttaaccgcccgttccaggcgagagctcatgccgcaccagacgctgtaacgccgcacgggcccgtagcgggctgtttgttcgcgtacatgatcgttgagctcttgccaatattgtttggcacactccagatcggaggtttgtggatagtcgggtcggatccgtggatcccaactgacatcggcggtgccggagacttcgtccagactgttacgcatagagcaccagtcgggtcggacgataaacctgtccttgcggattaaccatttataacgtagttcgtgatggcgtgtagaggcccgtacacgctccacggtcccaaagcggtcccagaagggaaagttttcgtgggggcagcgacccggcacttccagacgttcggcgtcgtccacggcgtagtgaaaacgccggccggcctggtaaattttgagcagacccactgttaacaacatatccacgctgtcagccaaccgccagatctcgcggcgagacacgtcaaaatagaaaaattcgcaggctcggtcgaccaggatcacgaaatcggcgtgaaagacgccggagggtagcgattcgcccaccacacccattatcatggtttcacagcataagcggtccacaaagaacttcaacaggtcgttgaattgctccgtctccatacagatgaagggccagacgcctttgaggttctcggcctggccgcagagcagtagcggacgtgtcatctcgcccggagtgcgcagaggcacgcattcgccgcgataacgacaggtcacacgctgtagttcgctgatgctgttgtcgtgcaggcgaaggtcgcagataatatgatccggttgcgtggttagcagcggcgtgcgcatttgctcgccgtagatggcctcgcagtgcaacagcccgtgtcgcgcaaaatcgtccagactgtgcgccaggtagtaaagcaccccgcgatcgcggtctagacaccacacggtttcgtaacgtcctaacaggagcaccagacgggcctggctaggtggctcaatttcctctacatacacgaaaaagtcgtcatcgtccgagtcctcgtcctcagaagaggaccgcggcccgtgtactctgggcaacacggtggtagagaactgcaggacgcccagagactcgagcgactcttcgcagcagatgagctgaccccagggcgtttcgggcccgtcggtgacagccgcgctgccaaagatgtcctcaaactctacaaaatctagacgccatccgggtggcgctgaaatgggaaggctaatgttcatatcagcataactacgaactaagtggcggatgtcctgccgcaagtcttggcagagaatgagctttcgtaaacccttgagggtcctccgaacaacggccccagacgcgtagcgataggactggcgcatggtgccgcggcgtggagcggcacttggcagcctattttatggagtttcttcagtgacgtggcttgttcacgtcgttcgtgggctgcggttggcagctccggtctgtaaaccacccgaaaagactgacatcgacgtcaaagactcacgtaatttggaacatgtgcgaccgcaaagtgcgtcagaatagcacgtggctttaggacataaaaagtaccgtgaggtctagacgtggtttttgtgattgacacttacaccaggtaagccaagggacggtgaaactgtatgtgaggaacctgggtgcttagacaactaacgtgtaatgctttttacaggaccgttcaacaggtgatactacctgcaaggtaatgactacatctactacaactaccactaatatcatgctacaggtgagcaacgtaacgaatcacaccctgaatagcaccgaaatttatcagttgttcgagtacactcggttcggggtatggttgatgtgcatcgtgggcacgtttctgaacgtgctggtgattaccaccatcctgtactaccgtcgtaagaaaaaatctccgagcgatacctacatctgcaacctggctgtagccgatctgttgattgtcgtcggcctgccgttttttctagaatatgccaagcatcaccccaaactcagccgagaggtgatttgttcgggactcaacgcttgtttctacatctgtctttttgccggcgtttgttttctcatcaacctgtcgatggatcgctactgcgtcattgtctggggtgtagaattgaaccgcgttcgaaataacaagcgggctacctgttgggtggtgattttttggatactggccgcgctcatggggatgccacactacctgatgtacagtcataccaataacgagtgtgttggtgaatttgctaacgagacttcaggttggttccccgtctttttgaacaccaaagtcaacatttgcggctacctggcgcccatcgtgctgatggcgtacacgtacaaccgtatggtgcggtttatcattaactacgtgggtaaatggcacatgcagacgctccacgttcttttagttgtggttgtatcttttgccagcttttggttccccttcaacctggcactatttttagaatccatccgtcttttagcgggaacgcaaaacgagactctccaaaccgttattactttctgtctatacgtcggtcagtttttggcctacgttcgcgcttgtctgaatcctggaatctacatcctagtaggcactcaaatgaggaaggacatgtggacaaccctaagggtattcgcctgttgctgcgtgaagcaggagataccttaccaggacattgatattgagctacaaaaggacatacaaagaagggccaaacacaccaaacgtacccattatgacagaaaaaatgcacctatggagtccggggaggaggaatttctgttgtaattcgatcctctctcacgcgtccgccgcacatctatttttgctaattgcacgtttcttcgtggtcacgtcggctcgaagaggttggtgtgaaaacgtcatctcgccgacgtggtgaaccgctcatatagaccaaaccggacgctgcctcagtctctcggtgcgtggaccagacggcgtccatgcaccgagggcagaactggtgctatcatgacaccgacgacgacgaccgcggaactcacgacggagtttgactacgatgaagacgcgactccttgtgttttcaccgacgtgcttaatcagtcaaagccagtcacgttgtttctgtacggcgttgtctttctcttcggttccatcggcaacttcttggtgatcttcaccatcacctggcgacgtcggattcaatgctccggcgatgtttactttatcaacctcgcggccgccgatttgcttttcgtttgtacactacctctgtggatgcaatacctcctagatcacaactccctagccagcgtgccgtgtacgttactcactgcctgtttctacgtggctatgtttgccagtttgtgttttatcacggagattgcactcgatcgctactacgctattgtttacatgagatatcggcctgtaaaacaggcctgccttttcagtattttttggtggatctttgccgtgatcatcgccattccacactttatggtggtgaccaaaaaagacaatcaatgtatgaccgactacgactacttagaggtcagttacccgatcatcctcaacgtagaactcatgcttggtgctttcgtgatcccgctcagtgttatcagctactgctactaccgcatttccagaatcgttgcggtgtctcagtcgcgccacaaaggtcgcattgtacgggtacttatagcggtcgtgcttgtctttatcatcttttggctgccgtaccacctaacgctgtttgtggacacgttaaaactcctcaaatggatctccagcagctgcgagttcgaaagatcgctcaaacgtgcgctcatcttgaccgagtcgctcgccttttgtcactgttgtctcaatccgctgctgtacgtcttcgtgggcaccaagtttcggcaagaactgcactgtctgctggccgagtttcgccagcgactcttttcccgcgatgtatcctggtaccacagcatgagcttttcgcgtcggagctcgccgagtcgaagagagacatcttccgacacgctgtccgacgaggtgtgtcgcgtctcacaaattataccgtaataaaaaagcgctacctcggccttttcatacaaaccccgtgtccgcccctcttttccccgtgcccgatatacacgatattaaacccacgaccatttccgtgcgattagcgaaccggaaaagtttatggggaaaaagacgtaggaaaggatcatgtagaaaaacatgcggtgtttccgatggtggctctacagtgggtggtggtggctcacgtttggatgtgctcggaccgtgacggtgggtttcgtcgcgcccacggtccgggcacaatcaaccgtggtccgctctgagccggctccgccgtcggaaacccgacgagacaacaatgacacgtcttacttcagcagcacctctttccattcttccgtgtcccctgccacctcagtggaccgtcaatttcgacggaccacgtacgaccgttgggacggtcgacgttggctgcgcacccgctacgggaacgccagcgcctgcgtgacgggcacccaatggagcaccaacttttttttctctcagtgtgagcactaccctagtttcgtgaaactcaacggggtgcagcgctggacacctgttcggagacctatgggcgaggttgcctactacgggggttgttgtatggtgggcgggggtaatcgtgcgtacgtgatactcgtgagcggttacgggaccgccagctacggcaacgctttacgcgtggattttggccgcggcaactgtacggcgccgaaacgcacctaccctcggcgcttggaactgcacgatggccgcacagaccctagccgttgcgatccctaccaagtgtatttctacggtctacagtgtcctgagcaactggttatcaccgcccacggcggcgtgggtatgcgccgctgtcctaccggctctcgtcccaccccgtcccggccccaccggcatgacttggagaacgagctacatggtctgtgtgtggatcttctggtgtgcgtccttttattagctctgctgctgttggagctcgttcccatggaagccgtgcgtcacccgctgcttttctggcgacgcgtggcgttatcgccgtccacttccaaggtggatcgcgccgtcaagctgtgtcttcggcgcatgctgggtctgccgccgccaccgtcagtcgcaccacctggggaaaagaaggagctaccggctcaggcggccttgtcgccgccactgaccacctggtcactaccgccgtttccgtccacgcggatacctgacagtccgccgccaccgtaccagcttcgtcacgccacgtcactagtgacggtacccacgctgctgttatatacgtcatccgacatcggtgacacagcttcagaaacaacgtgtgtggcgcacgctacttatggggaacccccggagcccgctcgatcgacggctacggttcaggaatgtgccgttcttaccgccccaaattgcggcatcgtcaacaacgacggcgcggtctctgaaggccaagaccatggagatacggttcaccatagcctggatgtggtttcccagtgtgctgctgatactggggttgttgacgcctccgagtaacggctgcactgtcgatgtcggacgaaacatgtccattcgagaacagtgccgtcttcgagacggtgcgacgttctccaagggagacatcgaaggtaacttcagtgggcccgtcgtcgtggagttggactacgaagacgtcgatattactggcgaacggcagcgacttcggtttcatctcagcggactcgggtgtcctacaaaggaaaatataagaaaagacaatgaaagcgacgtcagcggtggaattcgctgggctctatatatacaaaccggcgacaccaagtacggtattcgtaatcagcatttgagtatacggttgatgtatcctggggaaaaaaatacacaacagctgttgggttctgatttcagttgcgaacgtcaccggagaccgtccacgccgttgggaaataacgccaaagtgcctttcacgacccgcacgtcttctacatacggcgtcctcagcgcctttgtggtgtggatcggatccggcctcaatatcatctggtggaccggcatcgtgcttctggcggcggacgctctcgggcttggcgagcgttggctgaggttggcgctgtcccaccgggacaaacatcacgcatcgcgaaccgcggcgctccagtgtcaacgcgacatgttacttcggcaacgtcgacgggctcggcggctgcacgccgtttctgaaggcaaactgcaggaagagaagaaacgacagtctgctctggtctggaacgttgaggcgcgaccctttccgtccacacatcagctgattgtgctgccccctcctgtagcgtcagctcctcctgcagttccctcgcagccccccgagtattcgtctgtgtttccgcctgtataaaaataaagagacgggaggctgatcgcggccttcagcgtctcatttgtctttactctcgagtgcggtcggtgtctcgtcggtgagacgaggccgccgcccgacaagttcgatctcatgtcgctcttggagcgcgaagagagttggcgtcgcgtagtcgactactcgcacaacttgtggtgtacgtgcggtaactggcagagccacgttgagattcaggacgaggagcccaactgcgagcagccggagcccgcacactggctggaatacgtggcggtccagtggcaggcccgggttcgcgattctcacgatcgctggtgtctctgcaacgcctggcgtgatcacgccttgcgcggccgttggggtacggcgtattcctcgggttcctcggcctcttcctccggtttcgtcgcggagagcaagttcacctggtggaaacgactgcgccacagtactcggcgctggttgtttcgccgccggcgagctcgatacactccgtctaactgtggggaaagtagcactagcagcggccagagtagcggtgacgagagtaactgcagtctacgcacccacggcgtgtacacacggggtgaacaacactaatcgataagtcgcgtgtaggcgactggctacatcaaccggatatctgcggggatttaaaaagacgacccgttgtcatccggcttagagcaaaccgtccttttatcatcttccgtcgccatggctatgtacacatccgaatccgaacgcgactggcgtcgtgtaatccacgactcgcacggcctgtggtgcgactgcggcgactggcgagagcacctctattgtgtgtacgacagccattttcagcgacgacccacgacccgagccgaacggagggccgccaattggcggcgacagatgcggcggttacaccgtctgtggtgtttttgtcaggactggaagtgtcacgcgttatacgccgagtgggacggcaaagaatccgacgacgagtcgtcggcgtcttcctcgggcgaagcgccagagcaacaggtccccgcttggaagaccgtgcgagccttctcgcgggcctaccatcaccgcattaaccggggtctgcggggcacgcccccaccgcgcaacttgccgggatacgagcacgcctccgagggctggcggttttgcagtcgacgggaacggcgagaggacgatcttcgcacgcgggctgagccggaccgcgtggtgttccagttagggggagtgccgcctcgccgtcaccgggaaacttacgtgtaagaacacggcatgacaataaacaacatagcgtaaatccccgtgtgatgtgtgtgattgacgttcaggaaacatgtccccatcatcagcgtcacaactgacgtgggttgggtactgacgtgcaggatattacgcgagtcagagaatcgcataagaacggggtggtgagcgggttcccacaggagtttctggcacagaggcaccatgagccttaagttccccgagagggtgggttacgagaaattgggacaccgcccgtataccaaacgcgtgcgggtgcatgacccgttgggattgacgcggtttatcatgaggcaactcatgatgtacccgctggtgttgccgttcacttttccgttttacgtgccgcggtcctagcacgtcagtggtgacgctgataattgcaacatggcccatgacgaacccgcttgggacgaacgtcaataccacgtcaaaccaccgtgacttggctgaacgttgaaacataaagccaaagcgccgtcggcacttggcttcagagcagcgcctcggggcgatgcgacggcgatgaacttagagcaactcatcaacgtccttggtctgctcgtctggattgccgctcgtgctgtcagccgcgttggtccgcatggctccggactcgtttatcgtgagcttcatgatttctacgggtatttgcagctggaccttctgggaccagtggtggcggggaatcgctcagtccggacctggagagagcaggcggaccgagccagagggaccttcgctcggcgttcaggccttaatactagccacatcttacctgtcggcagcatgtatcggggctccgacaccttatccgccggcctgtatcgttccaaagaagaggtgttcctcctcttgaaccgctgtcacgggccactgtcaacgccgaaaaacgcttgtctggctgaggttggtgtcgttaatggaacttttttgtctcgcttcaatgtcggtgattttcacggagcgtcatgggaaaacggtaccgctcccgatggagagcccggggtatgctgaaattcttcttaaaattacgtaaacgacgtcgtccagtcgttgtgccgcgattcgtacggttcatcgtctacgtcgttttgttcaccgtcgctgtgcaacgtgtgaaacaagagcgcgatgcgcaccttcggcggtatgaagaacggttacggaaaaatcacgcacggcgtcggcagtcttttccgtgacttggggcgatgggtccgagctgcggtatgggtcacggcggcgtgtgtcttagtgacgaagatgccgatgtgtgactaaaaacgtcccagccccagagcgatgtgtttcaataaaaaaatatgtagtatcatattatgcgtgtcctggtttttcatttctggatgtatttgttacataaaaggcggtgggatatggggatgaaacatatgtagatacgcagtttgattatccgaacaaagctcgtgtgatgcgaaaaacggtactgcaggatgaaagtcccgttgggggggggggaagcagagaatagtcgcttttgccgctgggcatacgctatgcttgtatttgtgactatactatgtgcagtcgtgtgtcgatgttcctattgggaagggtgtgaatgtacgaggtataaagaatggtgggacgtagagaggcatcgctagacacaggttgatcgttgtgctagccccacgtgagcagcgtcatgggtaaagcggtgattaagcgtgaaaacaccgtaagggggggggggcaggaagcttggtggcagtggccgttagataccttacgtgtctgtattggtacatttgcgacttgtcgggtacgacggtatagtttaactatgattatattatgtatgcgcaggatacaatgccctaaaacattgtaacacgaaacgttacaatgatgggaaagatgccgataaaaatcacataaaaggcatatacacgaattactagttacacgtttgtctatgtgcgagtttaaggacacttgtataatgcgtatgacggcaaaaggccgcagaaacgacggggggggggggggtagtaacggtattaattatacgtcttgtagtacacgttatcgtgtactggtgcgcgtattacgacacaaactgcatagcgctataaccggatgtatggtatttatatgtgcgtctagcatccttgtgagattctgagagtcttcttgtaagcgtaattaaaacggtgtatgttctgcgtaaagtgcattcaaacaatgtaacagtatgggatgaataccaataaataacatataaaagccagaagtatacatacaagagttgctagacacaggtttgtctctgtgctagcccaacggcacttgtacaatccatgcaaccagaaaaaggatgcgaaaccaacgtcgtgggtggtggtggtggggggggggggtgaaagctctgttaatcattggtctcgcggtgcaaattgctgcgttttacgtgtattgttacacgggtcgcgtatccctataatcggatgtgtgttactcattcgtggcgttgttatagtattgtgaaaaagaattctcgtaagcatgttgacaactgcaaaataaaaccattttattgagcattgtaatggtagtgtgtggctacattagaaaacgtgacgcgtcgcatgtcgcggcacaatctggcagcggggtcggggtagggtacggtgggaggcatgtacacagatggaacaaaagcagaagtaacgtgagacggagcatatagtccagtatccagcggttcctgagtagcaccacccatcaactgaacgccctcatgagtaaaagtctgcgggcggcagcccttggggaccgttggcatgggacgatcaatctccaaaccacagcgtaacacggttttcttccaacgtcgttgatacacgtcgtttttacggttactccccagaacccagaaagtctcgtccaagtcgtaccaggagtcttccccagggagacgtggcggtttccaatcctcatcgtcccgtcgcaaagcacgtcccaaactggcttggggagtcaacggtggttctgtgggtcgggtgtagcgcgagtgttttcccttcatgagcgattcgtcctccttgcctttaggctttttggtctttttgtgtatcatctggccgccggcctccatcaccaccgtggccaagtccagtcccagagcttgagcgtcggcgcggcgtcgagcgtcttgcaggtagtcttccacatttgcacagatggccgggtgtttggtggctagggtgaggacctcagcctcgccgcggcccggacgtagcaaaaaagctaactgcccgtgcggctcgcgcgcccacagcgcggcgcgcgggtgcaggtgcagcgcgtcccagcgcggccgctcccactgctcgcggtccagctcgggcagcagccgccgcgcggcctcggcggcgggcgccgactcgcgccccagcgccagcgcgcccagcacgcccgcgcgcagaaagtgcgacagctccgccgccagcgggtacacgtgcccgtccagcgggcagtacccgaacacggcgcccagctcgtccagcaccaccaccagcatggcgcgcggcacggtccccgacgccgccggacccgccatcgccgtcggacccaccatcaccgtcggcgccgccgctgccgccgccgccgcatccgttccgaccaccgcgtgcgtgtccgcgtttggtacgcaaaccgcgctcccgccggcggcgccgtacggctgcggaggtaaagtcacagcagaccccacggctcccgctatcgcgcacggcgcgtccccgccggcggcctccgtctccgtgccgctcgcccccgccggcaacgtcgtccccgtcgccatcgccgtcgtccccgccgtcatcgtcgccggccccgccgcgcagcccagccaccgcgcgggcagcaccgcgcccagcgccagccagccgcagcacagacgctggttcaggtgccgacgcacggccgtcagcagcgacgcggggtgcggcgccgacgcgaacggctcgtactgcgccagctcctgccacgcgcccagcagtaccatcggctgcagtcgcctgcccggcgtctgcagcgccaccgtcgtgccggcccaccgccggcgcagctcccgtccgagcgccgtcgcctcctcggcgcgcagcaaggtctgtcgaagcgccggctgaggcagcagcgtcgcgcgcggggtgcccacgcccagccggttgcagcggtacacccgcaccacctcgcccgcgccgtgccgaaaccactcgtccgcgtcgcgcgccgccaggatcagcgtgttgttcgccaggtcgtacacgaacacgcggaatccggcgcccagcgccaggtacagtccgtcctgcgcgcacagaccctcgggatggccggccttgtcgcccaccgtcgggtcggccgcggggtctacctcgtgcaccacggtcgccaccagcacgatccacgcgtcccgcggcgacagctgacgcaggtccgtcgcgcccacgccgttcatctggctgcgcggcgtcacccgcgcgtagaatccgtacggccgtccgagcggcagcagcgtgcccgcgtcgcgctgcgaccacttgcgcatggcgcggcccgtgctgttggccagaaacgccgcgcgccacacggcgcccatggcctggtattccagttccgtcagcgcctgccgctccaccggaatctgagacagcaacaggcgctccggcccgtgccaaaagttgctattgttgccgctacccggaggggcgcccggcggcccgcggggttctacccgttggacgccgtggcccggcgtcgccgaacccgcagtacttgcaccagttcccgccgttgacgtcgctcccatcggcacacaagaagaaggagaggaagcaacccccgaaggccctccggcaccgcggccgcgaccgaggggcggggggcgcggcgacatgccgttgcgctgggccatggccgccggacacctccgacgtcgaggcgacgtccactatatagcaacacaacccgcgtcagcgagcacgccgtttacacacgcggacgtctccgttgtccgtgtgccacggccgacacgcacctggcttttataggcagcgccgtgcacggcgcttgctggcgccgccttggcgacgcgcagtctggaagcccgtggaaaaccacccggcaggcgacgacgcactcgactgggaaaggcagacgcccgaaggaagacgcgagacaggcccgcagcactcgagcgctgtcatctaggtggacgcctgacatccattccgggccgtgtgttgggtccccgtggggcgggggggtgtttttagcgggggggtgaaatttggagtcttggagtcgcgttgcggtgcggttgggacggcggcggcgcataaaagcggcgtgcggcgcgcacggcgaaaagaagacgcgtgtctgtgtctgtttgattccccggggaacggaggaagtccccaggggacgacggcagcgcgggtccccggggacacacgaagaacgcctcccaggggccagcgacgcggaaacgacgcggaaaagaggaagtccccggggggacggccgcgcgcggaaaagaggaagcgcgcggcgccgcgcgaccctggggaccgcgggggaagcaacggccgcaaagtacggcgcgacccgcgtcgaggacacacgcagaagaggcgtccggccgaggggaggggggggggctcgcgggccccggggcacacttgttgttccctccggccgccgacacgcaccccgaagccgcgcacaccgctgacacacccctgacacacccgcggcacacccgaccgacacacccgcgacacacccgccacgcgcccgacacacgcccgcgacacacccgaccgacacacccgcggcacacccgaccgacacacccgaccgacacacccgaccgacacacccgaccgacacacccgacacacgcccgcgacacacccggcacgcacgcacccacccagccgcgcccccggcacacccaacccgacgccggcgcgggacggggctgagggaactttgaggcccgtaagcgcggctgcctttgtgcgcactaccggtgcgtgtcgtcccacggtatctgttcgcgggaccggactgcgtgaggtttgcggggcgtcatcgcgctgagggatctctgtacgggtgtctccacggcgctttttgggcgcgctgggtaccgggctgcgggccggggggtgtgcgtgacggcggtagggccggggcgttgcgggtacgggggttacgttggcgacgcgggtgttgcgggtccggaccgagggacgggggtggcgcgggtgtttgcggcgaggacgcgggtgtgcggggacggggactcgccctcgcctatttaacctccacccacttcaacacacacctgccgcacaatcatgccagccacagccacaaacagcacccacaccacgccgcttcacccacagtaccaacacacgctacccttacaccacagcaacacacaaccgcctatccaaacctcggacaaacacgccaacgaagaacaccgcacgcagatggagctcgacgccgcggattacgccgcttgcgcgcaggcccgccaacacctctacgctccaacacaaccccaactacacgcataccccgacgccaaccctcaggaaagcgctcatttttccacagaacatcaccatcaactgacgcatctacttcacaacattggcgaaggcgcagcgctcggctaccccgtcccccgcgcggaaatccgccgcggcggtggcgaccgggccgacagcgcaagcgacttcgacgccgactgctggtgcatgtggggacgcttcggaaccatgggccgccaacctatcgtgaccttactgttggcgcgccaacgcgacggcctcgctgactggaacgtcgtacgctgccgcggcacaggctttcgcgcacacgattccgaggacggcgtctgtgtctggcgtcagcacctggtttttttactcggaggccacggccgccgtgtacagttagaacgtccatccgcgggagaagcccaagctcgaggcctattgccacgcatccggatcacccccatctccacatctccacgcccaaaaccaccccagcccaccatatccaccgcatcgcacccacatgctacgactcgcccacatgacacgctctttcctatcccttctacaccctcagccacggttcacaatccccgaaaccacgccgtccaacttcacgccgaaacgacccgcacatggcgctgggcacgacgcggtgaacgtggcgcgtggatgccggccgaaacatttacatgtcccaaggataaacgtccccggtagacggggtagggggatctaccagcccagggatcgcgtatttcgccgccacgctgcttcaccgatatccaataaacccatcccctcgccacgacgtctccgcgtatctttgtagcctcaggaatccgtccccacgtccatccatcccgagcactccacacgctataacagaccacggacacggcaaatgcatgcaaacttctcatttattgtgtctactactctgtgttgctacagggagtgaagggggtgaaggcaaacaaaaaaaaaaggaacaaaataatagattagcagaaggaataatccgtgcgaccgagcttgtgcttcttttgttataaggaggcaaatatactagggaaaacttaagaataggaagaaaccgaggtttgggagaaaagctgagataaaatagcgcattttccatacagaggttgttgtttttgtggatcctaagaggtttcaagtgcgaatctcaaagttctcacgagaatattgtcttcaagaatcgacaactgtggtccaagatttttttttggtctttttaggttctgcgagggacatcacgatggatcgttgcgatgaagtcacgcgtacgcctctggtgtggcgcggtgtcgtgacaggagagtgtgttttcagtgcagagctgtcttgattcctatatccgagtatctgttttctcgtaaggacggtaatcttctttggtgtaagtacatctaaaagctgcaaactatattttaagggctgtctctaggtgtactttgatgctggagtttttcgctgtgttgatgtgaataaatctactactactattatatgcagaaagagtgattatgccgagacaagattgcattggctgaactgtttcaaaaacgcctacactctacttatccgtaaacctaaggtaatactatgtgtaagttgtttttttttctttttgtagtaaaatggtgatacgtgcaattaaaactgtattccatgtttccatcctttcatttcaactttaaaggcggctttgagagcgaagaagtgcgaggataaaaatggatgactccttcgtgtccagggagtcgactactgcaacgctgattgattaaaagatggtctccgatgatgatgttgttattgatcgaatcatggtgcagaacggcgacggagaggagcgtgtccgccgccgggaaggtggtctctttctcttttcttttttcaagaaatcttccatgtgtttatcgtagtgatcgaaatcgactgatctcgggttctttttgttggtttcttttcggttaatcatgtattgttttctttttttacagaaagatacttttttcatgagcaattcctcgcccggcgccggcatgccgaggtggggccactgcgatcagcggcatgccgacgccgacccggggatcttggattcaccgttttctctcttctctctctacatacagaccgggtggcaggagcggtaaggaatcatcgtcgtctttcattcttcgatgattatggtaatactaaatcttatctaggagcatatacatctaagattggagtactagtagtcgtttgtggtttctatttttttttatatttatctatgacagtttttctgtttttcgttttgataataatataataaaaactcatggacgtgaaatctggcttggttgtggtgatttcattctcattattgttgttttctttccgtcttgcggatgaagatgttgcgatgcggttgttgttggtgttgctatacaccgagagagatgatctttttgttcttctggttcatttcctatgattgtttggctgctgaccgacgcgtcaggatgtgcagggcatgcggggaatcaggaccggacacgggataatttcatctacctatacggagatcgcggtcctcgccatgaggatcgcgacaggcgcgtcgagggggcaggaacacccttgcggattgacattcttggtggtgtttcgttgttgtcggtagttgttgttgacgatgaggataaataaaaatgaccttgtttttgttctgttttctctcgttgggaatcgtcgactttgaattcttcgagttatcggaaagctgaggtacccaaatgtctgtagcttttttctttttaccctcttgtttatcatctgcgattcgtggtaggtaggagagggaaatgataatccgagattaaggaaaggagaagataaaaaataaaaaaaaataataaaacagaagccgaccggccgccgacccgttccccaggaccagcctacgaggaacggataacgcggtggcgacggcagcggtggtggcgctgggggtggcggtagtggtgctgctgatggtagtcgggacggaggagagacgatgcatacatacacgcgtgcatgctgcatgggtggatggtacggccgggagacgcggaagagaaactcacataaaaaggtgataaaaagagcggttgaaaaaagaaaacgagattcgaccagacagaagagaaggaccggggcttggcgacccttccacgactgccgttgtcatctcggctcctccatcttctcccggccacgggcggctaagtcaccgccgttctccccatccgtccgagcgccgaccgaccagccggccgattcgcccgccggggcttctggagaacgccggggcagcagcgatctggggaagccgctaaacccctgcgtttttatatggtagctctgccgagcgcgggctgacgcgttgagtaagcggaaagacgtgtgtgacgaaaaggggtcccatggtatttcacgtgacgatgaggagatgcggtttggagcacatacggtttagaaaaagggagttgtcgtgacaagggctgagggacctctgtctccatgtgtgtataaaaagcaaggcacgttcataatgtaaaaaagaacacgttgtaaacaagctattgctgtatcattcggctgactatgcttcattcggactgattttcttttcctaacggcgtaacttaaagtgattaacgtatgatatttgttccccagagttatactatagtcatcatcctaaaattcagatataaatgaacacatgtcgtatgggattattaagaaaccgaaactctccacagttcaccatcttcttcgtcattcaaccgatgacccactccgtacaacgaatcagtctgctgcgtcatattgcaaagcacaagcgacgtatgcgaacaacttgaaacacaggctgttgtattgatgaccgttgtaccattattagtcacatcgtatagagactctccaccgtcatcccatgtttcccacccgatggaaaaccgtcttctatcatcaactgtggtaagatttcgaccctgcgaggtattcagtttcctcatatccataacctggattttatcattaaaccccaatattaaacacttttttagtaccccccacccaccaaaaaatgtgactggaccggttcctagcagctctgggagccatgttcaggttgaaccacagctacagcgaaaccgagtccagtgaccggtaaccacgtccagcccctgcgtatgtaccagtccaagcacgtccggtcattgttctacacaggaaatctaactaggtcaacgtaacctaacactctctaaacctaatttttagtagtcaaataccataattcaccgctgtactcgtctttattctctccgaaccaacgaccaaggtcgacaacgccatcgttacccttcgtgatattgcacagatctaaagatgtatgagtacaattcgttacacaaacgcttgatccattattcactagaggtgcatgtctccctgttacattacataaccatccttgattcagatggctccatttcgtagtcatcgggtcgtttttgtgttcaatggttacattgtcaccacttttaacctctactttattgaaacccgcaccttcatgtataaacaccgtcatgaaacacgctataagtacccccccccccacaatggaatgctgccaaaccggttatttcccgttatagccatggcgttcctaagcaagagctaacgccgaacctaatgcagtaaaaagcgcttgcagccagaaccagcttatgtaccagccacgataacatccggtgattgtttccacaggaaatcctaccaggcaaagccccgcttgttgtgttcctgaccaccttgtttagcaattcgtaaactgtcagcctagcgacgtccgtttagatcaaaagtcacgtatatagcgacgctgtttccacccgtttccccgtcccgccgtttccgaacaacccacccgggttcagacaaccgaccaccaacagaaatatacacacagaccaccgggagttcagttaaagatttcatcaggtttattttggctgctgctagtcttttgcttcttagaaaaaaaatacccatatagagaaataatgatagtttgacaacacatatggcagggatttcttcttcatcaataagatatgcaattcccccagggagagactttcaacaattgaatttacaaaaacaaaattacatcaggagaaagagaggatacattaataaatatattatatctggtgtatatactgaatgctgctggttcataaggtaacgatgctactttttttaattccaagatggtttttctttgttagtcttttgttgacttgctggttcctaaaagttcgcaaaaacgattgtgtgaagattttatgacgttggttgactagttcatgagattctgctgtacgtgtgatggttattcgctggttcgttctaagatgagtatcgtactgtgtctgcgatggtcgtctcttactggcattctctcggctgcctcttgctttcatgattgaaaaggaaaaaaggactccgagggcgcggtcatcttttacttttcggttttctcattggcgggtcagaggtagtcagatcatgagactgtcgtggtcgatgaaactgtgtctgctcaagtgacgtccatttcttgtacggagaaaaaagtcatcgggataaataaggctatacaaggcgttgtcaagcgtgcggctctaaacaaattaagcgatacaaaattacagtaatacgaataataaattacccccctccccctgtggtcccccgagacgagagccacccatcgtgtactctcgcaccacccacgaccacagagggaggcgggacgaagagacgacgcagagcgccatctcctcctgaaggccggcgacgttaactgctacagctgcggcggcgacgacgacagctgcgatttgtcggccgacatgccgatggtatgggcggcggcggcagtggccgcggcagcggggaggagaggagagagaagaggagcggggcgtccgaaggcgaggatggcatggtctcgccggagcgcccggcttttatgggacactcgcgtccggttgggcattgcccacaggaagatgagtcacaacttccaaaccatcttgagacccgagtaacggtttacaggtcgcacgccagtctcagctaaaaacagcggacagtcccacgctgtttctgttgtggctctctccagtttcctcatcgccatcccggtctccgtcgtcatcggaagaataccatccgctctcatgcggcagtcgatcgacctcgacgaacgagacgcggcgacgcctctctacggccgactggttgtggtggtgaaagaagagcaccagcaatcccaggaggagcaacaagccctcacatgtccaggaggtcggggagagggcctgtcggagatggccgtgaggcatcacgtacggcagctgaggagaaacggagaagaaaggaaaattaccgtcaggggccggggttcttattagaaaaacagcacgtaggtcaggatccagatgctaatggcgatcatgatgacgatgatcatgcaggccaagacgcggcgcaccaatgccgaatccaagagccgccgtgccgccggttggtggctggcggcatctagagacatggtttgggggggaccggcggcgcgaaaagacagggagatggacagtgacacggtgttttgttatgattaggacatggggaccggaagccgagacagagtactacagagtgttgaagggtaacgtgagggagatcatgtcatgggcgggctgaagaccgtgcggggaggatcgacgtgtgcggtgcttgtggaacacggtgttttaatatgtatccgcgtgtaatgcacgcggtgtgctttttagcactcggtttgataagctacgtggccgtttgcgccgaaaacacggttaccaccaattgtctcgtgaaaacagaaaatacccacctaacatgtaagtgcaatccgaatagcacatctaccaatggcagcaggtgccacgcgatgtgcaaatgccgggtcacagaacccattacaatgctaggcgcatactcggcctggggcgcgggctcgttcgtggccacgctgatagtcctgctggtggtcttcttcgtaatttacgcgcgcgaggaggagaaaaacaacacgggcaccgaggtagatcaatgtctggcctatcggagcctgacacgcaaaaagctggaacaacacgcggctaaaaagcagaacatctacgaacggattccataccgaccctccagacagaaagataactccccgttgatcgaaccgacgggcacagacgacgaagaggacgaggacgacgacgtctgacaaggaaggcgagaacgtgttttgcaccatgcagacctacagcacccccctcacgcttgtcatagtcacgtcgctgtttttgttcacaactcagggaagttcatcgaacgccgtcgaaccaaccaaaaaacccctaaagctcgccaattaccgcgccacctgcgaggaccgtacacgtactctggttaccaggcttaacactagccatcacagcgtagtctggcaacgttatgatatctacagcagatacatgcgtcgtatgccgccactttgcatcattacagacgcctataaagaaaccacgcatcagggtggcgcaactttcacgtgcacgcgccaaaatctcacgctgtacaatcttacggttaaagatacgggagtctacctcctgcaggatcagtataccggtgatgtcgaggctttttacctcatcatccacccacgtagcttctgccgagctttggaaacgcgtcgatgcttttatccgggaccagggagagttgtggttacggattcccaagaggcagaccgagcaattatctcggatttaaaacgccagtggtccggcctctcactccattgcgcctgggtttcgggactgatgatctttgttggcgcactggtcatctgctttctgcggtcgcaacgaatcggggaacaggacgctgaacggttgcggacggacctagatacggaacctctgttgttgacggtggacggggatttggagtaaaagatgcgcacacaacatcgacggtggaacaagtcatcatatacgcaaataatatgcatgtttattattttttggattctgcagaaaagcaagtgtaacaacaccactatcgccaatacttccacgtcgattacacccacaagcttaatatctactacacaactgacatctacgttacaaaccaccgaaatgtctaccactatgttcacatcctccaatggcaacgtcaacacatccacaggattcactgcaagctctgtaaaaggcacagacgtgacctcaactatttccaccatatctacccaaacatctacaactaacgtaactgtaataacaacttcaccaaacggcgacacgaattcatcgacacagcatgtaaccgatagtactgtgactttgcaaactatatcattatcaaccaacactactactatgataaatgcaaatgaaaacgtcactacaccgcttccaacttgctcatcgcctaacagtacaaataatacgatatcaaaagaatctgaaacattattggaggcggcacaaggagacaatattactataacacacaacctaaccatcacatcgtgctacaaaacagcctggcttagacattttaatatatccacacacggaaaatacacccatcccaacataagaaatggaaaatatcataaccattcattgaaaatcctccattcgcgtatactatgtgagtggcacacaaattatctaaaacatcactatgatttatgttttacatgcgatcgtaatttatctttatctctgtacggtcttaattttactcattctggtaaatatagctttcgatgttataaaactgggcatccctccgaacaaaatcaaaactttaatctgcaaatacatcctagaaacaacacaaacgggacacacgtgaatccctgggtatgtgaagaaccaaagcacgaatgggacacttctcataaaccgaccaattatgaagacaatacagccacatcatctatagatcatttataccgctataacaatcattctaacacatcacacggcagacgcactacgtggacgttagcattaatttgtgtagcctgcattctcctatttttcgtccgacgagctctaaataaaaaatatcatccattaagtgacgatataagtgaatcagaattcatagttcgatacaatcctgagcacgaggactaagcaacgtttccggataaatgtcttatgagaccatatcagaaaataaacgggcaagaaagatcaacaacgtccgaagaaacatcaatgcccgttaaccgaaatttaataacgttatggactggagatttacggttaagtggacgttactgatgattacgatatctgaaggttgcaatgacacgtgctcctgtccgtgcaattgcctttacctccaccgcctccactatcacaaattcttctaactctgtcaccgatgctaacagcacttcagctatcgcaaatggaaccacgcacaaaccctctaccgcttcttcagtcgcatcagcaaccacttcaacgctttcaaaatcatcgtcaagcgctacgccaacattaacgttttctaccattcatagtactactccctggttgaataccagcaacataacttgcaatggcagtttgtacaccgtttataaacactctaatttaaattacgaagtaattaatgtaacaggatatgtcggtggatacgtcactttgaaaaactgcagtagaacggatgtatggcacgatatagaatggataaaatatggacctcgcgcacaccaactgtgcagcattggacattattattcaacttccccactgaacggcatgtgtttagactgcaataagacctctctcactatatacaacgtaactaccgaacacgctggaaaatacgttttgcaacgttacagtgacggtaaaaaggaaaactactatttaaccgtgttatcaggaactgcaacatcgtctcctatacctgataaatgtaaaacaaaagaggaatcagaccagcataatagcagaacgtgggacaatgtaataaaaactgtaaaaaacactaacattcccctgggaattcatgctgtatgggcgggtatagtggtatctgtggcacttatagccttatacatgggtagccgtcgcgtccccagaagaccgcgttatacaaaacttcccaaatacgacccagatgaattttagactaaaacctaacatgcacatcaataaacttttgtttttatttttagccaataatgtctccgtgtggtttttgtgggttaagcacttatggtgtgaagcagaatattcatagttattaaaaacatgggtatacaatgtaacactaaactactgttactagccgcgctaatagcaactgcaaccattctaactagcattttagttccggtacttttacatgaacaagaaaaaacattttaccggcgattttttacgcaaagtcaacatgtagaaagacccatcacggtaactcagggagatacagtttacctgaacggtagtaataatccctgcaactattccagtttctggaactacggcagttgcgaactttgtggatggaacggatacatacataaacagtaccacgaaaacaaatcatgctctccgcgatttacatgttttaacgacacaaaaggtctcagacttaataacgttacatctagcgattcaggaacatacacggaatacgtgtatgaatgcgatttgccatgtaatacaagtgactatgatgaatatgacatactaaactatcttgacaattgtactactaccataaacagcaccaattatattattaccgtattgtctccacgtcattctaaacacaccaattcccacatatccacgctggttggacagctgccgtggtgacggtaattataatctgcgttttgacttactttaacgttccggcaaccctgaaacgcaaactacgaactagaaacaacgctacccacataccgtgattacaaagtacccacactagttcattcaggataaatttgtgctttgtgtagctctcagaaattgtacaaccccgcttttccactccgtcatgaaagatcgtaataaactacttatatgtattatctttattttcaccatgtgcctcatctgtctttactttaaacgccgttgtattcctaccccatctccagacaaggcagatctgcgagtggaatttccttcgttatctccgtgtgtcggcatacagtgcgctccatgaaaagacgcgtgatacatagcgtactccaggacggtacagtttatgagaacataattcaaggaaagtgcaggttcctgttgctatgttaccacaggagatcacggaacataaatgttttctgcgtatgtttttataaaagagcgtctcgaagcagtttgagccacactacggtccagatgacgagcgtaatcaaaaatatgccgcgtagtagtcgaaagccgtactgagcgtgcgaagcgggtagggtgccgaacgacgggtatgcgtcgtcgtcatctttgactataaggatcgcgaccgagttttctggcatggtaaaagctgcccactgtggcaggtatgtagcgtatccggtttggaatcgttcggctctggtccgggggatagtgaggaattctcaggggatgatatgggacccaatcactggataagacaagggtttttccccgtaagatgatcctcgtatcacatgaggtctggatatgtataaatgaggagtgaaataggcacagggaatcagatgccggccttgtgatgcagccgctggttctctcggcgaaaaaactgtcgtctttgctgacttgcaaatacatcccgccttaagtgatgagtctataaagcaccgttgtctgggtacggtaaaagtgactcggattgtagcacgtcatttttttttgtttttgcatcgtttatcgtcaccactagtgcaatattttgatcgtaaggctgaaagagtatcgttatgatgcttagagcgtggagattgatggtactacttgccgcgtactgttattatgtttttgcgaattgttcaatcagcacgacgactgctcctgtggaatggaagtctcccaaccgtcagattcccaagaatattacttgcgctaattactcagggaccgtcggcggtaacgttacttttcagggtctcaagaataaaacggaagattttttatcttggctactcgggtctggttataagtccatttgctcgttcttcccgcaactccctggtgattctaatgagcagcattacagatatgaagtaaccaacctcacgtacaattgcacctatgaccgcctgacgttactgaatctgacaacggaaaacagcaggaattactatttcagaagagaagatgcgaattccaccttctattactcttgttacaatctgaccgtgtcctaaagatcgcacgtgaagttccacagaaccgcgcagctgtagctattgtgtttacgttgcttttgaaatgttaagcgtccctacggcgctaacatgtttctaggctactctgactgtgtagatcccggccttgctgcgtatcgtgtatctagatcacgcttaaagctcgtgttgtcttttgtgtggttgatcggtttgcgtctccatgattgtgccacgttcgagtcctgctgttacgacatcaccgaggcggagagtaacaaggctatatcaagggacgaagcagcattcacctccagcgtgagcactcgtacaccatccctggcgatcgcgcctcctcctgaccgatcgatgctgttgtcgcgggaggaagaactcgttccgtggagtcgtctcatcatcactaagcagttctacggaggcctgattttccacaccacctgggtcaccggcttcgtcttgctaggacttttgacgcttttcgccagcctgtttcgcgtaccacaatccatctgtcgtttctgcatagaccgtctccgggacatcgcccgtcctctgaaataccgctatcaacgtctcgtcgctaccgtgtagctagttagccagctgtgtatagtttgttgtgttttgcttttgcatatttgttttcagtcagagagtctgaaacggggtgggagggacttttgcgggtagtgcacgctaagatgaacgggtgggctggggtgtgcttgataactcactgtttgaatacgcgctcacgcacatatgtagcactcaacatgttagcttttgcccgcacgccccggggcatgccgagctgcctttttaataaagtctgggtttccagatacgcgctggttctgattttgatggtttgtgcctctgaaggctcaacgaattgggtcgtggtttctcataggctgcctaactgtagcgcggtatctacaacagtgggacaaaacgttgagttatgcggctcggcgtcatcaggttgtaacataacccaatggggacgttaccagaatggaagtacgctggggccatggtgtaccctgtggggaccatatacccaagtctcattaggacatcgtgtagcgttcggctgttcttggacaacgttttttatgtacaacctttctcaaaatcatagtggcacttattatcgaaaaggtgacaactgtaccgacaaacatataacactatcttgtttcaacttgacggtgcatcccaaggcggctcagagcacaaccaccgtagtgacacccacggtagttacaaacgccacggcgaatgtgtcacccattacgtcgactctagcggtaaattccagcgcgtttaaacacgttagttatcaacggcaacagcgtgtcgaaaacaggacgtcatccaagaacataactaacttggcattcacctatggcagctggggcgttgcgatgctgctgttcgccgccgtgatggtgctcattgatttgggtttgcctcaatcggcttggcggcgctggcgaatccacgtggacgatgaagaacgtggtctgttaacgtaggaaataaaaagtactgtttgagcgtgactgtttccaaatcgtaccgtggtaaataaatcatggtttccggcgtgggttctcatcttatgacggttccacgattccgttggacagtgcatcatgtgtacaataaactattgattttggcgttgtttgcccccgtgattttggaatccgtcatctacgtgtatgcgccagagggagggaacgttaccctggtatctaacttcacttcaaacatcagcgtacggtggtttcgctgggacggcaaccacagtgatctcatctgtttctacaagaccaaagaaggattttcaacgccttatgtgggtttaagtctaagttgtgcggctagccagatcaccatcttcaacctgacgttgaacaactcgggtcgttacggagcagaaggtttcatgaaaagcggcgaaaatgaaacgttcctgtggtacaacttaaccgtgacactgaaatctctgaaaactacctcagctaataacgtaacaaccatcgttacaacgacgccgacggtgactggcgcggagagtaacgggactagaaatgccattttaacaccacaactacgtgctgttgctggattctccaatcaaacgccctcggaaaacaacacacacctggccttggtaggtgttgtcgtgtttttgattctgatagttgtttgtattatggggtggtggaaattgttgtgtagtaaatcagaattatagtaatgtgctttttatcagggagaaggttttgtgcccacaatgactagcccgggactatctacgtcggaaaattacaacggaaattatggactcacgaagaccgccaatacaacgcgtacaaataacagtgaccggacaacgttaggagccagtgcgtcgttgttgggaagcacggagactgcggtaaactttgacaacgcgactacgattatcccacaacgtgtggaacacccggttggggaaatacaatatcagagaacgacaacacattattcttggatgctaattattgtcatcattctcattatttttattatcatctgtctgcgagcacctcgaaaagtttacgatcgctggaaagacagtaaacagtatggacaagtgttcatgacggacacagaactatgatgttccggtacgcgttattacttcgatggataacaatcattctttgtacacgaaaatccaattattggaactacatatcaacgccatgtacttctatagttggctacagtggccagaatatcagcttatctcccgttaacaaattgtcagtcaaagacgatgcttttcaatggtatatagacaaaccgagagttactaacgcactatgtatttatcaaaataacgagtgcagtgtacaacccaatgagaacgctccgaacattaagtggcaatgtgtacagaatcatacacttattcttattaatttaacaactacatatagtagaaattactattttaattcttttgaaacccttggagtaacaatagcaaaatacaataccctgtgttacaatgtcagtgtacattctgcctaccaaacacactgttgtacaaccacgttatccatgtattcacccacacccgtacacaggtcatacacattaacttcaaccaacttcacacatgtcgcggtccattataccgccggtaacgttgaagcacaacacgatactgccaccccacatacaatgtggatcatacccctagttatcgttataacaattatcgttttaatttgtttcaaatttccccagaaagcttggaataaattcacacaataccgatacaacagtatgctcgccgccacttaaagaatcaccgtcgaggaaactaaaagctatgtacgtttatttttcagctcactgtttgaataccgtaaacataatgacgtacatatacgtggttatacaacaggtgtttgtgctatgcggagactgattaaccatatcgtgaaccatgatcttttccgatggtctgtcgtgaccgcaatgatattttacaggtattccgaaacctgtatggaggtcactgtcagagtaggtgatccagttaccctcggtagtggacatggttatcatccaggacaaaaagtacactggtataaccagtcatgcgtcggcatcagcaacggcgaaaatacgcatcctatctgcacctacgaccctcctaaacctggtagacaaaagacaatgaaaaccactccgttgccatcaccactgttgtatgaatgtcacaattccacattaagcattcttcatgtaaacgtctcagatcccagaaactattgcaggcgaaaatgtccaccaaagggtaactgtgagtttcccacatgttttacattatcgctgatttctagaacgacaaccaccagaagacccggacaaaaaactacgttgtcgcgattaaaaaccacgccaaataaacatacgcagcacaaaagatccacgcgaggaacgtcacctaaagattacaatgtaacgggtctgccgaaaggctttgcggactcgtttaccggtaacgtagaggcacatagagccaaagatgccgcacacagcgcatggattctcattgtcatcatcattatcatagtcgtcattctgtttttcttcaagattcctcaaagactccgagagaaatgggacaccaagggatacctttacaaagggaccgatggcctgcccactacggactaattatcgtgagcggacggatatgtccggtttcaaactcactgtttgaatatagggacagtccctacggaacctgagaacatgtggaaatcacctgtggtagaatgctgctcaggtacattacctttcatcgcgaaaaggtactttacctaacggctgcatgcatctttggtgtctacatcagcctccatgatgcctgcataccggtggttggcaagataggtaccaacgttacgttgaacgcggtagatgttctcccccctcgcgatcaagttcgttggtcatacggtccaggcgggcaaggctacatgttatgcattttcactggcacatcaacaacaacgtttaacagcacgcgctttaatttttcatgtctgagtaattacagcctcctcctcattaacgttaccgcgcagtatagtactacctatcgtactatgacatcgctagacgattggcgtcaccaacaacataaccatggttttcgatggactttagacacatgttacaatctgacagtgaacgaaaacggtacattccccactaccaccaccaaaaagcccactacgactacgagaacgacaactaccacaacacaaaaaacaaccaccacgagaacaaccaccaccgccaagaagacgacgataagcactacccatcataaacactccagtcccaaaaaatccaccacccctaacagtcacgtagaacatcacgttggttttgaagccacagcagcggaaacaccgttacaaccaagcccacagcaccaacacgtggctacacacgccctctgggttttagcggtcgtaatcgttattatcatcattatcattttctactttcgaataccgcaaaagctgtggctgctctggcagcatgacaagcacggcatcgtgctcatcccccaaaccgatctgtaagcaagtcgcgtaggaaatgattgcatgaaatcactgtgaaacgccaactccgtgccagctggcgcggcggacaggcctttgacgtatttgaagccaggcgcgctctcgataccgaaaggatccaagggggctttccaaagccgacgtccctgattcccttcataaagctgttgaccggccctagaaagaccaagagcatgctgtgggcccactgcggtcgcttcttgcgttatcatctgctcccgctgctactgtgtagactgccattcttactcttttttcagcggccgcagtgggcccacggcttggacattgtcgaggaggacgagtggctacgggaaatacaaggagcgacgtaccagctgtccatagtgcgccaagctatgcagcacgccggattccaagtcagagcggcgtcggtcatgatacggcgaaacgccgttgacctggaccgaccgccgctttggtcgggatcgctcccgcatttgcccgtctacgatgtgcgttccccgcggccgttgagaccgccgtcatcacagcatcacgccgtatcacccgaactgccgtcgcgaaacgggatacgttggcagtaccaagagctgcagtatctggtggaagaacaacggcggcgaaatcagtcgcgtaatgcgattccgagaccctcgttcccccctccggatccaccatcgcagccggcagaggatgcacgagacgcggacgcagaacgtgccgaatcaccacacagtgcagaaagcaccgtcagccacggcgcgagtgacaacgcagtgcggcgacggcacgaaagacggcgctataacgctctgacggtccgcagcagggactcgctgctcctgacgcgaatacgcttctccaaccaacggtgtttcggacgcgggcgtctgagacatcccgcgggaagcggtcccaacaccggcggaccgcgacccggcggtgcgggactccgtcaactacgccaacaactgacggtccgctggcagctgttccgcctacggtgccacggttggacacagcaagtctctagccagatcagaacccgctgggaggaaagcaacgtcgtgagccagacggccacgcgagtacgtacgtggtttgtgcaaagaaccacgttgtggcgtcgcacgtgggttccgggacagaacccggcggccgaagcgcaagaactggccgtcataccgccggcacccacggtgctccggcagaacgaggaaccacgtcaacagcttacgggagaggagacaagaaattcaacgcacactcaacgtgaagaagtggaggacgtttcgagagagggcgcgagagaagggaatgatgggagccgagcaagtggaaacgacgagagaaggaataatgcgggaagatatgatgatgatcatgaggttcaagagccgcaggtcacttatccagcgggacaaggagaactgaataggaggtcacaggaggagaacgaggaaggtggaccgtgtgaatcgccgccaatgacgacaaatacgctgaccgtggcctgtccgccccgagaacccccgcatcgtgccctgtttcgtctatgcttaggactgtgggtctcgagctacctggttcgacggcccatgacgatttagaatacaccgagccattcctttatttccccccatccccggtcgcttatgcgtgtcaaacactaccaataaagataatctgccaatcgcaccttatatataatatgtggtcgcgtgtggtctttttaaggagctctgaaacacagacaggtatgggcggtggccggctgccgccgctgtggctgccgctgctgatcgcctggagcgagtggggcaactgctgcctcgatgcgcctccggtggtgcgttcgccctgtctgcagccggtgcgcgaccgcaaccgcgagcggaacccgggctcaccgcagttgctgccttacggcgaccgtctggaggtggcctgcatcttccccgcgcacgactggccagaggtctctatccgagtccacctctgctactggcccgagatcgtgcgttcgctggtggtggacgcacgcagcggtcaggtgttacacaacgacgccagctgttacatcgccggcgggcgctggcgcttcgaggacggcggcgcggcgcagcggctgagcctctcgtttcggcttatcaccgagaccgcgggcacctacacctgcgtgctgggcaacgagacccacagcctggcgaccgagaccacggcgctggtggccgacgtgcacgacctgcgccactcggaccgctcctgcgacctagctttcggatctcgctcacagacgcggtacctgtggacgcccgatccctccaggttgcgcagtataaactgtggttgggagggtgaacggcaccgcgtggtccactacatccccggcacctcgggtctgctgccctcgtgcgaggaggacgagcgcgaactgtgcgtgcccttcatcagccagagcatcgcggacaacaactgcagccaccggcatcgggtagacggcgctaggcggcgctatcatctgcggagggattactggctgacggatccgaagatcgggctgctggccgcgggatcggtggccctgacctccctctgccacctgctgtgctactggtgttccgaatcgtaccggcgtctgaacaccgaagaggaaaacgaggcggcagaggaaactgccgcgggagaagcctctgcggtagcggcggcggccgtctctgaggaagagcagcagcgggagtaaacgaggagagccatgaagcggatgattcgcagtcacggcaggaaaacggaatgtcagatgacgggcgccggcgagcgacgcggctctgccgtcggtgcgctcatctgcggcagcggtacccgacgcggcagcggcgccaacgaacgccgcgactccgacgtcggtcccatcgcccacagtagcggtaccagacgcggttcggcgaatgaaacgtccgcctgtacgcggaccgatcaccagaaggcggacattgggctgtggttcatgtttctggtttttggactgtgttcgtggttggcgatgcggtatcgcgcacaataaattttgaatcgatgtcaaggaacgcgtgttttgtattttattgggaatattggcggggataaaccggtttcggatgtttacccttaatcttaccggggacctcgttgtcctctcctccttcttcctcggacacggggctccatgctgacgtaggtaccgactggggtcaaaagcctgggtacttatggggagcgcgcacaaaggaccgtcaggcgccggcatggagcgtcgccgaggtacggtaccgctgggatgggtgttttttgttctttgcttatctgcctcttccccgtgtgctgttgacctgggtagcaagtcctccaactcgacctgccgcttgaatgtgactgagttggcctcgatccatcctggggaaacgtggacgttacacgggatgtgtatttctatctgctactacgagaatgtgaccgaagacgagatcatcggcgtggcttttacttggcagcataacgagtctgtggttgacctgtggttgtaccagaacgacacggtgatccgcaatttcagcgacatcaccactaacatcttgcaagacggactgaaaatgcgaaccgtccctgtgactaaactgtacaccagccgcatggtcactaatcttaccgtgggccgctatgactgtttacgctgcgagaacggtacgatgaaaataatcgagcgcctctacgtccgattgggctcactatatccgagaccgcccggatccgggctcgccaaacacccctccgtaagcgccgacgaggaactgtccgcgaccttggcgagagacatcgtgttggtctcggccatcactctgttcttcttcttgttggccctacggatcccccagcgattgtgtcagcggctgcgcattcgcctgccgcatcgataccagcggttacgcaccgaggactgaacggataaccgcaaaggccacgtgcaacgttcacgctgctataagaaggccatgtcccccgtggacgggtctctttgacacgagcgcggcacgccgttgccacgagcatggatcacgcgctcttcacacacttcgtcggccggccccgtcactgtcggttggaaatgttgattctggacgaacaggtgtctaagagatcctgggacaccacggtttaccacaggcgccgcagacatctacctcgacgccgcgctccgtgcggcccccagaggcccgccgagattcccaaaagaagaaaaaaggcggccgtccttctattttggcacgatttgtgctggctgtttcgacgacttttctttcctcgggaggactcggagccactgatgtcggatccggcacggtctcccgaagaggaggagtaaacaacacacggctaagaggatacatcatcaaagaagataggaggggtcaaaacgcggactgaaagtatataacgccgatcatgtccgaggaactgttaataaaacgccatgatgacaacgtggtgtctgacgttgtttgtgctgtggatgttgagagtggtgggaatgcacgtgttgcgttacgggtacacggggattttcgatgatacatcgcatatgacgttgaccgtcgtggggatttttgacgggcaacacttttttacctatcacgttaattccagcgatagaacgtcaagtcgggccaacggtaccatttcttggatggccaacgtctcggcggcctaccccacctacctagacggggaaagagccaaaggtgaccttatttttaaccaaaccgagcaaaacctgttagagctggaaattgcgttgggttaccggtcacagagcgtgctgacgtggacgcacgagtgtaataccacggaaaacggtagttttgtagccggttacgagggatttgggtgggacggggaaactttaatggagctcaaggataacctgacactatggacgggccccaattacgaaattagttggttgaagcaaaacaaaacgtacatcgacggtaaaattaaaaacatcagcgagggggatactacaatacaaaggaactatctcaagggtaattgcactcaatggtccgtcatttatagcgggtttcaaacccccgtcacccacccagtggtaaagggcggtgtccgaaaccagaatgacaacagagctgaagcattctgtacatcttacgggttctttccaggggaaattaatattacttttattcattacggtgataaggtgcccgaggatagcgagcctcaatgcaatccgctacttcccaccttggatgggactttccatcagggatgttacgtagccatcttttgcaatcaaaactacacctgccgcgttacacacggtaattggacggtggaaatccccatcagcgttacctcacctgacgacagttcctcgggggaggtccccgatcacccgacagctaacaaacgctataacaccatgaccatcagcagtgtcctcctagccctgcttttatgcgctttgctattcgcgttcctgcactactttaccaccttgaaacaatacctacgtaacctggcctttgcgtggcgctatcgcaaggtccggtcgtcatgaccatcaacgccctgtatgagctgtttcgacgtcggttaccgcgtgcccccgtcaacacggtcatgtttctcacgcgacgcactcgtgatgggttctgcggtcggttgacgtccatcgccacgaattcccactacactatgttcgtgttggatcacgggtccgtgcgcatcgagcgaccgagtcagtcagaagtggattgcgccagtttaatggaaacgctgaagcggattcggttacgaaattcgtgggtagcgtcagaagacgagctagatgtgagtcgcagggacgcgtgacacgaaacgcgttcaggattaacgtaggttttcaaaataacctacgtccgtgagtgacgcggtttcgtgttgaaacccgcgcccggttcccacggtggtttatgatgaaaccggcgttggggatctacgcgggttcctcattcaacctgcgaaaagaggaagttgcggtaaaaccacgtcaataaagacgtcaatgacacctcaatgttgcgttggaacggtctttatatatacaaacgccgttatgctcagtgtccggcaagatgctcgggatacgggctatgctggtgatgctggattactactggatacagttgacaacgctcaatggcacccgaaccaacaataccgataccatctttgtgtctctccttaccggtcccaacggagttacccgcacggccatcgggggtttgtattcaaactacactaatttaactggaccatttggcttcacttcaacaaacgcatcaataaccaactcttccactgagggtaattggagcgtggctaatctgacagagagctgcatcaaccgcggtgagtcctatctgactaccctctggcttctgaactgcactcaaaacaatacttattggtattctggaaatgcttacaaccataccaatagcacctgtgaaaatcaagtttcgaaatatctcttttccggcatgtgccagctatggaaaaattggatcaatattacttttaataacactatcaaagtcgagttgctgggaaatgaaacacgctgcatgctgcttcctaaacagtatactctgaacgctacggtagaatggtacaacaaatctgaaggtaacgtaccaaaagaatttatggactatgttatcctgacccccttggcagtgcttacatgtggacttcaggaagcttatatagtcgacaagggtcgtagatacatgtatctgttctccgtgtcctgcgcgggaatcacaggtaccgtatctattatactcgtctccctatcgctgctcatcctcatctgttactatcgctgtggccggcttctgatatgcccacgcggctttgaactcttgccagaattcactgaggaagaggaggaaaaagaaaaattgttaacgcacaaggacattgaagtccaggtgcctatccgcacgcggcgactgctcgtcccttggatccgggagagcaaaatgtgggtactaccacccccgctgcctccacgacctccccacttaatagaattcccgccgtctcctccgccatcgcctggacccatgcacatggtggtctgcatgccagcatgacggactttggactctgagccccaagcggtacggactacatattttccataaatctacactgaacttgagcacaaaaatactgacaatggactggatatacagacttttatatgatccctgtacagatgtaaataaaatgcttttatttaaaactggtcccaatgttcttcgggaatcatgggatggggacgaggtacgcggtagggagcaaaaccgggcacatgggggggaacatcgtccagcagtagcaccagcggattgggcaggggctgttgcggaggtcggtcgatgacgatgtcgatctccatcggcagatccggtaacatctcttcgtctccctcaccgaccagcactcggcgctgttctggatgtatatgattctggaaaagcctccgacgagctcgcggcgcgtagaaagccaagcggcgcaagggccggcgagcccgaaagtccatgcgcacagatggcatgagtccttgagtgacggtggtgagctggggaacagggctacctcccatcgcgacggtgacagtggatccatgagagaggcgccgcacgctgcatggctaaataccgtgaatcccctgacgtcgtctttcgtcccgaacgcgtcatgttgggggcgaggcgtaaaccgtcgaggttgaaaaaccgcgtatctgcggttcgtccggactacgttgtttttcagaagcggccacatgacctcgagatgtcgtcacccaaggtatttaacggcacacagccagacgcgttcgtcagcagcgacgccgacaagacctcagcatggctcggaggctatggatactgagcttagccgtgaccttgacggtggctttggcggcaccttctcagaaatcgaagcgcaggtaaacaggtaagaaatacaaaaaataacgtgattgtgaacgcggttatcgtgtttttgcagcgtgacggtggaacaacccagtaccagcactaactccgatggtaataccacccccagcaagaacgtaactctcagtcaggggggatccaccaccgacggaaacgaagattactccggggaagagtatgacgttttgattacagacggagatggcagcgaacatcagcaaccacaagagaagaccgacgaacacaagggagaacacaccaaagaaaatgaaaagacccagtagcagcagatcccaagggttaaagaccatgttgactatcttgttttttattaaaaagctgtaaggttctgctctaaaaacaccccgcctccggtcttttttcttttgtattcggcacgcgaaacatggtttcttcccatagcctgtctaactagccttcccgtgagagtttatgaacatgtatctcaccagaatgctagtttgtagaggctatgcgggatgctgcggcggcgcgaccttccctctccacccagccccgtcaaaacacacgcgactcgagcggttcgtatgaaaaataaaaaacagctttttatttacaggaacggggaaaaaaaaggcacacggtccgtgggagacgcgggttcacgcgtcgtcaaaaagttggtggtccactccgtaaggacaggtaggcttatttagcttccgcatgctcctggttccgtaataaatgccgttttcgtggcagcgtgtcatgccgcgagtcacaaactccatcaaactgtcggccacgatgcaaacgtgctgattgttggcagcaaagacgcgcatacagtcgtccacgaagaggttgatcacgtcgtaggggcttaccaaccagcctaaaggttccacgtggttactgccgaccatgaccctccagtcgttaatctcgctccagtcgtacagccgaatcgtggagacgcgaatgacgctgtaatcacccatgaccatgagtcggccgcgatacgtagcacgccactgcgcgaacgcgtggatgtgcatgcagccggccagcgctctaagcgaggcggtgtgcggcagctcctctgggacggtgatgaagttgcagcgtcgcaaaccgatgttgagaaattcagtgatgctctcggccacaaaggtcaacgagtcagagtagatgtggtcggtccacaggtacatggcgcccgaggcgcccaggtacagttcagacggcacgttgtgatcgcccttgtgtttaagaaagttgtaggtgcagatgctgccgacgaaacgcagcggctcggggcagcagaggtagctggccagacgctgtgcatcccgtccttcgtcgcgcaccaagcgccagcgacgccggataacgaggcagcggtctttgggccagaccagggccacgcgttgcccgggtttccacggtcgcgacgtcttaggaggcctccagcggtcgagcagattgagaaaacagtccttgattaccgacatcgcggtcgcgcgtcggtggacaaaaagaaatcgggccgatccggaaaaaaaaaaaaacgacggcaaaacaccgccgtgctcgagcgaagggtggcggagggccagaagatgcggccttgacggcgttggcagcgaaaaaattggcacgcgagtcaaacgggaagtagcgtcggtgttttatgccccaagcagcgtcgtcgtcactcgtggcgtcacagtcaacggtgctgacgtcctttggggcagtcgggcacgcgatcgtagatgccgttgtggccgctgaaacgtcggttttcaaacagcaggttaagtcccagacacatgaacgtgttgagattatctcccacccggatgtagcggtcgtcgcgcacgtcgcaggcgtagacggccccggtataggcgacgacgatggggataaggtcgacgggccagcgcaagtgaggaaagggcgcgttctcgcccttgaggctgacggttcccaggccgagaacgcgcattccgaaagcggttttgatgttgcgcagcaagtgaccgccttccacgctgttttcgaaacacctgaggttgcatagacgcagttccgttcccggcgggtacgtcaacggcatgaactgcccgtggtggcggatgatgaatcgcgccatggtatccaaaccgaggctccaggcgcgcaacagcgggcgaaagtagcgcttaaccaacgacgaggtcaggtagcgcatgcagtgcagggtctcgacggcgcgcagcccgacgcgcgcaaactccatgaggttgcgggccaggtagtagacggcggtgtcctcgcgtacatagcaaaaaacatagccctcgtccgagatgaggcacacagcggtcttcttctgctgatccggcgacaacacgccctcgttcacgaagcgacccacgaaggccaggcgcgtctggcaacacaggtagtgactccaagccttcacgtcctccggtttgaagtcctcgtccgtctcgatctcctgcagcactaggttccagcccggcggccagaccacgggcaacacctggcctgcgttgatgcgcacgtaagcttccagacagcccaggccgaactcggccgtgagcgccaggctagccagatcgctcatgtgacgcgccgagtcagtgggcgagcccgggggcccgtcgcacaccacgctccgtcttcttgtcctcaccgcggccagcgtggcgaggacactttccgcgcccgaggctgtatcttcggtttgcccgccggagccggccctcactatataacgtcccgcccgggtctcctccatgtatgcaggtaagcaactgagccgaacgcacctcagcagacgagaggatgtcgtcgcggcgtcgcagctcgtcacgtcgctctggcgaaccctcgacggtgatttatatcccctcgagcaacgaggacacgccggcggatgaggaggcggaggacagcgttttcacgagcacgcgggcgcgcagcgccacggaagatctggatcgcatggaggccggtttgtcgccctacagcgtctcctcggacgctccgtcgtccttcgagctcgtgcgcgagaccggcggcaccggcgccgccaagaaaccgagcgaaaagaaacgatcgtcgtcgcgtcggcaaccgcagatcgcagcgggcgcgcctcggggctcgccggcgacacccaaggccggcaagtcgcctaaagtctcgcgaccgcctagtgtgccctcgctgcccgagaacggcgccggcggcggtggcgacgataacagcagcagcggcggtagcagcagtcgcaccaccagtaacagtagcagaagtaccagtcccgtggcgccaggtgagccgtccgctgccgagggcgatgagttttccttctgcgacagcgacatcgaagactttgagcgcgaatgttaccgggtcagcgtggccgacaatctgggcttcgagcccagcgtggtcgcgccgcagcacgtcgagtatctcaaattcgtgctgcaagactttgacgtgcagcacctccgccgcctcaacgaatgcatacccatgccggccttcgcgctcaccagcctcgtcgaccccgtcttaaacaacgtagcgcctggcgagcgcgatctcacgcgtcggataatcacgcacgcggtgatcatcaactattactacgtggcgcaaaagaaagcgcgccacatggtggaggccatacggaccaccgtgcggggcgacacggtacgccaggtagccgcgcaggtcaacaaccagagccgttcggggcgtgcggccgcgctagcgcttcactttctcacgtcacgaaaaggagtgacggacggccagtacgccacgtctctgcggcggctggacgaagagctgcggcatcgcggcacgcccgaatcgccgcggctcaccgaggtctaccagacgctacgcgattacaacgtgctcttctataccgcccactacacctcgcgcggcgcgctctacctctatcgacaaaacctgcagcggctcaacgagaaccaccggggcatgctccggctgctttcggtcgaagagatatgcgaagagcacacgctcaacgatctggcgttcctagtaggcgtcgagcttatgatcacgcactttcaacgcaccattcgcgtgctgcgctgctatctccagcaccagctgcagagcatctcggagctgtgttacctcatctatgtacaactgccgtcgctgcgcgaagactacgcgcagctcagtgacgtgctctactgggccgtcagtcaaaactacgactacgcgctctacgcgagcacgccggcgttgtttgactttttacgcgtcgtgcgtcagcaggacgccttcatttgcaccgactacgtgtattgcgccctgcgcctgctggcctgtcccgaccgacctattatcggtgacaccggcggcagcagtagctcccaacgcctcgtaggtgagtttatggtgcgcgatccgctgttgcgcgacccgcgcgccacccacctgcgccagaaactcatcacccgagacatatgcgtggcgcggttgcaagcgcagccctcgagtcgacacattccggtcgaacacacgggtgtctcctccgtcaccctgctcaaaatctttagccaggtcccccccgacgaacgcgaagaagacacgttacgcgagatggctcttaaagcgtttatggaagcgaacggtaatcaccccgaacaaatctgccgatccccaccacccccgctgccgccgcgcgactatcctcaacgcgacgagcgggaccgtcaccgtcgcgaccgccgcgacagcggggaatactgttgctgatggtggaacgaagcagcagggcggaacggtttatgataaaaagtcacaggaaagtatgtgttgttttttaatgtaccaagaataaaaaatgcgtctacgaccaaagcggtgtgtggacgctcgtcctctctgtcttctccgggttttttttttcatgtttttttttcttcctattttgttacggcaacagcgctgatggcacgttgccggcttcgaacatcgcgtcggtgatttcttgcttgcccggcgtcacacggtgacgtagcagcgcgcggctcacgtagcaggctgactcgcggatgacctggccgtcggcgtcgcgtcgcaggcccgagcgtttgccgtgacgcagtctgccctgcgcagcgcgctccacgtcttcaaagtagctgtgtagcaggccgcgctccagcagctgcggcagcgagtcggcggcgcgcaccacaaagttctcacggctgatctcgtagcacagcacgctgccgtcggccgccacgccggccacgctgcggtcccaactgaaaaggttggcgagtccgatggtgccgatgacgcgcaactgaccctgggtcaccaccagcagcttccagtattctacgtcgcgcggggtgaggatggtctcctccacgtcgcagacaaacagcgtgtagccgcgcggatagggcagatccaggtggcgaccgcgctggcggcgcataaaatcgtctaaattcaaaccgccgtcgggtgcgcgcctgctcgtcatcgccgcgcctcgtcggtcgatgaccccacggtgcttataacgcgccgccacggcttcatgtggcgtgacctccgacctcgtgaggccgaaaacggcgtacatgaagacgctcaaacttttgaatgtgggcccggtagcgcaccgagggccccggggcggcgacgacggcgggtccgagttccagcggggccttgcggcggcagcggttagcctggttgctcagctcggcgtccgagagcgccgagctgaactgcggcagccgcgtgcgatcctgcggcgcgtccccgtgtcgcagcgagtgccagagcaggcgctggacgcgcgccgtctcgggcgtcggcggcgcgcgacagccccggcgcagcttgaaaacgtgcaggcacaacagctcgcgcttgatgcgcagcgacacgctgcggtagtcgggaatccgctgcaccagctcgagaaagtcgcagaaggtctccacgaacgtgtcctcggtgaagcgaatgcgcttcagatcgtggacgtgtttgcgaaaccgcgacagttctcgacgttgcacggggttctgagcgagtcccttgcgcagcagcgcagcctcgcctttaaacagcctgatgagccgctgcacgtccccgctcaacatacgtatacacgccgtgtactcgtgacgtatactggcgcgcagcagccgaatgatacgcagggccagcacggcgttggaggccaggtacatggcgtagccgcgacgcgggttggcacaggcccagcccgcggggagcagaaagtagtcgtcgaccagcgtctgcgaccagtcggcgaagcccaggtcacgtgatacgctgtcctggacgcgggccacgtcgccggccgtgaggtggcggatcgccggcaggtgaaacgcgcccaggtgtcggttgcgctccagtctcagctcggcgtgctccaaacgggaatggtgggacgccaccgcggagggcgacaaagaggagtggtcattgccgccgtggttaccgttgtggttaccgccgttgtcgcgcccgtcgccgcactcgcaaaaggccgcgtagaggtccttcaacgccgcttcggctcgcgccataaacgtggcgtggaaaaaaacggcggcgcggtgcgtccggtacttgacgggcaacccgcggcacagggccgccggcaggcagcggccgatgagttcgcgctcctcgggctccagaaacaggcacagggtgccgtccaggcgcaggtacagctcctcggtcatcgagcatagctgccgcaaataatgggtgcgcgtcccaaaggtcttgtaatcgagcaacgtgcacaccacgtattgccccgtggccacggccagagcgatgcgtttggcggcgcgactgatctctggcaagtactgcgcctcgtgcaccagacggcggaaagcgccggcgttgagccagcgaaaatgctgcggatcgggcggcaagggcacgcctcgaagcgcggcccagacggcgaggtccgactcgagcgtcagaccgcggatgtcgtacttgccgtgcgccgtagcgcaggccgaatggaccagacagctgcggcgaatgtacaccatggcgtgcttgggatgtttgggcgccggcgttttctttttctgaccgccggcggccgccagatcctcgggcgtgcgacacaacaggccggcgcgcacagcctcctgtcgattacgaatcggcgtcaggtaggcgcgcaggaactggtgacaaaactcctcatcatcacgacagtcgtcgagatactcgtacgtggtgagcggatcacgaaataggcgctcgtcaccgtcgtcatggtcttctttagcctgctcctccggctgctgggttggcagtggaggcggcggctgatccacggggttcatgactgagaggaagaagaaggtggcggcgaagcgacgcggagcgacggcggtaaagccaaacaccggctatatagctagtcatcacagtctcctccttcacgacgcccccgtgccgctcacgctatccagcacgctacggcccgaaaacacgtactcgctgacgtcgtacgcgggcgatgtatggctgctcaccggtttcgcggcgacggttgcgctcgagtccaacggcgagaagcaaaaacgccgtgggcaacgaaaccagaaggagccctgacggataaaaccgcgcagcgtctcggccaacttaaccagcatcgtaccgtacagcagtacgtgaatgccgccgtgcgcgtccataaatacggctttgttcacgggctccatccatccgatgactacaaagtgggcctgttctagcacgccgatcacaaaattgttggcctcgtcggcctcggccacgttccacgagccgaaagtgaaagtacaagcgggcgagccgcccaggcggatcttgctaccggcgtggagctgacatacgcgcagcagattggtgcggtcgtgcagtatctgggagagttcgtacatgcccgcaaaggtgtgcttaaaccacgcgccctctacgatttcatccacgtagtcgcgctcaaagaagctgtacacggcaaagaggccgttctcaaaaaactcgccgaacgagagccccagtacgtacaccttgtcctcgccgggcaggtacgcaaaggcgtgcccgtgcccggagacccagatctcgggcgccgtgtttgcgtccggcacgcattcgtacacactgacgaggccgataaagtacaagcggccagcctggcgcaggcacgagaagcgccggtaggtcttgtgatcgcgcaccaccccaaagtactgagtgtcgcccagcatgatgccgtgcagcggcggccagcacagcgggagccaacgacccgccgtggcgcgcacgtagcgctgcaggtgaaccccgctcgcacgctcgcgcggcttcgggcgcttgtgggtccaggcatcacgcagaccgcgccagatgctgctgaacttgggctgcccgcgcagatagagcgacgagagcgagtcaaagtagcccacgacgagcctgtcgggagacacaagagcgcgaaaatcaaacctagagcgacgacggtgaaaaaaccgaccagaagcgcgtgtctcaaacacgctactttcggttataaaaacaccgtcgccctatttctgggcgtgtgtacactgatgactcacctacgctttttgaacggcagtctcagctcgggattggcctcgtacagcgagctgcggtccacggggccgatactctcgtagcgaaagtcgtcgatgagcagcgccagccccacgcgcacgaagcccctgaggtcgcgcgccagccgcaccaacttatcctgccccaccagcgccgcgtacacggtgcccgtgtcgccgcagagaatccgcacgcggtgaaagaaggtcttgtcctcggcgccctcaatttcgcccagcggcatgacgggctcgcgcgtgtacaacgaacgttgaaagcggcgcagcatcgaggccgagagccccagatcgcgcgccgtgcgcagcactagggaatgcttctcgggccagatgagggtcagttgcgcctcgcggtgcgcctctacgtaggcgcagcgagcggcggtgtcctcgcaggccagcaactcgcggaaagccagcaacgaacgtaggtagcgaccgcgagcggaggcgcgcgagcggcggcacagctcggcccgatggtcgggatgcaccaagggcacgttgggttgcagacgcgcgcagatggattcgtgcaccgggtcgcagcggatcatgcccttggcaaaaaatccggccagatccgaggccaactcgtacaggcagtcctcttgcgcgtcgtaggcgaacacggcgccgtacgcgtccacgaacacctggtaccggcaggtggcgtgcgagaccgtgccaatgagatgcagagctcggaattcgccgaaaaagtcgttctggcagtgctccagatcgatctcggtcagcgagtgcggcgaatgctcgcccccgaccacgtagatgcactgcgagggccagcccagcgatacgcacgagccctcgaagcgccgcaaataacgccgcaggccctcatagtcgcgtcgcacgcacagatcggccaagtcgcgcgtgcaaaagacctcgggtaccaagcagcgtttgcgacgcggccgacgcgcgtgcccgggcagaggaggaaggcgcgacggcggcgacgacgaggaggaagacgccgtggccgccgagcagcccttgcgacggccggacatgccggcagtccgcgacgatccacaggagacaaaaaagcagaagcagcagtagtctcggcgacccgctccaccccgtcctccacacgctcagccgcgactgagcgccggggcgcgccgctacttgggtttttatagccatctgccccccgtctcgggcacccgggagcgatctacggagacctgacagcagttgggcaacacaagacagggaaatacaaagacacttttaataaaaaacgagactactttgtgtgtgtgctccgtaaactgtttattctccccctccgtctcgctctggatgggctccgggtccgtcaacacgcgacccgcgcggcaaaaggcacgctgttgacggcgcgagagcccgtcgtgatagtccatcatgccccggagatcgtgcacaaagcagctgtcgccgcgcagaaaccgacgcagcgtctccacgtgctgcagctgtcggcgcgtatcaggagccgtcatcgccgatgtcgtcatctccctgacaggcgcgtagatggctccgcgagatcatgcgcgttttcaaccgccgtgacacatcaggtccatcttgagctggcgccgggcctcgcgcaggtctcgcacgcgttgtgagcgggaggcgagttcggcttcttgctcgaactcctgctgctcactgtccgagagggtgcgataaaaggcggcaaagtcctccaagtcggctacatgcgccctgggtctgacgctccaaagcgtacgcagtctgatgaagcggacccatcgagcgtcacggcacgccgtcttgaacgcggggcccgggaagaggttcttctccccggcgcgctcgggccggcgaggccgacgcggtttatatacaccgtctcggacggcgggacgccgagcccgcgccgcggccgctcatccggagacggcggaaaccgcggcgccggaggaaacggggaccggcaacgacggcggcggcgaccagattatgggggacaagcccacgcttgtgaccctgttgaccgtcgccgtgtcgtcgccgccaccgtcgtcgccgctgccgctcgtcagcttcacggagctgctgttaccgccgccgtccgtcgccgccgctgcggtggcggcaacagcgacgagcgaggtgggcgagaaaaccgcggagcaagaggtagcggctgcgggtccggagaccgggaatgagagaagagaaaacagggaggacgaaggaggggagacgaggacgacgggcaccaccgcggtcaaaaggtcgcacgacggtatccctcgccaactggcagagcgcctgcggctgtgccgccacatggaccccgagcaggactatcgtctgccggcgcaggacgtggtgacctcgtggatcgaagcgctacgcgacgcggaccgcgacaactacggtcgctgcgtgcgccacgccaagattcaccgttcggcctcgcacctgacggcctacgagtcgtacttggtgtccatcaccgagcagtacaacacggcctcgaacgtgacggagaaagcttcgtacgtgcagggctgcatctttctctcgtttcccgtcatttacaacaacacgcagggctgcggctacaagtacgactggtccaacgtggtgacgcccaaggcggcgtacgccgagctcttctttctgctctgctccaccagcgagagttccgtggtgctgcaaccgctcatcaccaagggcgggctctgctcgtccatggcggtttacgacgaggaaaccatgcggcagtcgcaggcggtgcagatcggttttctgcacacacaactggtcatggtgcccttcgtgccgcacgcctgcccgcattacgccgtgcctttcacgacgccgggaaagccgggctgcggcggtgctccgagcggcgttgcggggttggaggaggcggcgccctttggacgggtcagcgtcacgcggcatggcgcgacgctgctgtgtcgcgtggaccatctgacctggatcagtaagcgcgtaaccacgtacggacacaaaaaaattacgcgctacctcgcgcagttccgcggcacgatggacgacgacgaggcggcgctacccggcgaggacgaggcgtggatcgcgtccaaaaacgtgcagtacgaattcatgggtctcattttcaccgtcaacgtggattcactatgcgtggacgcggaacagcgccaactgctgggcaccgtggccacctccttctgtcaccgcgtctcggacaagatcacggcgcgcaacatgccgcgcgccttttccttctacttgctaacgagcgcgcagcgcgggtacgacctgcgatttagccgcaacccgtcactcttttttagcggcgacgcgctcaactgtccgcttctcaacgagcccaacgtgttttcgctcacggtgcacgcgccttacgatatccacttcggggtgcaaccgcggcagacggtggagttggacttgcgctacgtgcagatcacagaccggtgtttcttggtggccaacttgccacacgaggacgccttttacacagggcttagcgtgtggcgcggcggcgagccgctcaaagtcacgctgtggacgcgcacgcgttccatcgtgatcccgcagggcactcccatcgccacgttgtatcaaatcaccgagggcgacggtaacgtgtactcgtacaatcaccacacggtgtttcggcagatgcacgccgccggagcaaccacgttctttctgggcgacatgcaattgcccgcggacaactttctcacgtctccccatccctgaccctccgtccgtcctcctttcccgacacgtcactatccgatggtttcattaaaaagtacgtctgcgtgtgtgtttattaactattcctccgtgttcttaatcttctcgatcttttggaggatgttctgcacggcgtccgacggcgttttggcgccccccatgccggcagaacccggttgcggccccgtaccgctcttctggggcgacgataggtcgaaagccaccgttttcatgcccgtcgtgctcttgacgggggaacctacggcggcggtccccgtcgagcggcgtgattgcaaagccgcgctcgcccccggtttcaggatggagggggaggccacaggcggcgcattcgatacgctgcttttggccgtagacgacggtgggtaaacggtggttaccgcgggatacgtcggcgtggtcgaggcggcccggctggtgccggacaggcgacccggcgcgctaccgctcacggggaccgagggcggtcgacctaccaccgccttgccgcccaaagtaggtttcaaagaaggaacaccgacgcggctgccccgacctttcaccggagacggaggggcactcttggccggggacggagaggctgacgaaagcatggacagcggcgacgtgacgggggacacgacatcatcctccgtgggcgacaaaacggacgccgaggctgacggctgtcgagccgaagcggaagaggttctcgcgccagaagtcacgttccttgatgacgttgttttagacgaagccggttgaggttgcaacagcgtggcgggtaccgtcgacggcgtgcccgatacctgtttctctacccttccctgaaccggtgtcgacgtcaccgtctgcgctcgggcggacgcgtgcggcgtcgcgactcgcttgcccagcaccggtttctggctcgtggatgtcgtcgtcattggagacgataacttagctttacgtattctggacggcgtcgactgctcgggcgtctgactgggaggcgaaatgacgtcgttgtaatcggacgacggtgttgtgtgtcccaggctgacgacggagccggtgtccgaggagtcgtcgtcttcctcctcgctgtcttcgaccggtgactctgcagtttggtcccttaaagcccaaacctcatcagcggcgttctgagacgctgtttgtgtcaccgcggcgcgtggagtcgacggcctccgaggggtggtggacacgttgttttgagaagtcgtggaagtcgtaggcatcctgaagggattgtaagccaggtgaggattcttgagggcccacgcgcgttcgcgcggccagttggcggggttcatatcccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttgcttttggagaagctgattatatcgtccgggttcactggcgaggattgcgctggttaactgcagaaggaatgcgctttgacatgatgggttttctgcgcgggctggattgcggtaagaacggtgaaaccactgtaatgataggcaattcaggtaataaaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatgggttcatatccccgggcaacggcgccgtcggagcccagggcgagttaccgttgaccggggtttgggtacccgcgaaggtaggtgtcggggccggagcgggggccgtggaaggattgacaggcgtcggcgtgaggatggcagcgccggcgccagcagggacgttaactccggcgccgaacgtcaacgtcggttgctcgaacttgtacgcggtggtgacgggcggtttggcgctcgtctcggtatccgtgatgtccaccggcgtgtcggtgaaacgcggatcttgacggttggggggatagccatccgagctgtcggaatcctcgtcgcccgagaaaagatcccctcttgtctccgtgagcggcctcacgtcccacgcgctgtcccgacggacccttcccgggctggccttggttacctgcggggagacgagactgaaagccgcgtgacgctgttgttgctgcgggatgttcaagggaccgctggtcggtttctgactgcccgaggataacatgccgctgaaaatgctggaaacaccgttgccactagcggcgcccttgccgctagttcccggtttcttgatgggcgtaaagatgtttttctcgtcatcatcatcgtcgtcgtcctcatcggcactggagccaaagagcctccgggaggcgcccggtttacgtgtcgggggcggcggttgctgctgacgttgctgcaggttctgctgcctctcctcccaagccttcagctgctgtttctcacgctgcaccacctcgtcgtccacccgtttctgccgctcgcgacgcttttcctcttcgtcgtaatagccgacggccgccgaacgggcggcgtgggcgtcggcggccggtgccagagaaccatgggcctcgaagcggaacggtttgtgtcccttccagggactggcgatccagctccagccgtccagcggctgcgtggggacatgtttcttgggtaccgacgagaaggctgaaccgccgccgagcgagaggagattggcgtcatcgtcaaactccaacgacggcgggcgcgcgcccaaaaaggtgtgcgccgactgcgggaagctgtccacgtagatgtcaaagtcctcgatgagcagctccagcagcgtgtcggccgagtcaccgttttccacggcgtgtttgaggatattgcgacagtagttggaatcaaaggaaaggcacatgcgcagctccttgaccagcagcttgcagcgctcctgaatgcgcgccagacatttgcgctccagctcctcccaagacctgcgcacgttcatgatgagacggcccgtgtacacgagcttgttgacggcgttgaccagcgccgtgttggcgtgccggtccaggttaaggtcgagcggtttcacgcagaacatgttacggcgcacaccctccaggttttcttcaatgcgctgcacctccgtatccttgaggtgcacaaaagcgatgggttccgtctggccgatggctgtgaccagcgtctcgcgcaccgacatcttggccagaatgaccgcgcttacgagcgcgcgctccacaatctcagcatcgtggcgtacgtccgtatcgaattcggtacggtctagcacagccaggtggtcacgcgccttaccacgatcaccgaacgggtaagtgtagccgcgacgcgccacggccgcgcaacgcacctcgaactcctcgagaaccgaggagaggtcggggttgtggaaacgcagctcgcggtagtatcccaaccaaagcatgagctcgttgaacagcaccgtacgccggtgcaggcgtttttcgccacattttttcaggatcttggggtgtgcctcgagatccacgtcgggcttttgcgtgagatggcgcagaaagttgaccagggccaccacatcgcgccgctgtagaccgataaactgcaaactcatgctggcttttctccagaacccggaagcgtcgtcgccccggactgcgcccgcggtctgctattcgtccacgatggacaccatcatccacaacaccacggtgagcgccccacctagagggagggggggtagtttaatagcggaggcggatacgcggttttcactctggcaccgctgacttgtttcttttgttttttgctccgtgtgcttgttccgcctagaaccgcagtaccagtactccgcatgtcaacagtacctgtaacatgacggagacgctatccgccatccgcactacagaagccgtgatcaacacgttcatcattttcgtgggcggcccgctcaatgccatagtgttggtcacgcagctgctcacgaaccgtgtattgggctattcgacacccaccatctacatgaccaacctctattccactaattttctcacgctcaccgtgctgcccttcatcgtgttgagcaaccagtggctactacccgctagcgtgacttcgtgcaaattcttgtcggtaatttattactcaagctgcacagtgggctttgccaccgtagccctgatcgccgccgaccgataccgtgttcttcataagcgtacctacgcgcggcagtcgtatcgctctacctatataattttgctattgacttggtttgccgggctgatcttttccatgcccgcggccgtttacactacagtagtgatacataatggtacagatgagaataccaatgggcacgctacctgcgtactgtacttcatagccgacgaggtgtacacggtactactctcgtggaaagtgctgctgacgctagtgtggggcgccgcgcccgttatcatgatgacgtggttctacgccttcttctattcaaccgtacagcgcgcatctcagaaacaaaggagtcgcactttaaccttcgtcagcgtgttactcatctccttcgtggcgctacagacgccttacgtgtccatcatgattttcaacagttacgccacggccgcatggcccatggactgcgaacacctgacactgcgacgcaccattggcacgctgtcacgtctggtaccccacctacactgcctcatcaatcccattctgtacgcgctgctgggtcatgactttttgcagcgcatgcggcagtgtttccgcggccagttgctggaccgccgcgctttcctgagatcgcagcagaatcagcgagctacagcggagacaaatctagcggctggcaacaattcacaatcagtggctacgtcattagacaccaatagcaaaaactgcaatcagcacgccaaacgaagcgtgtctttcaattttcccagcggtacgtggaaaggcggtcagaaaaccgcgtccaacgacacatccacaaaaatcccccatcgactctcacaatcgcatcataacctcagcggggtatgagctttcctgttactttattcagaaagcaccagaacccgtcgccatttcccctcatatacggtacacgtccccctgatctgtcatcacggtacacagatttcgcccgactgcggacaccgacggccaatcgcgtggcgtaggagtggcgccccggcttcattataacgccacgtcggagcccctgcgcgccacaacgccgtccggcgcaacttctgtctcggcacggtacgataaaaacgacgtcccccgtcgacgttgttttctccgagcggtgatcgttcccgtccctctcctccctccgcggcccccacggcggcggcccgctcgcacggacctatactattaccgccccaccgccgtcgtcgtcatgaacttcatcatcaccacccgagacttctccaacgacgattcagtcctgcgagccgccgagatgcgtgacaacgtggcaggctcgatttccaaagcgtacaagggtacggtacgcgccgaaggcaagaagaagctgctgctgaagcacttgcccgtgccgcccggcggctgctcgcgccgcaacagcaacctcttcgttttctgcaccgagcgcgactaccgcaagttccaccagggcatcgcacagctcaagcgcgcgccggccgaactggacccccacgagatccagcaagtcacggccagtatccgctgccgcctgcagcccagtctccgcgagccgcccacgccggccgacgagctgcagacggctgtgtcgcgcgtgtgcgcgctcttcaaccagttggttttcacggcccagctgcgccactactgcgagcaccaggacaaggtggtgagctacgcgcgcgacgagctgactaaacgctgcggcgaaaaatcggcgctgggcgtggaggtgcatcaactggtagccctgctgccacacgagcgccaccgcgaactgtgccacgtcctcatcggcttgttgcaccagacgccgcacatgtgggcgcgctccatccgtctcatcggacacctgcgccactacctgcagaacagcttcctacacctgttgatgaactcaggtttggatatcgcgcaagtcttcgacggctgttaccacagcgaggcctaccgcatgctcttccagatcggtcatacggactcggtgtcggcggccctggaactttcacacagcgcggcggccgggccgcccgaggccgatgagaacaacgacgaaggagaggaggacgacgacgagctccgtcacagcgacccggcgccgcttcacgagtccaagaagccccgcaacgcccgtcgtccccgcacacgcgtgccgcctcacgagcaaaagcccgaagaaaacgaggaggaagaagaggagctgtttccctcctgcaaggcaaccgcagcattcctgcgggcagaaccctccgtctccaacgacgacggcaacggcggcgaacgctgcgacacgctagcgaccgccctgcggcattgcgccgacgaagaagacggacctctagccagccagaccgctgtgcgggtcgccgcgaccccctcaccttcagtcaccccagcccttacccccgtcacgtcccccataaccccgttgtgtatttaacgtcactggagaacaataaagcgttgatttctcaagttccgctctggttttggtttcgttttcaaagggagccccatcatggcccaaggatcgcgagccccatcgggcccgccactgcccgttctccccgtggacgactggctcaactttcgggttgacctgtttggggacgagcaccggcgcctgctgctcgaaatgttgacccagggctgctccaactttgtggggctgctcaactttggcgtgcccagccccgtatacgcgctggaggccctggtggacttccaggtgcgcaacgcttttatgaaggtaaagcccgtggcccaggagattatccgtatctgcatcctcgctaaccactaccgcaacagccgcgatgtgttgcgggacctgcgcacgcagctcgacgtgctgtactcggagccgcttaagacgcggctgcttagagggctcatccgactctgccgcgctgcgcaaaccggcgtcaagcccgaggacatcagcgtgcacctgggcgccgacgatgtgacattcggcgtgctaaaacgagcgctggtccggttgcaccgggtacgcgacgcgctggggctgcgcgcgtctcccgaggccgaggcacgctatccgcgcctcaccacctataacctgctgttccacccaccgcccttcaccacggtcgaggcggtggatctgtgcgccgagaacctgtccgacgtaacacaacgtcgtaaccgaccgttgcgctgcctcacctccatcaaacgcccgggctcacgcaccctggaggacgcgctaaacgacatgtatctgttgttgacgctgcgacacttacagctgcgacacgcgctggagctacaaatgatgcaggactgggtggtggaacgctgcaaccgtctttgcgacgcgctttacttttgttacacgcaagcccccgaaacgcggcagactttcgtcacgctggtgcgtgggctggaacttgcgcggcaacacagcagtccggccttccagccgatgctgtacaatctgttgcaactactgacgcagctgcacgaggccaacgtgtacctctgcccgggatatttacatttcagcgcgtacaagctgctaaaaaagatccaatcggtctcggacgcccgcgagcgcggcgagttcggggacgaggacgaagagcaggagaacgacggcgagccgcgtgaggcccagctcgatctcgaagccgatcccacagcgcgcgagggcgagctctttttcttctccaagaacctgtacggcaacggcgaggttttccgcgtgcccgagcaacccagccgctacctgcgtcgacgtatgttcgtggaacggcctgaaaccctgcagatcttctataacttccacgaaggcaagatcaccaccgagacgtatcacctccagcgcatctatagcatgatgatcgagggcgcctctcggcagacgggcctgacacccaagcgcttcatggaactcattgacagagcacctctgggccaggagtcggaacccgagatcacagaacatcgcgatttatttgccgatgtttttcgccgtcctgtgaccgacgcagcttcttcgtcgtccgcgtcttcgtcgtcgtcctcagcatctccgaattctgtttcgctgccgtccgccaggtcgtcatccacacgaaccaccacgcccgcgtccacgtacacctcggccgggacttctaccacgggcctcttgctctcctcttcttccttgtcggggtcgcacggcattagctccgcggacctggagcagccgccccggcaacgacgccgcatggtcagcgtaaccctcttttcgccctactcggtagcctacagccaccaccgacgtcaccgaagacgacgcagcccgccacccgcaccccgagggccggcccacacacgtttccagggacccgacagcatgccgagcactagctacggcagcgacgtcgaagacccgcgggacgatttggccgaaaatctacggcatctctaaacgcggttttcctctttttatacgtgtctgtctcaggacgagacgttgatatcaataaaaataccgtcaacgtggttttctaacagtgtggttttctttattgaccagcggagtacacagtttacgagtaaaaaagacagggaaaggttatataaaatgctgtgttatatacaaaaacatgcacataaacaaacgggaccaccgtgctcgtcatcctctcctcaatcagttgttcatgtaggcgtgtggcggggtgaggggcggcatgccgttggcggcgccgggaataatgtgtcgtcgaccggcgtcgcacaccttgaaacgccgtcggcgcacgcagcggtcgcaggacgggatatcccagaggaagcccatataggtctcggggtcctcgtcgtgaaagcggtaagagagttcaaggtggtgcaatgagcccgtccgagctcgcagcttctggcgaacaccctccacgtcatcggtgcacagcgacagtgctgggctgtcacacagggcctgaagctcctgcggccacaggtgcgtggccaggggcgagtccgtcgtcaccagtttgacgcagtgcatcaggttctcggtgatggcgtcgtacaggcgactctcagcctcctcgtgcgtcatcacgttccgaggcagcgacagctcgtcgtcgtcatcctcgtcaaacatgatcatggggtcaggggtttttttgggatgttgacaggtgggtgtcttttccagacgcacgatggcctcacgccggctgctgaaacggtggtttcggtgtcccttctttcccatgacgcaggtgaacataaccacgtcctcggccagacggtagacggcgtccatggcggggtcgtagccgtagacgacgccgaaagtgtccaccaagacgtactggcgtacgagaaactctttgcgttctggcacctcgtggcccagcgcgcccaacagctggtgataacaggtgatgcgcggcacggtacggatcatgagctccatggtctggatgctgccgcccgcgcggacaacgctgaaggatgtttccttgaacttcataacctctgtgttgtgggtccagaaggcgaaatgggtgtcgggacactcatcgaaagggtcgtcgatgctgtaggaagcgtagccccgcttggtcacctcggccgacaggctctccacgtcaccgcggtagagcatgacggcgttccagtagtcgtcgtactgcaccatgggccgctggtagtcgcgcatagtgtggaagtggtcgcagtgacgaaagccatgccgcagaaagtccttcatggtggccgccagctcgtagacgcagtcacgcagatcatcgtagcagtagatgccgccgcgctgcccgatgagcacgatgagttggtagcgcataaagcccggaccctcgacgaagccaaaggggtgcaggtattcctgacagcagacgtaagcacctggtggagaaataagaaaaatccacacacgttgaaaacacctggaaagaacgtgcccgagcgaacgtcctctttccaggtgtcttcaacgacgtggggcttaccttgcgaacagacggtgcccatcttgcccacgaagggccccagggcgctgcgcgaacggagctggatgaagcagcgttcgggccaggccacgtgcagccgggtgccgcattcctgctccagaaagtcgttgagaccgttaaagtccccggctcggatggcgatgcagccgtaggccatcaacgtgtcccgtaggtcgtccatgacggactcctctaccttcgctcgccgacgctgcgcttctccagccaccgctgcggtcgacagactcctccgtccgccttcggagaactacggcgcggcggcacggcctttatagacactatcagcgttgacgtcagacgatccgatgaacgtcgttttttgtgctggaacttccctcgtcccgacaaatgtagcggaaatcttcaagcaaatcgcgacgaagtccgatgaggaggatgcaaaagaggctgagcaacgcgatgctgcccgccgccacagtacatatgctcaacaacgcccagtgtcccaacgcgcgacttttggctcggaggagagccgaacggcggtttttccacatgatggataacgtagtccaatacctccatccttcgcattccgatgtccacatgggaagcgatgtcatgttagttcccgtaaacgttgtgttttttttattgtttttcgtaagcttaacgctcctcttgagaaatcgcggacacatgtcttgtagaaaaatataatcactttccgcatataccgttaagattgacatcacagtgatggtgttgttttctgaagaagtcacgttatcggtgacgttggtttcctcccaatttacggatgactcaaacggactcgtgcgcgccagtgctcgcaatacgtaactgcggccggtaaggttaagcgtcagctgtcccatggtaatattagtgtcatttgtaaaacacgcaacctccccgtagacctcggtgacgttgatatcgcggctctcgttcaggatgcgcaggggaaaccagccttccaggtggtactgaaaaccaaacgtgagcatgacgctgtgccactgccgacgtgattgccgaaacgttacgtttaaaggcagttttgattcggctccggcgcaggggccgttgtagatttgcgtatgattgcacgtgcagtttaaccggcagttcatactcgtggcgttggaagtgacgttaatgtccgtaccgtggtacgtacatcggacagaaacaccgtatcccgtgctccaaaacagcgtcaacaacagccacacagacacctacgtggggacgacacgggactttttattgacggagactcatgtttacaccctcccctttcccataggtaaaaacccacgtttataacacacgttgtttttacctgaaacccgcgcggcccgtggacgcgacaaaaaaccgcggcactagaaagaaaatgaaacaagtatgtttattaagcagcatgtggggctaataggggggataactgaggtatagcaactattaaaaaatactacaaaaaaaaaaagctgaacatggtcatctagcagcaaagttctccttctagaccacgaccaccatctgtaccacgtcgccctccccggccgtgtacatcacatccttcaccacgaccggcggcaacggcggcgacgaggacaactcgctctcgacggaggccgggacgacagaggacgggggggtggtggcggcggaggacggaggggtggtgacggcagcggggtcttcttccgacacgggcgacggcagactcggcggcgcggacagcacccgttgcgccggagcgtgagaaggctgaaccccggtggcctggatgtgggccaacgaattggctcgcagcgaatcgcgatccacgaaggtcataggaatcttcccttcgcggatccgccgctcagattccaggatggcgcgcacgtagctgttcaccgatttggcaaaagtgcgcggcccctccgtattcttgtcgcgacgcgcttccaacacctgcttttcgtagtccagctggtggaagaccatcaccaggtcgtccatggtgtgcgcgtgctgacggacgtgggagcgcacctccaccgggaacagagcgttccaatactccagcactatggcaccgtgccagaactgcgccatgctgggagccaggaaaaacaggataccggagtcgtaggcgaacacgtcccacttgggcgtcatgaacaacaccagctgacgcgtgggccgcctcgaagcttcctcccaggcctcgatgaccccgaacatgatgagctcctggtccaacggggggcagtgtcgctccagccaactgatcttgctcaggttcatctgcagaaactcgtaggaggggtcgcagatgcacacgtagagacccgagtcgtgccgcagcctggctccgcgcttcatcagtttcctcaccgcgtagcgaagcgccaccttgcccaacgccgacgcctggatcagtccccccacgtccatctgcgtctgtcgccactcggcctcgtccagcaggctcatgatagcggcggtgctatgcgtggtcgtagtcatcctttctatccttctctatgaatagcagcaatagcggtaaagtcccttcttatactatcccggagtctgtggtttttttgtttacccctgcttactggtgagactgctgggggccgttgtgctgcagcagccgagcttgtcgccgccgttgccacaggaaccggtgcctccgcagggcctttttgagggcctcgcaggcttctcgcgcaagtcctgagaggccctcggcgtcgatggggttcacctcgggcgtccgagcctcgttttcttcttcttcatcctccctttcctcctccgtgtcctcccgctctgtgtcctccgttacgctctcctccccggcctcggccaagagcgcggccaccaagtccacggaccgctcggtctccgagttctcaccgtcaatgacgccatgttggcggcgtaaccggtgccgagaacgccgggtgagcgcacatgcttttttctttcttaaccaaggcgggagaggatcttcaaggcgttttcgctggatccagcggtagctaaagtaccaaaaggccagcaggcccacgctacctaacagattcacgtagactggagacataattaaagaaagaagtgaaacccgcgtgtgggtctcacgtcgtcttgaaacaccgtcttatatacatgaagatgccggacatgacgcgcccaagacacgtggggttttccccttaggcgacccgatttcttaagatgtttttcatcttcgcacgcgatgtactacatcaaagggtcggctgaccgaccgcattgacgcacagtttccgagtacgcgcgtctcggagcacctgacggtgagccacccagctcacgcggatagggaacaacactgacgtgaggggcaattcacgtcactgacggctgacgggaataagacgggtgagggatttccacctttttcttaagtgtgactgtccttacggtaaatcgcacctgtgacctcttaacccctcctccctggtacccgataacagtgaaaaacacacaccacacgtcacgacaccgatcgattttctttattcttagtgtgatgataggtaagggcactcgtgaggatgtgcagttatcattatcaagccttcttcaaggcgtagtgatgatcgttgggcagaacccccaggctcctagcgatctgggaatagaaggaggagaacgagcccagggccagaatgcccacagtgtacatggcccaggtctccagaccgaacgtggcgggtcgcagcttcagatggtaggccacccgctccgagagttgtgaatgctcgttcaggcaacaggactgcagatgggtgagcccaaaagcgctttcgtttacgccgcgcacgtgcaccgtctgggccggacaatcctggtgttgcgcgcgaaagtggtccaggcaggagactccgtctgcgcggcgatgtgtgttgttacccacttcaatcaacagcgtgttaacggcaagatgacgcgagaacgcgacgacggtgttgctggaggtctggcggcagcagtacaaaggcgcccgtcatgaagacgtaggcaggggaattcccatatttttatggcttcttttaaaagtctgtgtccgactccattcggcgcttttcccaaaccgtggtctcctcgtcgtccgactcggtacccaggagatggtaagtcttttgccgcacgtagaaagctttcaacgtggagcaaaagatgagaataaagaccccgaaaacgaaacaaaccacgccgatcatgccgatgcagacgttcatgtcgacgtagccggcggtgctgttggcggtgcggcaaaagagtgtcatgtcgtacgtgcacaaaaaacaccacacaccacaggccaggtcgtagcgtagttattattccgtagcagcaatgatggtacagtcaagcacatgatctatttcccgttatcccgatgttgacaccgtccccgttgtattggaattgtcccggttaatcaccacggtgaacaccacggccaagaaaatgatccctaatatagcgaccactaagagagcaaaagtccatttccagccgttgtcaaagtacgcccccgtggtgggatgcatggtggcgggcatttccatcatatccatgtcgaacgtgtgtcgcggcgacggcgaactaaccaggcagtacgggggtcgatagggcggtgggctgcagtcaggtggtggcggcggtggcgtggaaaccgtcgtcgggcacagacccatggcctgctcgtaggtggggggcgcgtcgtcgtgatcccggtcgcggagcatcggcgtgggctccatgtcggtggcagtgacggcgacggtggtaactgtggtggagacggtaccgacggcgtccgcggctcaccttcgagcaaagagccccttctttttgcgcaaacgacggcaaaacagttctctgggacagccggtggcgcggtaagcgggtgccacgctttcagggtgtgtaaaacagtcgcgggcgaagcagtagttgttgcagaaccgcaagaacccgacgcgaaagaagcccaggagtccgcgcgccagaaagtgcgcctgccgcgtctcgggatgcacgccgaagacggcgccgctctcgttcaccagtatggagatgtccaggcgctgctgtgactccaccggcacggcccgcaccacaaatacctgcagcacgttcagcgagcacgtctcttttaaccagttgccgtgggccggatcctcgtaagtctggctcccgttcaagacgaccgtcgtcagcgcctcattaccgtctcgccagctgaagatggaaccctcgcgcttcatgcacaggcgccacagggccagcaggtcgcgcgccaacatgaactcgcgacccacgtcgccgccggtctcgaagcggacatagcccagttcttcgcgcagcggcgcgtagttgcgcaggccctcctgcacgaagccgcggaaaccggaccgcgacaccaggtacagcgattccaccacgggcgagtagacgtagacgcggccgccctcgccgatgagtatgggtagcggtgggcggccgatggcttcgcaacgactcacagtgcccaccggcagcaggaacttgtcgcagcacaggaaggtcttctccaaacctttaatattgagatgtccaaagtagccaacgcgtaacaggtcgcagtaggtgaagaaccaaccgttcggccagttgagacgcagcaccgtgccactgacgcgacgaaccagcttctgcaggtccttgcgggcgtcggcggtgacagagcagcggaaggtctcgttgaccagctcgacagccagcgcgtcctccagcgtgcgttccttcatctcgtcgttaatgctctggcggcgccgccggatttcgtcgaaacgggccgcggaggcggcgaccgacgcggaggtcgtccgaacgccctctgtgacgctgtcgtccggccagtcaagaaagctaaggctggcgctgcgccgcctaaagtgtccgatccgcgcgggacgtcgctgaggaacggtggctggtctgctggggcgggtacggccgcgggtgtccgcggacacgttagttatacacgggattgagtcacgtggcacgttgccagctgaaaccgccgtcgtctccgccggcgttttctccatcgcgggaccgcgccgtgcgcgcaggccgcgtgcccgggcacgcgctctagccgcacttttgcttcttggtgttagggacgaactcgaacgttacagaatcctcgctgtcgctctcctctttcgcgtcgttgaagtaattgccggagttgcgatccaaaccgccgcctcctcctcctccgccgccgcccgatccacctttggacgtcaggtaactggtgatcttgtgctgctcgtatttttccttggaggaaagaccgtgatcgtgatcaccgccgccgccaccgctgctcattttccgcgtaccggaaccaccgccgccaccgcggtcgtgcttcttgccgccaccgccgccacctcctcccagaccgccgagacccatgggctcgttcatgagatcgttatccagacccgggccgtcgtcgtgcagaccgccggcattggccagcgaagagaggctgccgccaccaccgccgccgccacgcgacttgccgctgttcccgacgtaatttttgtcgaagggatcgccacgctggaaaggttcctcggtgagaaagttctccacggcgaacagaccgttgcggctggccacgtacaacagcgtgtcgtgctccgtaactatacgcagcgtgcacggtagtttggtgacggcgcaattgagcagcgtctggtagaagttcttcagctgcacgttgatacgcatgttttttacgccgtggaaactgacgcggttattggccgtgaattccagctcgctgccgttggtcaggatgaacttgatggccggcggaccggcgtgcaccagaatctgcacggtgcccgtagggcagggcgcttttttaacgttacgcttgacgcgggtatgcggcccgatccacttaagcaggtcggccaccacgccgaaatcgagatccacgtgcacggccgaattctcgctttcgcgcacaatgtcttgaccgtgcacgcaggccgagctgaactccatattgaaatcgggcgcgcacatggagatcttggccgacaggtccgagatgtcctgcacgtagaacttggtcaggtccttgctggaggtcaggtacataaaattgccgagcagcggcgtggaattgttaatggtcttgggctgaaacgacttgtcggtgatgtagaggcatgagctgttaaaagtgatttttgacacgcaatgactgcgtaccgtttgcaagataagcgacggcgtgggcaagaaggtaaccgtggtgttctccttgagcgcacggatcacagatcgcagctgctggatagccgtcttgtacggcttcagccgcagcgccagcgtcggtggctccgagaggcgcgtcttgcgatccatcccggacagcgtgcaagtctcgactaaggagcgggcgcgagcgagcgaaagttttatagagagcacacacgacgaccgggaacgctgcgaagacgcccggcgtctaataatacagccgcgccgagccagcgggcccccgactaagaggcacagtacttatatactccgaccttaaagcgccagtggtaccacttgagcatcctggccagaagcacgtcgggcgtcatccccgagtcatagtagaaaaccagggccacgcactggtccacaaacacgctcaggttcacggccgccatttccacgtcgttttggatcgccggcgccgcctggaacagacactgcgtcgccttgccctcctcctggtgctgctccaaccacgcgtaattcaccacgggcacgcgcagcggcctccgcaccacagtggggaagtaacactcacggttgggcgggcacaatgaccacaccgtctcctcctcgaacacggtgccgcgcgaagcccatactgacggcgtcacgccccacagatgcgccacctcgtcgtcgggacccaccgccagaaactgacagttgcgcaatccgaactcgagcatgtcggcgcgcagcgcttcccagcgcgcgctggcgatggagagccgcggcaaccgatacaattcgaaaatgaatttgccctcttgatagatggtgcgttcgaaccattcgcagcgtggcaaacccgacttgcacaaatcgacgctagcgcgcaccgcggcaaagtacatgtgctcaaagatgcgctcgatcaagtcccaagaggcaaagtacgtaaaccctaaccgcataagcgcagtgtgcaggccagccacgccgatgtgcagcggacgcagtttttccagcgcgctctctacccaccattcggacgccgacattagcgcgtccaagcgcgcgttgccccaaaccaccgcctcggtcaccaactcgcgcagcacgctcaaatcaaagtaacgtcgcgtgttccccaaaaccacgtcgggtagatgcagcttctgctcgtcgctacgcgcaaacacgcagcgagccacgttcaccgtcagccgctgcaccggcatgtcacactcgccaaagtggcacgacgccatatcgggactcaagcacggcggcaggcacacgctgtcggccataatcgagtacttgactacgtgatggacaaagaccaccgaggcacggcccttgagcgcgcacagcaacatctttttcagaaaatcgtccgtgttcacgaccaccttggggcacgattgctcgcagcgcgaatactctttctcgaaagccgactcctgacccagatccgagagccgccgggagacaggccgcccgaacagcgagtagcgctgctcacgcgcacggtagcgcttcattaacacgctaggcacgttgaaagcgtagcaaacccccgtcaactccgacgtgctttctttgagaataaagttaatcacgcggatagcggccacgtcccacatgtccacaaacacacgtaccacgggtcgatgcacctccttctcgcgtatcaaatcgcagtatccccccaggcaacgaatcacgctgttcacatcggcgttgagtcgcgttacgttcaccgacacagaaacgccgcaactcaaggtactcatccacttgcacatggccgcccaactggcgtcacgcgagaaagggtcggccgagatcagaaagtcgtactgcggcacgcgatcgaaacccacggtagacatggtgaaggtagacagcgacagctgcccatcgcgacagcgcttcaacaccgagtccaacacttcgccctcgaaacgcgcatccagatggaaacgatagatgcgcgagtgcctactgttctcgatagcggccgtcaacgccacggcgatgcgcaaaaacacgccgcccgggctctcgtcctgtccatgcagttggcgacacaccttatccaaacacaaaatagccgcgtacaagccccagcaaccggccaattccacaaaacgcgccgtctcctcggccagcttgggtagatcctccatgtgacgcagcacaaaacggcgcaccgactcatcgcacagctccgaagcgtaacacagtggcgtgcggctttcgcgcgcccagttggctttgaaataaaagcgacccaacagcagatcgcaacgcggcgagtgacgaatcagacagggaccgtggcgcatgatgagctgaaacagcctgaaactgcccaaaccggcactgtgtcgcgacacggtgtccatctcgcgccacagcgcgttcctgtcggacggcagctcccgcgccggctcctgtacgccacaaaagcgaaacttgccccagtagccgtgacaatgacactttttgcccatcaacatgcgcgtagcctgtatcggcggcgatactttgcagagtgaagccccgaaatcgtcctcctcctcgacactgtccagctccatcctggtcgcgccggccggattgaaggtgctcagaccgctactcacacgtccaccgcgactgggcacggcgggaccgctgtcacgcgtcaacgacagcacagacggcgtgccgtcgggagacggcgactcgggacgccaactgacgacgccgccaccactcgtaaaacccgctacacacgctacgccgctcgatacgttggtatttccagcggacgcttccttgtcacccccgggcagcggcccctcctcgagctcgctgtcatctcccccggtagtatcagcggcggcctctgccgacgattcctccgtctcggtttccgagccgcggcttggaatcctacctggccggcaccgatgtgcgggcaccgaggacacccgctgttcctcgtccgcgtcagccggattcataagtttacgaggaaaataacaaagaaatcaggtagatttcaataaagtgagtctagatggcgccgataactacggtttataaagtctgtgtgcgatgtgtttatttttttcttctgtgtctcctccccgtatgctgtcagcgccgctcagacgaattctcgaaagtctcccaattcgacgctaaagttgtccaaacggacgacggacagtttgagttctttgtgtaccaggaacgaggtgtgaatgtcgtcagccaggcaccagcccagcttttgtatgaccccggtacacagagggatctggcgcgggcgcgtgatgcgacggttgacaaagctacagcgctcgcgggcgaactttccgcgtgcaacgtcgaccagggtctgccagtgtgcgatgctggaggtgagcacgtagatgccgggacgtgtttcgggcccgtcatagtcatagacgatgattaaatacacgtattgcagccgtccccgggtctcttcccacgtcaggtacatgtctttcggtatcatcaacgcgaacacctccgttttgagcgtgttgtaaaggtagccgcgcatgacgcaggtgagcaacgaggtgatgcccagcgagacggtcttaacgcagcccagcgtctcaaggcggcggtgcagcagatgcgggcccaggtccagccactgcagcgcggcgcgcgcggccgaggccgtgtacacgctttcgagcaggcagcgcgtgctggccgagacgttggaggcgcgaatgcctaacaggtagaggctgatgtagaggtgtcgcggcgagtcgcaacccgtctccatgcggatgagcagcgcgcccggctgcgcctcgaactctaccaggccctcgggcacgaagaaacgcgccgtgagcgcctggtgatcggcgtggtagaggtagcgcaccgatatagtatttacctcgcgtttggctttgagcgccgtcactagttcattgtcctcgtcggccgggtcgcgcggccgtttggccaccgcgcgcgcgtccatgatggcgaggcgcacggtagatttcaaaaagttgatagagcagctgcgggcacgggccacggacaaagcggaggcgttaaataccgtgagccaattggagatcggcgcggtggatgcccaggacgtgaccgcgagcgccgtgcgcgccttcgtgggtgcgttgccgagctcgggctaccactttggcttcgtgcgtcagaacgtggtcttttacctcctaagccacgccacggtacagacggcgcgcgacccgctgtacgccgccgagcagttgcacgaacagctggaccgcttcctgcgacaccagcacgacggcggcggggacgaggaccggttgccgttctaccacaacggggccacgctgacggctttccagaagctgttgcagaccctgcgcgagatccagaccgtaatagccgaacagagcggcggcaccgcggcggcggcggacttgatcgccagtaacaacgcgtcggccgagcgccgcggcaagaagggcggttcgagttccgggggccagcagccgctggtccgccgggtgatcacgcagctggaaacggctgccacggaggcgcggccctacgtcaattgtcgcgccgtggccgaactcctggacctgacctaccagcggctcatctactgggcctgcacgctcatgccctacgtgttgtttcggcgcgacaccgacaccgaactggacacggtgcttctgatgcattttttttacacacgctaccgttcggttaacggcgatttggccgtggagtttcaaaactacgtcaagaacagcgtgcggcacatgagctctttcgtcagttccgatatcgacggcgaccagaagcccggtgccgaacacatgcgtgacgtcagctacaagctgttcgtgggtaatctgcaggcgcgtgacgccagcggcctcatgtttcccatcattagcacgcgcatctccaccgtgaacctttacctgtcgcccgaacgtatgtttttccacccgggtctgatctcgcgtctgttgagtgaggaagtttcgccgcgcgccaacctagacgcttacgcgcgcgtgtgcgatcgcgtgctggaagaccacttgcatacgccgcgacgcgtgcagcggctactggatctgacgcagatggtaacgcgactggtggaactgggtttcaatcacgatacctgcgcggcctacgcgcaaatggcgctgatccagccggccagtcagaagagctcgctctttgtcagcgagattcgcgagaaactcatacagatcatctacaatttttacacgtttttcatgtgcctctatgtgtacagccccacgttcctgttcgaccaccggcggcggttgattttggagcagcatcgatccacgttgatcggctccaaggaggaactacagcacgtctggagcaacgtgacactgaacgtcaatacgcactttgcggttcagtacacggaagaagactttgaggcacatacgaagggtgccacggaggcagagcgcgagtacctgtatcgggacctgcacagcaagtggggcgtgcacctgtttaccttgcgtccgtctcgcggcgcggccggcgcggcctcgcctttgcctccgcttgacggcgtcacacgctccgacatcttacgcgaatgcgcgctcgttaatctgaacgaaggccgcgtcaactacgcctccctgctagccttcagccatcatcccgagttccccagcatcttcgcgcagttggtggtggtaactgaattttcggagatctttggtatcccgcagggcctgtttcaagccgtgggttcgccgcgtcttttcgcgctcattcagctgtgtcgtgtattgttgcccgagcaggtgacgctgtaccagaacctggtctccatttacaacctgaccacctttgtcaagcacatcgacgccgcggtttttaagacggtacgcgattgcgtcttcgacatcgccacgaccctcgagcacctcagcggtgtacccgtcacgcccaatgtggacctgctggccgagctcatggcgcgctccgtagcgcataacctgtacaccaccgtcaacccgctgatcgaggacgtgatgcgcagcagcgccggcagtctgagaaactatctgcgacacacgcgactctgtttcggtctggcgcgcggccgggcgcgcctctcggaggacggcgtgacggtgtacgtggaggtacagggtcagtacggactgcgcgtacctaccacgcgtttcgtagaacagttgcgcgaactggttcgccgcgatcggctgttggccgagaatctgcgcggcttaaacgagcgcctgctgagtgttcgcgtgcgcgtacgtcagatcagcagcgacacagaggaagtaagccgacacgccaagggtcaccgcacggtggcccagatgagcaaggcgctcaaaaagacggcctccaaaatcaaagtgttggaaacacgcgtgacattggcgctcgagcaggcgcaacgttccaatggcgccgtcgttaccgcggtgcaacgcgcgctagccgtctttgacgtactaagtcgcgagaacttggaacgccgcggcgcacagctctgtctgacggaagcgacgagcctactgcaccgacatcgcgcgctagcgccgatgacctggcccgcgggcacgggcgttgcggcggcggccgaagcggatcgcgccttacgcgagttcttggaggcgccctgggaatcggcgccccaaccgccgcgactccgcatgacgcccgacaccgatcacgaagaatcgacggcaggcgcgacgtccgtaccggaggtcctgggtgcgcgctacgaacccgcacacctggccgcgagcgacctattaaactggtacatcgtccccgtaagccaggcgcagcaggacatcttgtcttcgatcgacccgcccgccggctcgacatcggtgtccctgccgccggcctcgccatgaaagtcacgcaggccagctgccaccagggcgacatcgctcgctttggagcgcgagcgggcaatcaatgcgtctgcaacggcatcatgttcctacacgccttgcacctgggtggaacgagcgccgtcctgcagaccgaggcgctggacgccatcatggaagagggcgcgcgtctggacgcgcggctagagcgcgagttgcaaaagaagctgcccgccggcgggcggctgccggtctaccgactgggcgacgaagtgccgcgccgcctggagtcgcggttcggccggaccgtgcacgcgctctcgcggcccttcaacggcaccaccgagacgtgcgacctggacggctacatgtgtccgggcatcttcgactttctgcggtacgcgcacgccaaaccgcgtcccacctacgtactcgtcaccgtcaactcgttggcgcgcgccgtggtcttcaccgaggaccacatgttggtctttgatccgcacagctccgcggaatgtcacaacgccgccgtgtatcactgcgagggtctccatcaggtgctgatggtgctcacgggcttcggcgtgcagctatcgcccgctttctactatgaggccctttttctctacatgctggatgtggcgaccgtgccagaggctgagatcgccgcacgtttggtctccacctatcgcgaccgcgatatcgacctcaccggcgtcgtccgagaaagcgcggacacggcggcgacaacgaccaccgccgcaccttccttacctccgctgcccgaccccatcgtcgacccgggctgccctcctggcgtggcgcccagcattcccgtctacgatccctcgtcctcacccaaaaaaacacccgagaaacgccgcaaggacctcagcggtagcaaacacggaggcaaaaagaaacccccgtccacgacgtccaaaacactggccaccgcctcctcctcctcagcgatagcggcggcctcttcttcgtccgcggtaccaccgtcctacagctgcggcgaaggggccctgccggccctgggccgctaccaacagctggtcgacgaggtagagcaggagttgaaggctctgacgctgccgccgttgcctgccaacaccagcgcctggacgttgcacgcggcgggtaccgaaagcggcgctaacgcggcaacggccacggcgccgtccttcgacgaagctttcctcaccgatcgtctccagcagctcatcatccatgccgtcaatcagcgctcgtgtctgcgccgcccctgcggtccgcaatcggcggcgcagcaggcggtacgcgcctatctgggcctatccaagaaattggatgcctttctgctcaactggctgcaccacggcctggatctgcggcgcatgcacgactacctgagccacaagaccaccaaaggcacgtactcgacgctggatcgcgcactgctggagaagatgcaagtcgtcttcgatccctacggacgtcagcacggcccggcgctcatcgcctgggtggaggagatgctacgctacgtggaaagcaagcccactaacgaactgtctcaacgactgcaacgtttcgtaaccaagcgaccgatgcccgttagcgacagcttcgtctgcctgcgacccgtagactttcagcgtctgacgcaggtcatcgaacagcgacgtcgggtgttgcaacgtcaacgcgaggagtaccacggcgtttacgagcacttggccggcctcatcaccagcatcgacattcacgacctagacgccagcgatctgaaccgacgcgaaattctgaaagcgctgcagccgttggacgacaacgccaagcaggaactctttcgcctgggcaacgccaaaatgctagagttgcagatggacctggaccgtctgagcacgcagctgctaacgcgcgtgcacaatcacatcctcaacggctttttgccggtagaggacctgaagcagatggaacgcgtcgtcgagcaggtactgagactcttttacgacctgcgcgacctgaaactgtgtgacggcagctacgaagagggatttgtcgtcatacgcgaacaactgagctacctcatgacgggcactgtgcgcgacaacgtaccgctactgcaagagatcctgcagctgcgacacgcgtaccagcaagccacgcagcaaaacgagggtcgcctcacgcagattcacgacctgcttcatgtcatcgagacgctggtgcgcgacccgggcagccgcggctcggcgctgacactggccttggtacaggagcagctagctcagctggaagcgctaggcggcctgcagctacccgaagtgcagcagcgcctacagaacgcgcaactcgcgctaagccgcctctacgaagaggaagaggaaacgcagcgtttcctcgacggactctcgtacgacgatccgcccaccgaacagaccatcaagcgacacccacaattacgcgagatgttacgtcgcgacgaacagacgcgtctgcgactcatcaacgccgtactgagcatgttccacacattagtgatgcgactggcgcgcgacgagtcgccgcgaccgacgttttttgacgccgtcagtttgttgttgcagcaactgccacccgactcgcatgaacgtgaggatctgcgtgccgccaacgccacgtacgcgcagatggtcaagaaactggagcagatcgagaaagccggtaccggcgcatccgaaaaacgcttccaagcgttacgggagttggtttactttttccgtaatcatgaatatttctttcaacatatggtcggacgactgggcgtcggacctcaggtaacggaactctacgagcgatatcaacacgagatggaagaacagcacctggaacggctggaacgtgaatggcaagaagaggccggcaagctcacggtaacttctgtggaggacgtgcagcgtgtcttggcccgggcaccgagccatcgtgtcatgcatcaaatgcaacaaacgttaaccaccaagatgcaagactttttagacaaggagaaacgtaaacaggaagaacagcaacggcagctactggacggctaccaaaaaaaggtgcagcaggatttgcaacgcgtggtggacgccgttaagggcgagatgctctccaccatcccgcaccaaccactggaggccacactcgagctgctcttgggcctagatcaacgcgcccaaccgctactagacaagttcaaccaggacttgctgtcggcgctgcagcagctgagcaaaaaactagacgggcgaatcaacgagtgtctgcacggcgtgctgacgggtgatgtagagcggcgctgtcacccgcaccgagaagcggctatgcaaacccaagcctcgctaaaccacttggaccaaattttgggtccgcaacttctgatccatgagacgcagcaggccctgcaacacgccgtccatcaagcgcagttcatcgagaagtgtcaacagggcgatccaactacagccatcacgggcagcgagttcgagggcgactttgcacgctaccgcagcagtcaacagaagatggaggaacaattacaagagactagacaacagatgaccgagactagcgagcggctagatcgctcgctgcgccaggatcccgggagcagctccgtcacgcgtgtacccgagaaacccttcaagggtcaggagctggcgggtcggatcacgcccccgcccgccgacttccagcggcccgttttcaaaacgctgctagatcagcaggccgacgcggcccggaaagcgctcagcgacgaggccgatctgctgaatcagaaagtacagacgcagttgcgacaacgcgacgagcagctgagcacggcgcagaacctgtggactgatctggtcacgcgccacaaaatgagcggcggactggacgtgaccacccccgacgccaaggcgctgatggaaaagccgctggagacacttcgcgagctgttgggcaaagccacgcaacaactgccgtacctgtcggcggagcgcacggtgcgctggatgctggcttttctggaggaagcccttgcgcaaatcaccacggaccctacgcacccgcatcacggaagcaggacccactaccggaacctgcaacagcaagccgtcgagagcgccgtgacgctagcgcatcaaatcgaacaaaacgcggcctgtgaaaattttattgcacagcatcaagaggcgactgccaacggcgcgtccacgccgcgggtcgacatggtccaggcggtggaagcgatctggcagcgactggaacccggacgcgtagccggcggcgccgcgcgtcatcaaaaagtgcaggaactgttgcagcgcttgggtcagacgctaggcgacctagaactgcaggaaacgttggcgacggaatactttgcgctgttacacggcatccagaccttcagctacgggctggactttcggtcgcagttggaaaagatccgcgatctgcggactcgttttgcggaactggccaagcgacgcggtacacgtctctccaacgagggagccctgcccaacccacggaaaccgcaggcgacgacttcgctgggcgcctttacacgcgggttgaacgcactggaacgacacgtccagctgggtcaccagtatctgctcaacaagctcaacggctcatcgctagtctataggctggaagacattcctagcgtgcttccgccaacacacgagaccgaccccgcgctgataatgcgcgaccgcctgcgtcgtctatgcttcgcgcgtcaccacgacaccttccttgaagtggtagacgtcttcggcatgcggcaaatcgtcacgcaggccggcgaacccattcacctggtcaccgattatggcaacgtagcctttaagtacttggcgctgcgagacgatggccggcccctggcatggcggcgccgctgtagcggcggaggactcaagaacgtcgtcaccacacgttataaagccatcacggtagccgtggccgtctgtcagacattgcgcactttctggccacagatctcgcagtacgacctacgaccctacctcacgcagcatcagagccacacgcaccccgcagagactcacacgttgcataaccttaagctcttttgttatctggtgagcaccgcctggcaccagcgcatcgacacgcagcaggagctgacggccgccgatcacgtaggcagcggcgagggtggtgacgtaggggaacagagaccgggccgcggtaccgtgctgcgcctgagtctgcaagagttttgtgtactcatagcagctctgtaccccgagtacatctacaccgtcctcaaatacccggtgcagatgtcactaccctccctcacaactcacctacatcaggatgtgatacacgcggtagtcaataacacacacaaaatgccccccgaccaccttcccgaacaggtcaaggccttctgtatcacccccacccaatggcccgccatgcagctcaataaactgttttgggaaaataaactggtacagcaactgtgccaggtaggcccgcaaaaaagcacaccgcctttaggcaagctatggctctacgccatggccacgctggtctttccacaagacatgctgcagtgtctgtggctagaactgaaaccccagtacgccgagacatacgcctcggtgtccgaattggtacagacattgtttcagattttcacgcaacaatgcgaaatggtgaccgaggggtacacgcaaccgcagctccccaccggagagccggtgcttcagatgatccgcgtgcgacgtcaggacacaaccaccacagacacaaacacgaccacggagccgggacttttagatgtttttattcaaacagaaaccgccctagactacgcgctgggctcctggcttttcggcatacccgtgtgtctcggcgtgcatgtagccgacctgctgaaaggccaacgtatactagtagcgcgccacctcgaatacacgtcgcgagaccgcgacttcctccgcatccaacgctcccgggatctcaatctcagtcaactgctccaggacacgtggaccgaaacgccgctggagcactgctggctacaagcccaaatcagacggctacgcgattacctgcgtttccccacccgcttagagtttattcccctagtcatttacaacgcacaggaccacaccgtcgtacgcgtgctgcgaccgccctccacgttcgaacaggaccacagtcggctggtgttggacgaggccttccccaccttcccgctgtatgaccaagatgataactcatccgcggacaacgtcgctgcgtctggcgccgctccaacaccgccggtacctttcaaccgcgtgccagtcaatattcagtttctgcgtgaaaacccgccacccatcgcgcgagttcagcagccgccgcgccgacatcgtcatcgagcggccgcggccgcagacgacgacggacagatagatcacgtacaagacgatacatcaaggacagccgactctgcattagtctctaccgcctttggcgggtccgtctttcaagaaaaccgattgggagaaacaccactatgccgagatgaacttgtggccgtggcgcccggcgccgccagcaccagtttcgcctcgccgcctatcacggtgctcacgcagaacgtcctcagtgctctagaaatactgcggctagtgcgattggacctgcgacaactggcgcaatccgtacaggacactattcaacacatgcggtttctctatcttttgtaaccgacactgacagtagcgggtaataaaaacaataggctttttatcgttttttatgttacaaaacaacgtatcacttttacggtgatttattcttgctattctttttccccttgggctgtcagcgccgggtgcgcgacacggctaccatgcgcaacaggtccagcttaaaggcgcacttgtcattaaacaggctggacatgcgcgtgtacttgctcagcatggtggccaacaccgggtgggtggcctctgatatctcggtcggcagctccaaaacgacgttgacgacgtgacggtgtttttcgtcccgcttgttggccaccgtgggtcccggcgcggtgttagacatggggcaggccgtggggggaggacgaagaggaagccgctgctaaaccgccgcgcgcctgctgcacaatgtggccgccgacgtggcaggcggtctgtttaaccagcgcgcagccccgacacagcggggcgccgtcttcgctttccaaacagctgtcgcggtactcgcccgtctgacagcgcgcgcacagcaggccgtgcccgtgcgaagtgaggcgcaggagacgcgggaccgtcacgccgcgtaccaccacagtggagtcgcaggtgcgtgccgcgcagggcagaatgacgtcgaaagccagccggtgatcgtacacggcacaagccgcgttgaggcccagcacggctttccagcccacgcgtacgcagcgctgtccaaagagcgtctcggagacgagctcgtagacgcgctgccgcaccacccgctgactgccgcagagcgagcagtgcacgagctcggcgtgcgtgttgaagatgacgctcttttcttgacggtcccgataatagaacatcgagttgagcggaaagttttgctggcagtgtagcttttccttacccaggttgaggcagtgtccgcactgccgacagaccacggccaccagcgagcgcgcgtccagatggcgctcgcacttgagtcgacacagacaccagagcggcaggtcgatgacgctgccgatgaggccgccgcgcagcgcggcgctgagtgcaaagaggacgatcttggtgggctctacgtgacgcgcctgctgtccggcgcccgcgtgtcctaccgccgcagctgccgccgtcgagcctcctccgcgcgtctcgtcgtgcagacccagtgcccgcaacggcaccaggtatcgcggacacgtgtcgcaaaacgtctgcaccgcttgtcgggccagtacgtagagcgggtttccgcagggtaccttcccggcgtgccggcgcaaggctgcgatgaggccccgcagctgcggcgaccgcggctgccgttggtgacaccactggttacggtggtatacggccaaatcagcgcgggcgtcgaagcgcttggcgcgtagtagtgctaggcacggcgagctggtggggtgaagcacgggcagccgaaggtccaccccgaaaaggaaacggtgaaggtcacctagcagcgaggaggtgacaccgtccaacaacgcgtgcagccgctcgggcgggtagagccgcagacggcgcagcaggtagtcggtgtcgtagcgttcgaaacgcagaaaggccatcgtgcggacggccacggtgtgcagacagtccatgctgtagacgtaagcgagaaacacaaagtagggcttggtcataaccatacgctgaaaaagcgccgtcaccgcctcccgctcggcctgccgacacaccagccattcgcgcaggaagcgttggtagagacggtcgcccagctcgcgattcagaaagcgcttatccgtcacgaagagatgaaggacgcaagaacgtggcacgtgatgcaccagctgctgctggaggaccgccgacgtctgcgccgcaaactgcgccggtggctgcgacgtttctaccgccgcttcctccggctgcagcgcaccgcggccgatcaccagctgcacatggaaatggtcctcgtgaacgcagaggggcgcgaagagacggcgcagagcctggtggaactcctcagtcgcggtgtgcggagcgtgtcggagacggcgattggccatgaccgcgccacagcagagccagcaccagcaggagagccagcaccagcgggcccagagtcgcgaagcgcgcgggcagccacggcccagactgcggtcgcgatggcccggagcgcgctcgccaccacgatgacggtgcccaacgataaccagtccgctccaaggacggcgcgcacggcggagacggcggatgacggtgatgggtcgacacccctcgccgacgactcacgtgctcctccagaggccgacgcgcggaccctccgacatcctggcccgccgctgccgctgccgccttcccttctcccgccagagccagcaactcctcctcctcttcatcagcgtctccctcgcttgcgcatccgcatcgtcccatacaggcctcacaacgacacagccgccacgaccccgccgccatgggtggcggcggcggccgaggcccggcagcggcgccgccagcggcgaccatggtgggagagcaactcggatgacgaggaggaggaggagggggagatgcggtccgagaggaccgctttcccgccgttcgcgtgagcgcggccgacatgcgggcgcgccacagggacggaccgctgccgctgtgactgcttacggtgacgtggttccggaccgccaacgacgtcgacgcggctttcttggcgtacagctcgcgcagcagattctcgtactcgccctcgttttcgggtccgaaggcgatgagctcgatgttgaagaccgacgccgaattggatttgcgcaccacgcacttcgtcagcactccgtaggccgagggcttgatctcctcgatgtccttgagcgtgacgatgagcgactcgttcaccttaagcacattgaactcacctacgtggcgcgccggcgagacgagcttgacgggcgctcgcacaaaacagcagagggagacggcacagccagtgtttttaaagataaaacaaggcacgtggtctgtgcggctctcccagtagctgagcagatactcgacacaatagaccgtgtctgtcttgagcatggcgtcgcacaccgagtaattggggtttttacagatgaggccggcgtcggtgacgcgcagctcgctgggacccaacttgaggatacgccgcgtggcctgcaccagatcctgatggagaaccttgttcatctccatcgcaccgacgccaccgccgatttatttacccggcgccggctcgtcttttccctccaggattccgttaatgtccatgagcttgctgacgatcgccgttaatagttgcgtcttctcacggaggatctctccgtgactgcaggtcgcgcagtcgccgtgcacgtacttgaggaaggcggcgtacttctgacccgcgttcacgaaatttaagcgcgcgtccagagagggcagcaacagatcgtagacgcgcggcagcatcggctcgaactgtaatagcagatcgtcgtcaagatcgggtagcgcgtgcccgtcttcaccgtcctcgtcgtcaccacctcccccctcgagcccaccgctcgtaccagccgcgggctccgcgtcctcgtcgatcaccagcggtcgcgtcggcaccggagaatccacgtcatcctgcacgtcgttttcctcctctccgtcgtcatcgtccagaaacggcacccgctgcttagcccaggacattctttttccgcgtcctcaatcagcggcgccgatcgccatgaatccgagtacccacgtgagcagtaacggcccaacgactccccctcacgggccccacaccacgtttcttcccccgaccagcccggccccgtccaccagctccgtcgccgccgctaccttgtgcagtccgcaacgacaggccgtttcacgttacagcggctggagcaccgagtacacccagtggcactcggacttgacaactgagctgctatggcacgcgcacccacgtcaagtacctatggacgaagcgctggccgccgcggcggccgcctcataccaggtgaatcctcaacaccccgccaaccgttaccgtcattacgaattccagacgctcagtctcggcacctcggaggtagacgaactgctcaactgctgtgcggaagaaaccacgtgcggcggcacgcaatccaccgtactcaccaatgcgaccaacaccactaactgcggcggagccgtcgccggcagtagcaacgcaggacccgccggcgcttcggccgcctgcgacctagatgcagaactggccggcctcgaaacctcggcggccgactttgaacaactgcggcgactgtgcgcgccgctggccatcgacacacgctgtaacctatgcgccatcatcagcatctgcctcaaacaagactgcgaccagagctggctcctcgagtacagcttgctgtgcttcaaatgcagttacgcgccccgtgcggcgctcagcacgctcatcatcatgtccgagtttacgcatctgctgcagcagcacttttccgatctgcgcatcgacgacctgttccgacaccacgttctcacggtcttcgatttccacctgcacttcttcataaatcgttgctttgaaaaacaagtgggcgacgcggttgataacgagaatgtcaccctgaaccatctggccgtggtgcgggccatggtcatgggcgaagacacggtgccttacaacaagcctcggcgccacccgcaacagaagcaaaaaaccaacccttatcacgtcgaagtgccgcaagaactgatcgacaactttctagaacacagctcacctagccgcgaccgcttcgtgcagctgcttttctatatgtgggccggcaccggcgtcatgagcaccacgccactcacggaactcacgcacactaagttcgcgcgactagacgcgttatccacgacctcggaaagagaagacgcaaggatgatgatggaagaagaggaagatgaagaaggaggagaaaaaggaggagacgatccgggccgtcacaacggcggtggcaccagcggggggttcagcgagagcacgctaaaaaagaacgtgggtcccatttacctatgtcccgtacccgccttttttaccaagaaccaaaccagtaccgtgtgtctgctgtgcgaactcatggcctgctcctattacgataacgtcgtcctgcgcgaactgtaccgtcgcgtcgtctcgtactgtcagaacaatgtgaagatggtggaccgcattcagctggtattggccgacctgttgcgcgaatgcacgtcgccgctcggcgcggcgcacgaggacgtggcgcgctgtggactcgaagcgcccacctcgcccggaggcgactcggactatcacggcctgagcggcgtcgacggcgcactggcgcgacccgacccggtattttgccacgtcctgcgtcaagcgggcgtcacgggcatctacaagcactttttctgtgacccgcagtgcgccggcaacatccgcgtcaccaacgaggccgtgctcttcggacgcctgcacccccaccacgtccaggaggtgaaactggccatctgtcacgacaattactatataagtcgacttccgcgacgtgtgtggctctgcatcacactcttcaaggcctttcagattacaaaacgcacctacaaaggcaaagtgcacctggcggactttatgcgcgatttcacgcagctgttggagagttgcgacatcaagctggtggaccccacgtacgtgatagacaagtatgtctagcgtgagcggcgtgcgcacgccgcgcgaacgacgctcagccttgcgctccctgctccgcaagcgccgccaacgcgagctggccagtaaagtggcgtcaacggtgaacggcgctacgtcggccaacaaccacggcgaaccgccgtcgccggccgacgcgcgcccgcgcctcacgctgcacgacctgcacgacatcttccgcgagcaccccgaactggagctcaagtacctcaacatgatgaagatggccattacgggcaaagagtccatctgcttacccttcaatttccactcgcaccggcagcacacctgcctcgacatctcgccgtacggcaacgagcaggtctcgcgcatcgcctgcacctcgtgcgaggacaaccgcatcctgcccaccgcctccgacgccatggtggccttcatcaatcagacgtccaacatcatgaaaaatagaaacttttattacgggttctgtaagagcagcgagctactcaagctctccaccaaccagccgcccatcttccaaatttattacctgctgcacgccgctaaccacgacatcgtgccctttatgcacgccgaggacggccggttgcacatgcacgtcatcttcgaaaaccccgacgtgcacatcccctgcgactgcatcacgcagatgctcacggcggcgcgcgaagactacagcgtcacgctcaacatcgtgcgcgaccacgtcgttatcagcgtgctgtgtcacgccgtctcggccagcagcgtcaagatcgacgtgactattttgcaacgcaagattgacgagatggacattcccaacgacgtgagcgagtcctttgagcgctacaaagagctcattcaggagctgtgtcagtccagcggcagcaacctatacgaggaggccacgtcgtcctacgcgatacggtctcccttaaccgcgtcgccgttgcacgtaacttccaccaacggctgcggcccctcctcctcgtcccagtccacgccgcctcatctccatccgccgtcgcaggcgacgcagccccaccactactctcaccaccagcctcagtctcagcagcattatcaccgtccccagtcaccaccgccgccgctgtttctcaacagcattcgtgcgccttgacactgtacggcagaaaagccggctccaagtgcaagcgccgcggcagcaccatgtgcaaaaacttgtccttgcgcgcggtttcgccgccgggaaagacgggcgacagcacgttggttacagccttgagaacctgctcaaagtacttgtcggcgtgaatgggcacgccgtgctcgcgcacgtagctcggatcttcggctacctcgtagttgcacacggccgacggtggtttccgcgccctcttctttggcggctctcctcctctcctgttgctctcctctaccccgccgccgtcagcgtcgtcgtccgtgccatcaatcgcgtccgaccgggaaaccacgccggtggttacagaatcaccgttgtcagaggaaccctgcggcgccgtccggacaccgggcgccgtcagtacgtaaaagacccgatccccgaccgagggtagctcctcagaacgggccgccagtcgcttaatgacggcaatgtgcggcaggttagattgacggtacaacgagatgtccttagaaagcaccgacgaaagcaccaggtcctcgacacgcacacggtgcaggtacagatcgtcgcgggcctgcaccaggcggcgcaagatacgccagaaaccgcgtggcacgccgtatttcttgacttcatcgagtgagaggcgcgacaggcgcacggctgcttccgagacctcgcgatcctcaaagagcagcgagaggacgtcacgcgtaacgcccttgacgaactcgcaagccgtcttgcgcaccagatccacgcccttcatgctcagacccgaggcgccctccactttgccgatgtaacgtttcttgcagatcatcataagagagacgaagaccttttcaaactccagcttgacgggctccacaaaaagacaggccgtcacgtagtgcgccaggctgggcccacgcgccaccagagcctgcggcgtcagaccacgaaagcggacaaacacgctgtccgtgtccccgtagatgacccgcgcctccacccgccgttcgtccgagccccctgacgatgtttcgagcccctccggtaacgtgctgctctcctccgaatccccctcccgcgttcccaccacataatcttcttgattaaaaaaattgtgcaaaaaacacggctctgaaaagttgtctttgatgaaccgcgccgtgcgctctagcatgtcgcgaccgatgcgcgtgatgctggcggcgatgggcagacacggcatcatgccgttgaccacgccggtaaaaccgtagaaagcgttgcacgttactttgagcgccatctgttccttgtcgagcaacatacgacgcacagggtcttgacactcgcgcatgcattcgcgcacggcacgccgctgcgaaacccacttgttgagcagttccgaaagcaccgagacgcgcaccgaagcgcgcacaaagcggtgggtcacgccgttctctagcgtgacgctgtatacgtcggcagggtccacggggtactcgccacccggcaccaacagggtggagtagcagaggttgtgggccatgatgatggaagggtagaggctggcaaaatcgaacacggccacggggtcgttgtagtaacccacctcgggctcaaacaccgtggcaccttggtacgaaaccgccgcggtaccgccggcgccgtgactgtcgttggaaacgccgacgccgccactactgccggagccgacgctgaaaacgccgacgctgctactactgttactaccagagccgggtgaaacgccgtcctgactcgacggcgcagattgcaagggcggcgacatctgaaacatagccgccacagaacccgcgtcgccgggcacggcggcggtagagatgatagcggcgttaggtgacacggcaacgctattcgtttcgggcaccgtcgtacctttgctgtagtggttgggcaagataaaatcgcggcaggcgcactcgtctagcagcgaggtgtagatacggatctgctgtccgtcaaagatgacacgccgcaacggaattttagccagccgcgcgatggccccggcctcgtagtgaaaattaatggtgttgaacagatcgcgcaccaatacggcgtcctgcagacagtaacggcctacctgggcgcggccctcggcattagccacgaaacaacgcgggatgtccttgtaggacaggtcatccttgcgttgccgcaggtaaagctcggccatagtgttgagcttatagttgggcgagttagtcttggccatgcatacggggtacatgtcgataaccaccgaacccgcaatatacaccttggtggcggccgtgctggccggattattgtgagaagccgagggaaaggcggcggcgtactgccgcttaaaacccacggcggggctgtgtaaaaaaaaacggccgccctgcgccgtgggcaacttgcagaagcgctgcgagtccaccttatacaggtactcgaggcgcgtgaggatgtacttcaagtcaaaagagttgatgttgtaaccggtcacaaaggccggcgcgtaccgttgaaagaaaagcataaagcccagcagcagctcgtattcggaagggaactcgtagacgtctacgtctgggcccacctgcccgcaggtgccgatcgtaaagagatgaagacccgagtgcccaaagatcacgccctccgaggtgcagccccgaccatcgttcccgtttgggattccctgatccacggcggtgtttcctcccgtctcgtagcacacgcacgagatctgaatgacaatgtcatcagacttctcggcgcagggaaaaccaccctcgccgctcatgcactcgatatcgaaggacaggcaccgataacgcggccacgagctgtcgtcgggcacggccaccaggtcggagacatcgcagtcgacctcgatatcacaagtcgacgcgcgaccctgctgccgccagtcgtaacgattcacggaacaccagccgaacgtggtgatccgccgatcgatgaccaaacgcgtcagcggatccacacggacctcgtacacgggaaaaccctgctccagcagatactcgccgatctttctagccatggtccagttgctgatagacacacactgcaaatcgggcacgggtcgcgtcccgtacccgtagatggaggtcttggtggccggcgtgacagacacggcgtatggcgtccgcggttcgggcactagttcgcccacgctggcaatgacctcacgcagcctatcggtgtcgctgtactcacagtaaaagtagctgcgctgcccgaaaacgttgacgcagatactgtagccgtgttctgtggccccgaagaaacgcaacacgttccccgaaggcaccagatgctgacgatagcgcggcgacacgttttcgggcgagtcgaagaagagcacggcgtccgtttgatcgtaggtgtgaaaacgaataggtcccaccacgcgacccaccagggtctcgcgccaaggacacggccaaaccatgtcatgactcaacaaatgtttaatctctcgatagaacatgagaggcaaccgtcccgtcttatgcttgatcaaccccgtctgaccgtcgaacatgacgcctcgcggcacgatctgcaaaaactgtttctgtggcggccgcttgcccgagccctgcgcggagccgggctgcgaacgctgacgccggccacccgcaaccgcaccgccggtcacgccgccgctcagatacgggttgaaaaacatagcggaccgtgagaggctgacagcttacgaagcaaaatcacaaagcaaatacacatgcagcacctagatgtccagtttaaccccgtatatcacaagtctctgtcactttttttgtctagtttttttttctcctcttggttcagacgttctcttcttcgtcggagtctttcaagtgtcggtagccgtttttgcggtgtcgcagtcggtctagcaggttgggcttctgtcccttgtcctgcgtgccagtctgtccgtccaaagaatctgtaccgttctgctgcgctcgctgctctgcgtccagacggaccagggccagaagcatctggtaagcctgctcgttggtgtaaggcggagccgccgtggatgcatcagacgacggtggtcccggtcctttgcgaccagaattataaacactttcctcgtaggaaggcggagcctgtaacgacgtgtctttggtgttgcccgacgtcacggtggtcccgtcggcggacaccagatagggaaagaggttctgcagcggctgcatgcagagacgccgctgtcgagtatagatcaaataaatgataatgacgacggctatggccacgaggatgatggtgaaggctccgaaggggtttttgaggaaggtggcaacgccttcgaccacggaggccaccgcgccacccacggccccaatggctacgccaacggcctttcccgcggcgcccaggccgctcatgaggtcgtccagacccttgaggtagggcggcagcgggtcgactaccttgtcctccacgtactttacccgctgcttatacgaattgaactcgcgcatgatctcctcgagatcaaaaacgttgctggaacgcaattctttctgcgagtaaagttccagtaccctgaagtcggtgttttccagcgggtcgatgtctagggcgatcatgctgtcgacggtggagatgctgctgaggtcaatcatgcgtttgaagaggtagtccacgtactcgtaggccgagttgccggcgatgaagatcttgaggctgggaagctgacattcctcagtgcggtggttgcccaacaggatttcgttatcctcgcccagttgaccgtactgcacgtacgagctgttggcgaaattaaagatgaccactggtcgtgagtagcagcgtcctggcgattccttcacattcatatcacgcagcaccttgacgctggtttggttaatggtcacgcagctggccagacccaggacatcacccatgaaacgcgcggcaatcggtttgttgtagatggccgagagaatagctgacgggttgatcttgctaagttccttgaagacctctagggtgcgccgttgatccacacaccaggcttctgcgatttgcgccagcgcccggttgatgtaaccgcgcaacgtgtcataggtgaactgcagctgggcgtagaccagattgtgcaccgactccatgttggataaatgagttgcattgttgccatctgtacttcttttggttctattatgagtaagattcagactggagcggttggccaaacgttcgagttccaccagagatttttgcttgataccttgccagaacaccaccaaaccaccagtggtttcaaagacggacacgtttccatatttttcatatgtttgattgtatgaagtattgaaaatctgctgtaacttatttatggcctcatcacgtacacagtccagcgcagagtcggacatgttcacctcttgcttcttagataagaaagtggcggtcattttggcagaagaaaagtgatacgagtcctcggcttcggaacgaatggtgcgttccgaggcttcccagaaagtgagttgacaagtaacattcttctcgtcctgtatatcccaggagatcactgagtccgcacgttcaagaaaagccaccaacctgtgggtctctaacgcagaattcggtcttccaaagtcggagacgatagtgtagttcggaaaaatgaaaaacttgtcggcgttttctccaaaatagctggcattgcgattagttccgttgtagaaaggagaaatgtcaaccacatcacccgtggaagttgcgaaaaaatgatagggatacttggagcgcgcagtagtgatggtcaccatacaattcagattacaggtctcacgatagagccaggtgctgccgcggctgtgccattgatccttgaccgtcacgtaacgggtactgtgggtgttggaataatcgtcgggcattaattgcatggttttgttttcatagctgtccctatgataagccacgaaaaccgtgcctgctataacgcggctgtaggaactgtagcactgactgtgactgttgatatgatgaatctcccacataggaggcgccacgtattccgtgttgctgcccagcagataagtggtgtggatgtaagcgtagctacgacgaaacgtcaaaaccttctggtagactcgtaccttaaaggtgtgcgcgacgatgttgcgtttgtagaccaccatgatgccctcgtccaggtcttcattgatgggcttcatcgaggtgcagacgatattacgttcaaagcgaataagatccgtaccctgtgccatagaacacacgcgataggggtacttggtggtgttgacccccaccacatctccgtacttgagggtagtgttgtagatggtctcgttaacaccatggctgaccgtttgggaagaagttacgcgttgagagactgaaccggatcgagaatgagcagcagacgtcgtatgagaggaatggtgactgtgagtagcagaagttccacgagtagaagatgaggaaaccgcagcacccagacagacgatacacaagttaacgcagactaccaggcaccagatcctggattccatgttcgtcgcgggccaaatccagcagcgatgaggcgcgtcgtggtctcttgcgtgttgcgcggaccctccgggaaacgcccgcggtcgaggaggaggggtacggacttggcagccaaggtcggtccggctccctgaaggcacccgagacggccgcggcggccgtcagggtggagggcttggccgcgggagctgttggcacgtcgccactctcatccggtctggacagatgcctgtagaggaggagatatagatctttggacttataaagacttccttcgtgacgaagcagcagcggccactctttgttatacgtgagaatcacatctctgtccgggtgcagttcgtcgcgcaggcacgcgatcgagagttgtttcccgaaagtttcattatatagtgcgacggagagcacgagctcccgcacgtgcatccacatctccttctgcagcacgtttagatcctgacagtccgaaaaattgaaaaaacccatgtacttcaccaccatccactcactgggatacacggtaccttccgcgcatttgaccaaatcgtccttgacgtggggtagtacgcccgcgttgtcgcaggcataggccatgtccacattgtgagagaggggatagcgatcggtgcagtgtgtgaagaggggcccgttacacaactcgtagatctgctgacccagtagcgggagggattccacaggcagactcttgtggatcaggttattgaccacatacaggtgctcatcgtacgtgaactgatcccccacgtccaccacgtcttggtcctggtggtattggctgcggtatagaaacccattcatgagcttagagataaagtccagacacaagggccccactaggttgacatcgatgagtttgctagtcagacgctcctgcgttttgatgcaacggatcaccttgccatagcccacctccgaaaccttctgcaggtaggcgcgtttgcgcacgttcacctcgcgggtgacgttgtggatgcgggaacgcgcgtccaccaagtcgagagcctcgtgttcgtcgcagttgcgcacccgtaagccgttctcgctgccgtcgccgtcctgcccattcgcccctccccctaccgctttcttgcctcctccacgggcccggccgccgccaccgttattcctctgactgtgagtactgctgttgctgctgttgctggccgtcatcaaagtcgtacccgtccccgacatcgcctcccgtccacgcaggtgaatagcctcgccctcggggccgtcgccccccgtgccatcgggcagcggacgtcgaatctcctcgagaatatgcttgattttggtgtacatctcgttgctttcgtggagcttgttgaacaccgggttgtcctcgaaagcttgaatgctgagggatgtgatgaggtcgatgatcctgttgggggcggcaaagaccgaccccacgaacatgcgctcctccccgtccaacgccttttccccgagcacgaagatgtcctccacgtcctccccgtacagatggcgactgatgccgttcatgagcgcccggcacagctggtgatacacatttagctgctggatggtgatgcccacccgcttgacgataacctccgaggtacgggaccagtaggtaaaatccgacaaggaatatattcgttccggtatatccgtaaacaggttgtactccctcagcgcctcctccgcctcctggatgtagctgtggtaggccgatgaagaagagaataggcttttgagggccgaaaggactccagccaagtgggggatgcgcgttgtcaggtccagcaggtcctgctccaccgtctggatattcacatcggactggcttgacggacggtggaccgctatatggttgcacagcaagccctgcagccgcttgttcaacgagcggccctgattcgggatgatggtcagctcctcgtagcattgggcgcatgtcgtcccttcgacgtacacttcctgacgcgccaccggcgagatgccgcataggcgacggagaagctccagcagctgcgcgcagacctccaggccggcctccggcgccaggatcccgtacacgtagttcatcttgcacaggaagcgctcgatgtcgttgagtgtggccagactgacgctgaaacggacgttgtccgtaaactggagctccacggtgtgatggcgatcgcagcgatccaaacggaggacggtacggtagaaggccgcccggtccggctggcgcgagtaggccatcagcgcccggtccagcaaagccgtatcctcgtgcagcgccttcagcagcatctccagatagagcgtcagcagcgaactctgcgtacgattctgcgccaccacctccgggtagatcttccggtacagatacactatagccgccgcgtttctcttgaacggcgtggactccgccagtaacacgttcggatcgcagtactttagacactccagctccatggcgtattcgttgcatttcgaacacactacgcatagtttctgtaacaaattcatctccatgactcgactcgctcacgtacgagacgctgtcgtccggtctggcgccggccagagacatggagtcggtgcacaaataactcgcgggccgctcgctatgccgactgacgttgacgttaatatataacgacgtcgtcgacgacgcgggttctgctcccgacgctgttgccgccgcctgcggcgcaacctcctccaccaccgccgccgccggctcctccgcctcgggcgacgggggctcggagatgaccggctgtgtctgacactcctccccttcctcaggcggcccgggcgccgacgcgaatgtcggagcttgccagcgcggcggcggtctctgtctctggtgccgcggcgccaaccttcggggctgttgctgctgctgatgatgcgacgccgtctgtcgccgctgttgcggcggtagctgatacggtgtcgcctggtgctgctgtgtcggtggctgctgttgttgctgctgttgttgcggtctgaaaagcggccacgggggctgcgactgttgctgctgttgttgcgatgctcgtggctgcggcggccgttgtcgcggcgtctgctggcggttacaaccggctgcgtttggccggcaataacccgctgcccccgccgcccccgctgctcccgccgacgccgccagcctcgtcttcgccggcgttcacgagaaagcagccacctcccgtctcgccgggcacgccgaagcaaatggagttgcccgtgacggactcgccgagaagaagaccgccacccccgacgccggacgccgcgccgacgccactgggcgcgaagagcgccgacaggtcgtgcacctcccccccagcggcgtccgtcaatcgctgggcgtcggcgtccagcacgcgtcgcaagttctccagcgaaaagtcctccacgccctgctcctgcaacgcggcaaacttgtccatcagcgacgcggccagcgcctcgcagccatccacgaagaagagcacatcgtcggacgcggggatctcctcgcgcacgctcagaatctcgtacacggccattacttcggggtcgcaatccaagttctcggcgtccagcgccagcatgacgcggttttttataagatccgcgtcaaaaagcacgttctcgcggcgcgagcgtttaatgagcacgtcggccagacgcgtagccaagaggtagcgctggcgcatgaaacgataatcttggccgctcatagagctcacgttaaggctgcgttccacaccgttgcccgaaaagtagccgatctgcccaaactgatagatctccttgctgttgttgatacccgcatatttttccacgctcacgggcacggtcaccaaggaacgatgctcaaaaacgctccgtactaacgattcacgcgccacagtggcggccatgggcgccggcacgcctgcggtcttcaagcccttgacatgcaacgcaaattcggcgggcgacgagaaacgcggactagcacctaacacgtgaggaaactgcgcgtggttctgcgtcgttaagcgcgtcgttaacccgtgcagcgagccgatgtagtctttgaagccgtagtagcagaggaatttgttatggaaacggctttccacgtaactcagcacacagtctggcgccacatccagcagatcgtgctcctgatagtcagccgtcacagccaccagaaatttgacgaaagcattgaactcgcccatgtcacctatgggcacattcttgggcaacgcgttggaacagaccttctgccaaaactgtaagcaggggagaccacattcaggaaagagtcgctcgtgatgtcgatacagcagaaatcccaagcagcccttagccggattacgacgcggaacgtgatcgcggcgaaaaaacacgctacccgcgttgcccttgcccgcgcggtagatgggtcggtttttcacccgcaccatgatcaacgtgggtaccgacagccgcgagagcttgatctccatgggcaccacggcgtacgtgccctgcgcgtacagcctaaagtccagcaggcggtcgtgatccgaattcttggacgacttgatctgcttggtgaagagaaagcccttgcgcgacgacgtggtagagaacgcgccgtggatggattgaaagtgctgcgtcatccatttggataccaagttggtggtcaacggattgtccacaatgtacgaggtagcggtaataagcgccacgttctggatcacgtaaaagacggatctgaaataggcgtaggccagcagcggctggaaggccacggcgtagggattcagatccaggttgaaggcctgcgtggcgcccgccacctcgtcgcggctgctcttgaggcgcacctccgaaacgaaacccagggcctcgtcgtccacaaacttgttgagcgccgaaaagacggccacaaagtcgcttttgccgtgcgcgctaaaggtatcctcgcccgtcacggggtcgatgagccgcatcttgcggcagtaatccaagatgcgattgagccgataggtacggtccacgctagcgcccagcatgcgaccgccgcgccccatcattcccccggaatccccgccacccccaccaccacgaccgccgcccagaccgtcgctcgggcccccgctcacgtctcgtccaccacccccgccagcaccgccgcccggaaccccgtcgtcacctttgccgtccaaacccccgtccttggcgtcgacgttgtaacgccgaccgaagctgcccaaaatatccacgtcgttgagaaaacgcgactgcacggtgatcacgcagggctccttcttgggctgcttgggcaccacgggcaagcgggtgcgcacccgcacgaaggccgtctgataacacgtgtggcaacaagtacccccacaggcctcgcacaaccccgcggcgcagcccaccaggtgattcgtgagcgtcgacgaacccgacaagcccgtgttatacaccgagacacgatttagataccagacgaagcccgaaactagctgcggacacgtgccacacaccaacgccaaatgctgcggcccatagcgttcgtccttgagcggcgcgccttgaaacttgagcaccttgcgcgcgtcgttgtagacgtcttcgcaggccgccgacaacccgttggtgaactgaatagccttgagcaacgtctcctgactggccgtaccgccggcgctgggatgccgcgccgacgactggagatacaccagcctgtgctggtagagcaccgaattagcgctgaagaccaaggcggccacgtgcgtcgagagatgcaacttgagctcggtcagcgcgcggatcagatcgcggtgatcggttgcgttggtcactaaaggccactcggaaaagagcatagactcggcaggttggtaggccgaatcgaaaaataccgaggcaaaactgaaggccaactcgcaaaccaccgcgtcactcagcatcagatgatccttttccagactgctgagtcgctggctcatgtaccccaagtagcgcttatgtggcgccagcttcaccgactgctgactgtcgtgcacaaactgccgcaacgccgcctcgatcagcacacgcggctccgagaagcgcagcgattgacaccatgacgtgtacacgtagtagaaaagcgtctcgcttacggccggcacgtagagccctcgcgcctccacaaaagcgctgcgcgcatccagcgagacctcgtcggcttcggcgtcaagctgcagcgaattaaagagcgtaggcgggtacaacggcacgcgcaccgcctcgccgccgtgcagtcgcaccgtggtcgcctcctccacgcatggaatcagctgaccggcaaagagaaactccttcaagccgttgcccaccaccacgtgcacagtcgtctcggacgcctgacagcccaccgccgcgcacaacgccgccagatcggtaggcacgcgatccgcctcgggcgtgtaggcctccaacgcgtacttctggcgggcgtcctcgcacagccgatgcacgtctccgtgatcctcggtaaaagccacgatgccttgcgtatgatgaaagtagagcgcaaaaggacagaaggacgtgactttcgtgagcaccccgccgtcgtaacaaagcacaggcgtacgcacagagacgccgaaatccgcctccaccgtgagccccgccaacagaggagcgatcaccacgctcgaggaacggtcgcataacgagagagtggccagaatctcctgcgtttctgcgttcaacctgctgaagtagagaaaagccgcgggccccaccggcgctagcgcggttagttcctcgtggctcatggtggatgaacggaagacaatggctacgccgccactgagtgaattttataccaaggaaaagttcagcacgtcatgtttgacgcacgacgtctgagacaccaccgtggccaccactgcggtctggctgcggttgcggaccaccaaaggcgacaaccgcaacgatcccagcaattcgtaagaaaagctaaccgctacggtcgggtagcctctcgcagccagaccgctagccgacgcacccgcccgcgaaaatagcgtgatgttcgggacggctttgcgtcaccgccaactaacgtcggtagtcgagcacgtcgtttatcctcagcacaccgtccgatcacaatccgttttcccactcagtcgcacaagcagcacataaaaaccccacacagggcacgtgaaaacaccgtccctagaaaacggtgttttctgtcctaccgtcaccggtatacacaggcaaatcccaagcccgatccccgaaaacaccgtacggtgtttgtgacctccaaaatcacatcagctaacaaaccgtgaaaagtcacgtttcacgaacacggtgtttttaaatcacaaagaaccgcctgacggtttacaagcagaaacaccgcaccacggtggtacaagcgcgatgaatctggtctcgcaacctcaatcgccgctatcaccaccgattttcgctgcgctccgccgacaaaacgccgtacaagctacacaccccaaaaacccgcgcgcctacgggcgccaaacctgtgtattatcccaacgtcacaacacgacacaaaccgcgtaacgtggtttcccgaacacgtacgcggcacagacccccgacacgtactcgaagaccttacagtttacgagtcaataaaacaggaaaagatccgaactttaaaattgtgtatttttattttcccatccccctctttttaccaaaaaacacatttttcgtcttgtaaaaagtaactttcgcccattgccatgaaacaccgtgatggggaacggtgttgtgtgtcgactgacgtcactacggcgatcagtatcgacgtcgtgtatacataacggtgcccggtgtttttattcggggcgttgtcgcgtcttgatgtaatgtaacctgaaaccgccgtgcccaagaatgcggaagccagcgtgtactcataacggggttttgggtacaatctgacgacatctggcggcgagcgtacaccatcgaatgtggcgatcgccggctctacgtcacaatgacgcaaaaacacactgtaaaacccgcgtagacagctttcctggtcaacgagcgccatctggtgtcggcataagaacaggaatcaaccccgtggccggcgaggcggtgagcacttttcctggtcacgtgaccatcagcgcaggaagcgaggcccgtagaaccgcccaagaggcggtgccagatgccaacgtcataatcacaaggtgatttgttacgtcacgcgtgtgcgcacgcacgcgcgcacgcgcgcggtagaatacagcgatccctagtgaagccacacccattacgtgtagccatatccgcttacgtatacagccacacccctaggtacgccaccttatctaccaatcacagaaacggatatacaatgacccctccctagactccaccccttgtacggaaatttcagataggtggaacccgttagggttccaccgtcctcggtgtacgtacaggcttctccgtctaccggaaatatacacctgctgacgtagacgctactcccggatacgcgtcataagctactggaccctaggggggagtgtctacagggctacgtgcacgcccccttacctagggtatccgcccccttcctctgttttgacctagtaaacttaacgccgccgcttctcacgtgacccctgacaagcctacgtcacactcgcgtaaccacacccactccggatatacgtcatcctgtggaattccggacatacggtgacgtagcgagcgtagcgagctacgtcacgtatgcgtgcgtcacctccggcggaaatcatctctgatgacgtagcgagcgaagcgagctacgtcatcagtccgttctacgtataccggatgctaggcgacgccccgtaggggcggagcctagcttccacccctaggatgcataccctatatagcataattcttctaacgaaacgttctacgaaaacggactggcggaacgggaaccaccgtaacccccccccctcacccccccccttctcctccggaaccggggggggcaaatttttaccaaatttgggcaaccatgatttccaatgggacggcgtttccgtgcgcatgcgcagtcggggcgaattttcggttaccagggcgttaccacgcggattatgggatggggactcgagtgcgcatgcgccggggatgccgtatggagagcctatatataaagaggggtgaaccaggggccccggtgcgcatgcgcgggtcctggtccgcgggagggtcgtcctgcgcatgcgccggtaaaattccactgggtgtgtgtcgtgcgcatgcgccagtatttttccactggaggcggtcagtgcgcatgcgtcggtaaatttccattggatgcgcgtcgtgcgcatgcgccggtatttttccactgggcggccgcacctagggagcgcgagccccgtgccgggcatgggccgcggcggtggaaaattaccgctccgcccacctaggcggggcctctgaaaacctataaaacccggcgtgcccgtcgccccccggcgcagtccgcggcagggttccggccgtgctgcggtccgcacgctgcgcccgctcccgcctgcctcccgccctaccccccaccctccccggccgaggcccggcgccggtccgtccgcgggcccgtcccaccgccctggagcaccatccggggccgtgggccgggcaccgggcgcggcccgctccggacctcggccgggggtccctcccataagcgctaacttaagggttgaaccatctgaagaatgcgacgcctcggtgcctcgttaagacgatgcctcgcgttcttcaattgcgttttgtaggctgtcagggatactgtcccacgaatggccacctgtaagctccagatgaccatttttgttattctccacaacgagttagttcttcttttcggatccggcacttctgggggggaaatccagcgatggctggattatgtcgtcaattaaaaatgcggcgagtagattagcaaatatccacgctttcgcgagttcaggttcctttgcacgcaaagcatccaggtgcagcaaacttttgagccgcttaaaagccagttcaatttgccatcgcagacggtaacaatcagccacttgctctgctgaatattcatcttccggtaatgatgttagcaatagcacatggcccgctgcttccagcgtttccgcctgaactactcgtccttttcgacgattctcgctgagcagtcgggttttactgattaatgctttttcgggaggaagtgatacggcaatgagacgtgccggaaagggagctccggcttttttattacctgaattgcctatcattacagtggtttcaccgttcttaccgcaatccagcccgcgcagaaaacccatcatgtcaaagcgcattccttctgcagttaaccagcgcaatcctcgccagtgaacccggacgatataatcagcttctccaaaagcaagtgagcggatacattcgggacgcgaaccgaatccccggtcagcaatgcgtatctcgtctgccgtttgcgcaaatcggtccagccgttcagcgtctctgctgtcggttagctcaaaatcagtgaactgacaggtatgaggatcatatcccatatgtagtcgccattcagcgctgccgcccccgggcgcactgattgctgttccatcgacaagacgcaatctctttccgcttgtacaacccgtaactgcggcgcgtacagcaagtgtttgtgcggcaagtatgccaaaccagtcggcggcattccgcagccgcttcaggagagccacgtcagataatgttgcaacgtcatggagctgagcccatgcagtgacttcacgtaatgacatccccccggggccgtaagccagccccagacgtagcagagttgcagcatcacgaatttcgcggcggcgggttagagccccggcattacgtgccgaagtatccagttcttcgggcttaccaatatgggccagaattgctgaccagttatcgtgagagtaattcatcggcacgttaaatcatatcaggcgtaataccacaacccttaagttagcgcttatggggtccctcccctccccccgctcgaccccccatccgacggcccggccgggctgggacccccgcaccggggtcccggttcccgtccgcggcccggggggacccgagcgggggcttcccacccccaccccgctcctccccgggctccggcccgggatccctcgctgctcccggcggcctccgccggcttcccggtccacccgccgcggaacggacgggacccggggtccgcgcccttcccctccccccacggggggctgggtcgcggaccccggttcctaggctcgttccgcggtgggcgaccggggatcccccaccccgctcctccccgggctccggcccgggatccctcgctgctcccggcggcctccgccggcttcccggtccacccgccgcggaacggacgggacccggggtccgcgcccttcccctccccccacggggggctgggtcgcggaccccggttcctaggctcgttccgcggtgggcgaccggggatcccccaccccgctcctccccgggctccggcccgggatccctcgctgctcccggcggcctccgccggcttcccggtccacccgccgcggaacggacgggacccggggtccgcgcccttcccctccccccacggggggctgggtcgcggaccccggttcctaggctcgttccgcggtgggcgaccgggatcccccacccagctccccttcccggctcgccccgctggcttttgggcccctccgggctttttttccggctgggggtcgcggcggccggccgacgacggtaggtgggccgggcggacggtggtggggacgggcgacgccccggctcgacggcagtcggccccggagggttgggggctgggggcccggtcaggagctccgggagcggggtcgaccgcgacggcttccgggtctcgcggcggctccctctcggcggctccggttgggctcccctcccccctctcgagggtccggtcgccggttgtggtcgggggtccctcggcctagccgccggctctcggtccgccttaccctgggcgttggccggtcccgtgacgctcccctcccccgctgctccccaaaaactccgcccgaaccgtcgcggtttgctggccctgggcgtggtctccccactcccctccccccatcggccgcccagccggggtcggcgcctcggaccccaccaggctgtggcgtgtgtgctggccgatgcggcggcgaggttgggtgtggccggaagcgctcggggtcgacggtgggccgccatgacacctcaattgccgtcagtacgcccctccacaatcaccgtccccacacgatgggcccggcagttcacccaacgttggttcaggcccagtcgggtttttccccggtacgaacgcacgtccccgtgggctccacgcgttttccaccctttcctggaggggtccggaacaccgtgaatccacggggagggtcccggcacgggccgaggagaccacgaccgtcccacccggcgtgtcgactcgtccgagacccgggaagggaacaggccccaccttttttcccttctccgatttgccgtggaaaacccgtgaaccgatacgggtgcagacggccgaaaaaattcgagacggcaatacgacggcagggcgtgattttctcccccacccgacaaaaccgtgtccctcaaaattccccacctttctctgttcaaatggccccgaaactgtaaaacaccgtttgaccgcaccccaaccggcgccatcttggtgaccttctcgacggttctctcgctcgtcatgccgttctgagctccgacatggcggacgagagaaaatggcgtcgagagccgaggagcgttttcgctccaggcgggtaaaaaaatagcacgataacttttctgtgcttttttgagacgtttttgaagagctttttttctgctcagagcgaaaaaatgatagccctgaaaatctcgacgagtctggccgagcggcgccatcttggaggaggggcgagtcgcgggcaccgcctcggtaccccctggccgaggcgagtccgcggtcgccgcctgttccgtgatgctacctagagggcgccgtcgaggcgactcttcctgttttcgccctgagggctaacggtcgctgacgtcaaaccatctcgtgctcgctgagtcacatccggttgttgacaagcgatggaggaccgcacccaaagtgcgccctctagtcatcgcgcctgaccccttttataaactgctcgaagaaaagaacaccttatgtgaaaaaatacagaatgatgacaagttcattcaacacaaccgctcaacaacgccatatctatcagtgtccaaaaactatcttctatcctttgaaactataaatgctgcctatatacatatttagtatccaagactcttaccacgtagacgaaaagaagtgatacaatgatcttgacgtgtatcgtctatatcgtgctagatatattcagataagacgcgcaaaccatagatttctcatcagtatcatgaaagacctatagctctatatacgaacctagtcattttaggacagccgccggagaagccgacgagggatcgggcgggtgcagccagaacctcacgcccgatcccgcctccggtaggcgatttgcatctgtttggtaaaaagctcataagtctgtatgtgacctatatatatattatacgctatgtacaccgaactgtcgctgttgtataagaagaaaaaactctccatatttatatcgtctgaatttttgcttgatagacacgtgtttggaactctgtccccccacgttttcactgtgtataacaaaaatatgtgtttctcaaaagatcttgaggtgtttgaaaacgggggaaacctgcgtttgggtgcgctaagccccggactgggacgtagccggcgtccggcacctatatttttctattttttttttacaaaatatatgatgaaccaagaataaaactctagctctcgtctatttttaatatgctctacttagaacctttttaatgacagaatgaactccatgttatacgctctttatatagtttctctgcactaacctttaaaaccgtatccttccctgttgtacaaatcatcttttgatacacaatgatgacctgatatccctccatatatatgatcggatattattccgttagacttgtcctccttttttttcctcatctcctgtatctggagatatatgttgaccaccaccgccatgaccaccaaaaagctagccgtcacgactagaaatgtgtaggattcggactttccgtttgagaagaaagagaccgcgtctctggacgctctttttgtcggtctgaatcgacccgggatacgtaagagagcggccctacatcggggggcgctcgagaccgacgacgttccatctgaccagaaaaaaaaaggcacccctcggtggcgacctctcaccatcgtttgcccgtccgcccgtccttcgtagccatcatcatcatctcaggctctatcggtaccatcgttgtcatctgaaaaaaaaaactgcctcacccacctgcgtaaaaacaccatctttccggaggtgcggtaagacgggcaaatacggtcgtgccgaggcaaaaaaacgcaccatcgacaccacaccctcatgagcaccacctgtcggtgttggtcgtcctccatcgttctctacgaacatctcgacgcccgggtgacggacgacggcaagacgtcccggagaagacggtgttctctcgggcggtacgctctctggatctataatatctatagtagctaaacgagactgtgagtacgacgaaccacatcatcttttttttatgttgcttctttagaaaatgacttatgtcgacgacactcggcatcagccatctcgtgaaacacgctcgcttttcgtctctccaaggaacactgggtccgctgaaagggaccgtgtaccgaccaaagcaaaaaacacacacgtagtaacatgatcaaccacgtctgaatgacacgaaaacacaatcgtataacgctctattcatggaacgaacttggaataaaaaaaccatcgcaggccagaggctaagccgaaaccgtccggggaagcgggcgcgagttttccgacttagtctctggtgctcgttgagcctcttttttttttcctgattctctgaagaatcaccgtcacagccctatgacgcgaaatcaattgctagaacataaacgttctcaacaggtatgaaatgaacaaactagatgatgctataaccttatattgtgtgtatatagataggtgtgaaatttgtaggataaaaagtgtcgttgtatgatgcacaacgatcgtgaaactggagactgtagctctctaccgaatgcaaatacacaaatgacatcgattcccgtccccacataaagaaatgtgctttactgtgaaagaatgaagaagattcttgttcctcgtacgacggggccctcgctcgtcgtgcctcttcccccctccgggagaggggacgtcggggccctccgtcgcaccgggccgaagccagtgaaatgtttactacactgtcatcagaatatatgatgtatattatttcctccaaactcctcaccatagccaccaattcgcatcacttaagaaagtagtagcaaccgcggcggcggcgaccggccggtcgtcgtctcctcgtcctcaaatgttgtacatgtgcagaaaaatgtgtaaatacgtgttatttatcccatgcgtcttgtacatagatatatgtttttatatacgctatttatactttatatatccttttgcataaccatagacagtcaaggattttaatgatttgctcatccgcctttgagccatcgcttaggagttagttcctctatgttctcggcccaccttttcgactacagtagcaaacccttgtactaccaccccgataaaaaccacatcatcatcgtcaccacgacctggaaacgacacacgttcccccccaatcttgggcatgtgtatatataaaaagaatgggagggagaggacgtggggctcgagaagaaataaacgccaagctcgattcgaaccaaaaaaccacatgtgtattgtgcttttttttttttttacggtgggggaaaaggagggggccgtcattaacggaaaccgtgtatggggtccggacacgaacagtacacagcttatggggaaaaaagctcacagagagaaaaaaacaccaagctcaggcacgcgtacatcattatcatcatcggatatctcaccacgggtcatagtagtaccaaggagtgtgtaacaccattttttcttttctttgtaacgggataagggacagcaatcatcacgcacaacacccttcactctctttttagtcatccatatcatcgctgtaacacagcatgtcctcgtaatcgggcgtctggcagcgcattaccaccgagtcgtcttcttgcggtaccggtggtggtggcggcggcggctgctgctgctgggttgccgtcgtactgtgattaccgttggcggactgcacagggatgatgggctgcttgtggggaacctggggtggactgccgccgtgagaaggcgacggcgtcatcaagttaagatcaccacggtgactccggacaccggcgaggggcgccgggggactgggagggaccgcggtcgtcttgtagacgacggtgtccccgtgtcgatccgtggctcgtaccagatcttgactgctagcgtcgtcactgtcttcgtcctcttccagctcgccctcagagtagtgctgctgtggttgcgacggtggctgggcgggaggagcggcggcggcgatcattggagagggatgtcgatgactcccttctctgtcttttttatcgtaggctgtcagcgttgctgggtccgtcctgctttccatatttgtgtattgctcatcggtgggatgaatttggtctcctccccgctgttgtccgccggcagtggcatggttgctggcggttgtcgttgtcgtaccggcaaagacggtgagatccaatagcgactgctcgtcgaagggacagtacgctatcatgaaacgatagggtgccaacgcgcgttggatgcgcagttcgcacatctcgttctgacactcgtggcactgcagggcgcctaggatcaggtccgagacagcgccgcagcggtaggtacccatggcgttgttagtatcgaactggtcaaaaaattggggcgtaccggtgacttgcaacgcgcgacggcgtagcgagacggccacgcgcgagaaagagcacacgtaggccatggcgcggtgcatgggttgcgagaaggtctcgggcggacgcttctgcagatcgcagacgtcgtcgcgtagccaggcgctcatttgaccgggcttcttgactaaccgtttgagcgtgctgcaatggtcgccccagccgtcctggtggtccaggatgcagcccaggtccaggttgttgagtttgttgaagagcagctgacgcatgccgcccaccgtctccagatagggatcgtgcgggttgacgggtagcccgtgcaggtggtggtacttcatgtagctgagcgtttcgtcgatgatggccagcaatgtgtgtaagttgggagcgttgtacacggcgaagatcttttccaccaccagcttgcgcagcaacggttcctccagccaatcgaactgttgacggatgtgcaacaggtagtcggtgtgcatgagctcgtcgtgtgacagcaggatgcgaccgcgcggctgatgatcttgcgggaaggcggtggggaccttgagatcggcggggtagggtgccagacgtagactctcggccgtgtagcgctgaaggtcgtagacgggcgaggtagaactcggtgaggtacccgacgaggcggcgccgcgctgcagacgcgctctttttttcttttcgatcaaacggctgagttgctgtagttcgtcctcgtccatggcgtccagttcgtcgtcaataagcgccagcatctgttgttgttgcggtccggcggacgatccgtgatgattattggctgaggaggggtgagaagaaccgaaagtcgtaggacaactgggaactcggcgacgaagatgcgtcgaatcgccgccgtgatggtgcggttcgccgtcatcgttgtcgtaagacttaccgtagtgggggttaaggggcaccgaggcggacgcggccacgcgtcgcttgaaagaggaggacgccctatgtccgccacggaagcccgcggtgcccatgatgatgtgtccgccggtgcccccgagtgcgtggcgggaggagggtggaaggggaggaggatagtggtccggatcgccttcggtatcatcgtctttgctgtagcggggtcgtcgtgcggggacgcagggtcggtgatgatgcgaggcggcgccgacggtatcttccgcgagatggtattcgctggcggctgctccgttccgtgtcgacggcgaggttggacttcgctcgcgtcggaacttccgtggcacgggttcgtaatccagacagaagcgccgtgcgcgacgggcgcggcgttcgcgctcgctcagggaagataacgacggagcgtcgtgacggccgcgtgagtgcagctccatggccgtcgtcgctaggaaggtcacgttcgggcacgctgatgtatatatagatgagaccgctgccggggggcgggtcaccggcgccgtggaaagtgaggctcagacggcggtcgccggcggcatgggcgcgtcgggcggtctgattttgatggaaatgtggacgtttttggcgttggagtgacactttttggtgaaacagcggctccagaggctggcccagagcgcgtagctgtgctcggtgcgcaggtcgatgaacacctgcacggtctcttgcgggttgcggtgcgtgtagttgagacagcgaaaatcccgcgtgcgcgcgccgtcgcgccgcttgacggccacgcagcaggcgccgtggggctgaaagaggaggacgtggggcgcggtaaactgctcgctgacgtgcggttcgtagtgttgcgtgaggtgctcgagcagcggcggccacacgcgggtgacgacgagccgctgcaagtccgtgtcggaaatcgcagcggcagtggcgccgtcgccaccgtacaggtgataggcgagcacctcggtgagaccgcggcgtcgataacgcgtcacgttaagcgagcgcgtttcgatgaagttggcttcggtcgaggggcagattttgtcgcgcacgctgagaatgacgcgcggcggcggcgacaggggcaacgcgggcaggtcgtgcggcgggtggtggtgaagcaggttacgcaggtccagttgggcgcgcacaaagcctagcgggtgttcgcggtaggcgtcgggcacgatgaacagcggcaacagacggcgatgcatgaaatagccgtcgtcttggtccattttatacatgtagggcagacgtacagagcgtccatggtggtagatgcctgtgtctaggctgctctcgggatgcgagatggggtccagcagcgtgtgcagttcggcgtcgagacagacggcgtgattgagcacctgcgccacggcgcgtaaaacgctggggtgtacggcgacggtgcaggcggggaacggcgtgatgatgcgcagccccagtttgcccttgcagcggcagtaagggggtgacgtgtcaacggaggacgttgttttttgaaaaacgccgttatccgggacgttatttttattctctttcccgtcttcgtcttcctctgtgtcgcgctcgtcccggtaatcgagatagtcgtcgtcatcgaaaggcgcgccggccgcgtctacgggcacgctgttgggtgggcacgcgcttttgaagaaatagaccgggtgccggtcggggtgcgtgtagccaaagaggctcgcccatacggtcatccagacgcgtcgtagtccgcgacataactcaaagacggtgtgtcgcgccagaccggagacgccgtcgcgcagccgtaaatcaaagtcggccacaaaattgaagacgggcagacgttcgttgaagacttcgtgtcgcgtgtagtagaactgtgtctcggggctggtgctggccacgtcgtcgtcgtgtagccacacggtctcggtcagggcctcatccgagaaacggctgtcgggtacgtgacggagcaggtcgcgcggaaagaggctgcgatgccaggtttcggaggccacggcgcagaagacgtgctggtcattgggcaggtgtacgcggtagacgggcagcggtcgctccagcagcggtgccagcgcgggctcgggtagcaggtagcgacgttgcgagtaacgcgttagcgtgccggtggtgtaggtctgggctgtgcgtagcgaggcgcatagacgtaacaaaccggacagggagcgttccagcggggagaagacagactcggaaagcgtgttgatgcgttcgagctggcgcgccagctgcgtggaggtgccgaagaagcccgccaggtgcgtgccgtcgatgcggccgccgtagccggccagccccaggccgtgcgggctggtcgccgagtggggggattcgtcgaggcgcagtaggtgcgtctccacgtagtcgtgtagaaagttgtcgagcgagaagtatttttgcatgacgtccagcagctcggtggaaagccggcggcccagaaaacccggttcgcgcgtgcactgcgcttcgggcgccgcgtcagcgtcgtaagccaccacgcgccggtactcgagcaaccgcgcgcgtgccagcgccgtgcggtaggccaggtagacgtagtgcacgcagaccgtgtcgggcagacgcgcacgttcgcggaacgcgttgatctgcgtgtccacctgctctagctcggtgtagtcgcggcggttgcgcgccacggcgtacgccacgaaagcggacacgcgctgacggaagggcgagcccagtagcagacgcgcgaactcgcccatggaggcgtgcgtggggatgatggtgcccaggtcgcgcgtgcagaagctgcgcacgtactcctccacggtggagatggtgctgtactggccctcgaataggtagtaggccatggtcagcagcacctggccctcggtgtgcccgaagacgctgatgaaccacgagggcgaggtggggcagaggaagacctggttgagatgacgtagcacggccgcgtggtgaaagtacaccaggtgcttgaattcgcgcacctcgccgccgtgttcgggcgagagcacgggcgtgcggaagagatgccggtagagcggctgcgtctcggcctcgtccagactggcgataagcgccgagagggggatgggctggcgcgcggccaggtagcgcgagagctgcagcgtttcgttgttcacggcgaagacgggcgccacccgccgcgagtccgagcacttttgtgtctgtaggcagaaataaacacgtcgcgagacctggtgtttgaccagcagggggaagacgcagtgatccgtcggtgtctgcgagagtacgttggcgactatatgagcagaatcatactctgttgcgaacagaacgagcgtcatcgtcgcgccggcacgatgcagctagcccagcgcctgtgcgagctgctgatgtgccgtcgcaaagccgcgcctgtggccgattacgtgctgctgcagcctagcgaggacgtggagctgcgcgagctgcaggcgtttctggacgagaactttaagcagctggagatcaccccggccgacctgcgaaccttttctcgcgacacggacgtggtgaaccacctgctgaagctgctgccgctctataggcaatgccagagcaagtgcgcgttcctcaagggctatctctcggagggctgtttgcctcacacgcggccggcggccgaggtggagtgcaagaaatcgcagcgcatcctggaggccctggacattctcatcctcaaactggtggtgggcgagtttgccatgtccgaggccgacagcctggagatgttgctggataagttctccacggatcaggcctcgctggtggaggtgcagcgcgttatgggcctggtggacatggactgcgagaaaagcgcgtacatgctcgaggccggcgtggctgcgacggttgcaccaccgacgccaccggcggtcgttcagggggaaagcggcgtccgcgaggacggggaaacggtcgccgccgtgtcggcctttgcctgtccctcggtttcggactcgctgatccccgaggaaacgggggtcacgcgtcctatgatgagtttggctcacattaacaccgtctcctgtcccaccgttatgaggttcgaccagcggctgctggaagagggcgacgaggaggatgaagtgaccgtaatgtcgccgtcacccgagcccgtgcaacagcagccgccggtcgagcccgtgcagcagcagccccagggacgtgggtctcaccgtcggcgctacaaggagtcggcgccgcaggagacgctgcctacgaatcacgaacgcgagattttggatctcatgcgacacagccccgacgtgcctcgggaagcggtgatgtcaccgaccatggtcaccatacctcctccccagataccctttgtgggttccgcgcgtgaactcaggggcgtgaagaaaaagaaacccacggcggcggccttgctgtcctccgtgtgaacagcctggcacgttttggaaaacgtacgtgatcacggacacgacgagtacggggtttctcatagacgtactttattaggtcagggatgacggggaggtttcgggccgacgtcaaaaataacgtcactcgtgttgacagggctttctgcgtcggagctcttttcatcttcttctgtctcgtcgacgtcatcgtctaccggcgagggtgtccgttgcaacaacgcgtgctcgggcgtgtgggtgaaaccgatgtcgggggtgggcggcacgatcatctgtcctagggggtgactgcccaccggcagataggtaaagcggtgggtggtaaaaaccgctttggctacggtggtgtgtggggagatgcagacggtggtgtgcgaagtgttgaccaccgtcacgccggccgcggtacccgggagccagatggtgggtcggatgatgagatccgactgactaaactggcgcacgcccactatgagggcgcagataccgggcgcgtgcacgtaggccgcgtcaaaatagacggtttgcgtgtgacccggaccgatcaccagcgtctgacgggtacgtaatgaaaagaaacggtgttcgttgggcggcggcaagttcatgagctgccaaggttctggcacaaaacaggggaaaacgccgatatcgccttcgatggtgcctggaaagatggactgaaaagtgtcgttgaggttgacaacatccaactgcgggacttgcagcccggattccagcagctcgggcatgcaaacgaattgcgcgtccaggcatttgtaaaaggtaatgccgaaaaaaccttcggggatatagaggctgacgcccagcgaggtgggcactttgcgctcgcgtgatagccaaatgatgtgtttattgtaaaaggccagctgcgtgtggcattgtttgacgatgaaactggaaggcatccacttgtagggaactttgagcggcgacggtaatggcgacgacgcttcatcttctcccggatgctgctctttgtcgtatttctcctcggtcgattggggcagcgtaaatgtggtttgaaaatcgctatcgctagcgaaacgtacgcagtaacgcatgttgacggatttctcggctaggatgatggagcctgatgacggtgcggactcttccttcattattaacgtaggggtctcccagaatcgctgaaaacgggagcgcggcagccgcgacagtaccagttgagagtcgattcgatcggtaaacatcgtaagcatcgtggcggtggtgtgatggagtggaacacactagtactaggtcttttggttttatcggtagcggcaagttccaaccatacgtcgactgctagcacaccgagtccctctagctctactcacacctcaacgaccgtgaaggcaacgactactgcgacaactagtacaactacggtgacaagtacgacttcatcaacgactagtaccaaacccggttccaccactcacgaccccaatgtgatgagaccacatgctcacaatgatttttacaaggcgcattgtacatcgcatatgtatgaactttctctgtccagctttgcggcctggtggactatgcttaatgctctcattctcatgggagttttttgtatcgtactacgacattgctgtttccagaactttactgcaaccaccaccaaaggctattgagggtggacaggttcacagcccggcggtgttccggcggggtaaggtttccatatgtggacgactgtaggctgaagttacggatttcacttaaaaacagcagcgagtctagataatcccacatgggatctataaacgttctctgaaacctcgtcgatggtgacgtaggtgtagttttgttattatcggaagccgtttcgttttccacgggcatggtgtcgttgtaatataaggagctcatgtcaagagtaccgtaaatagtgtacggtgtttcgttgcgaatcaatacgtgcgtatttttcataaattctgatacggcggtccggttacggtttggtttacaaaaaggttcatctcgatagcgcagagtagtatacacccacgtcgctagatcttttaactgcgtggtcagaatggatttcataaagttttcgtcaggacgataaccaattgtagatgtgggaatccgagttgggacaataggactataagttacattagtactgacgttaaaaatagttgacgtgtaggaagaatatggtgtggtggtgctaacacgacttttcttactgatcgatttgacaggcgcttgtttacgtttaagctttcgcatagtgttcttcagcttggtgctgttaatatacttgggaacgcggaatatattccggctcatggcgttaaccaggtagaagctgcgtgtacagttacgttgcgcgtaacgtagaagcagggcggctaaacctaaaaaataaattgtttggctatccacattgactttactcggacccacgtacagtttggtgttccaacgtggtacgttaaaaaacataggattaaatgtggtaaaattgccacagttttcctccccggtgttgttacgccgggatacatttagcatttcagaaaggcaagtcatggaaggtatcgtaccacaggatgggggtcgaaatgttattttttgccctgtatgattatattccgaatacacatatttggccggtttacggagttgggtcgtgtgaaaatcgaaccagaggtgggtaatgctatgattacgaataggtcctgctaaaatggaattcgggggaaactgtttcatttctacagttatgttatacaacttttgctgactaggaaatgtgaaaaacttgtaataatcacctgtttttgacgctagttcttgcagtatacgtaattttagttgcctctcttcctcttttgctttctgactctttactcgaaaacgcgctaccgtgatcttacagtttatgaaagagaatagcaggaaagttagcgacataaggaaaaataaattaaaaacacctctcatctctccctttctccccatgacagaggaggagaccccgcaccgtccgtctgccttgtggtttggcttgcctgcgtgtactcactgctgattctggtcgttttgctgctcatctaccgttgttgcatcggcttccaagacgacctagtctcccgcaccttggctgtgtaccgagcttgtatccaaggcccgatatgtaaccagacccacaacagtacctcgtaaataaagacgcacagacctcacacatatagtaccatcacaccgtgtggcgtgtactttattacaacgagcaagagtgcccctaagtattggggcccgtaccgttttagaagattttgtgtgaatgtctttaactttctctgtcccttttctcataaactgtcaggttctacagtcagcatgtcttgagcatgcggtagagcagatagatgccgatgatggccgatagcgcgtagacggacatcatgaggagacgactgtcggtagcgtccacgacgacgtcagttacttctaggaccgtaccgtttttcaaaagcatgaggtagtgagttcgcggagatgagaccaccacttcgttgtagggatccagggcgaaaaggacgtcgtccgagtcgtgcatgtacatgatgttgatgacgccttgcgtgtcgtcgtattctagtagggcgctttggcaaaaggcgcagttttctagggaaatgttgagcgccgctgtgatgctgtgtgtggtatgcatgttgcgcgtcagttcgcatttagtttgactgtccgtctgggtgatgatgaggctctggcctacgacggtggtggagacagggtaggagatacctttgatcaggtactggtttgttacgacataactgacgtgttcggagacggtcagcgcggagaaggattcgccgagcggcagacaaaacaggtcggggaaggtttctagcgtgcttggttgcatggtagataggatggagagggcggcgggaacggtagtggggacggtggcatcggggaagagacgtgtgaggcgttcgagcgagtgatcgcgtcgcccgctactggaacagggtgtgtacaggtcgctgaggtattcgtggtgcggatgagctagcaactgcgtaaagtgtgatagctcggctaatgaacagaggcccgtttctacgatgaagatttcgcgtctctccgtcgtatgtactagcatggagtggacgaggctgcccatgaggtagagttcttgacgcgcgaaggctgaaagaaaagaggccaggtgcgttttgtgtagttttagggcaaagtcggcgatctgtcgtagtgcccactgggggatgagatgttgctgattctgtttagagagtatgtagaccaggcgtacgaggctggtgatgtcggtgatctgattcggtgtccaaagggctcgtttggccaggtccacggccgtgggatacagcagcaacgtggtgcgtggtggtgtttgtgagaggcaggtgatcataaattcttgtatttgtaagagtgcggcctggcggtctagggcccgtgggacggagacttgggcgccggcctcttcttgtcgggctgctgcgaacagtgctaatgcgtaggcgaaggccatttctaccgtgcggcggtccagcatctgacatcgaccgcttttgagtacatccacggcgtaacggtgaaagctgttacgtagtagtgcgctgaggtccaggtagttgaagtcaagtgcggcgtcaagaaagtccgggtctttgagataagagtgacggttcagttgatctttcttaactagcaccaggagctcgtgtttttcagtttgtcgtagtataaagttgtcgcgttgatagggcgctttaaagagtacgcgtggaagatggccgaagataagcagcatgggtgtgtcgtcgtctatggacaccgtaactacgaagaagtcctcggtcagtgttattttaacgtaacgtagttcgtcgatgaggtaaaagccttggtgcaaacaaggtgtgacggtgctgaatagtagatcgtgtccatcaaagaggatacaggtctggttaaagtgtggtcggtgtagtcctgaggtggtatgtgattctgtccagccgtgtggagtggtttgcggtggcatccaaacgtgaggtattgacaggtcaatgggtggtggcacagtggtgggctgttcacctaggctgtcctgtgcctttagctgctgcgaaaaagatcggtagctggccaggtctttggataccagcgcgtaagtgttaagtctctgttggtatctttccagggtttcggtcagatctacctggttcagaaactgctccgccagaggacccgcaaaaagacatcgaggcatatggaatacatagtattgattatagctttggaaaaagttgaaactgatggcgttttccctgacgaccgtgctgttacggaggctgctattgtaggtacactgggtggtgttttcacgcaggaagcggatgggtctcccgtaggtgttgagcagtaggtgaaacgctttgtccagcggttcggatatggcttctgcgccatatcgtgacgaaagtaggtggctgaggagacagacggcgaggacgatgaggtaggaggggaggcctggccgcatagcgcggccgcgccgctgggttcagcggcgtgatccaggtggtggttggcgttacacccgagagaaggagagaaaggatcccaggaaggagcacccgggtgcggcgctacgggttacaaaagtcgcgtctccgtctatttaatacgatgtcattggccgctgcgaagggagaagaggggacacgcgagtaagtcatgccgtccgggtgtggggacgacgctgattcgaaggggaacgctctgcggagattgcctcacgtgcgtaagcggatcggtaagcgcaagcacctggacatctaccgtcgcctgctgcgggtctttccctcatttgtggcgctcaaccgcctgttgggaggccttttcccacccgagttgcaaaagtaccgtcgccgtcttttcatcgaagtacgattaagtcggcggattcccgactgcgtgttggtgtttttaccgccggactctgggtcgcgcggcatcgtgtattgctacgtgattgagttcaaaactacgtactcagacgccgacgatcagtccgtgcggtggcacgccacccacagcctgcagtacgccgagggcctgcgccagctcaagggcgccttggtggactttgattttctgcgtctgccgcgcggtggcggtcaagtctggagcgtagtgcccagtctggttttttttcagcaaaaggccgatcgcccatctttttaccgggcttttcgttcgggccgtttcgacctgtgtaccgattctgttctggactatctgggacggcgtcaggatgagtctgttgcacaccttttggcggctacccgtcgccgtcttcttcgagccgcacgaggaaaacgtgctgcgctgccccgagcgcgtgcttcggcggttgttggaggacgcggcggtggcaatgcgcggcgggggctggcgcgaggacgtgctcatggaccgggtgcgcaaacggtatctgcgtcaggagctgagggatctgggtcacagggtgcagacttactgcgaggatctcgaagggcgcgtgtccgaggcggaggcgctgttgaaccagcagtgcgagctcgacgaaggaccgtcgccgcggacgctgctacaaccaccgtgtcgtccgcgttcgtcgtccccagggaccggcgtggcaggagcttccgccgtcccacacggtctttatagtcggcacgatgccatcacgggacccgccaccccgtctgacgcggcgaccgcgtcagcggccgccggtgcttcttctacctggctggcgcagtgcgccgagcggccgttgcccgggaacgtacctagctactttggaatcacgcagaacgatccctttatccgctttcacaccgattttcgcggcgaggtggtcaacaccatgttcgagaacgcctctacttggactttctcctttggtatctggtactatcggctcaagcgggggttgtacacgcaaccacggtggaaacgagtgtaccatctggcgcagatggacaacttttccatttcgcaggagctgctgctcggcgtggtcaacgctttggaaaacgtgacggtgtatccgacgtacgactgcgtactctccgatttggaagccgccgcctgtctgctggccgcctacggacacgcgctttgggagggccgcgatccgccggactccgtggcgacggtgttgggtgagctccctcagctgttgccgcgtctggccgacgacgtaagtcgtgagattgccgcttgggaaggccctgtcgccgcgggtaacaactattacgcgtatcgcgactcgcccgatctacgttactacatgcccctaagtggtgggcgccactatcacccgggcacttttgatcgtcacgtgctggtgcggcttttccacaaacgcggcgttattcagcatttgccgggctacgggacgataacggaggagctggtgcaagagcgtctgtcgggccaggtgcgcgacgacgtgctttccctctggagtcgacgtctgctggtcggcaagctgggtcgcgacgtgcccgtctttgtgcacgaacagcaatatctgcgttcaggcctgacctgcctggctggcctgctgttgttgtggaaggtgaccaacgcggatagcgtcttcgctccgcgcacgggcaaatttacgttggccgacctgctgggttcggatgccgtagccggcggcgggttgcctggggggcgcgcgggcggcgaagaggagggctacggggggcggcacgggcgggtacgtaactttgagtttctcgtgcagtactacatcgggccatggtacgcgcgcgaccccgcggtcacgctgtcgcagctctttcccggcctggctctgttggccgtgaccgagagcgtgcgcagcggttgggatccctcacgtcgcgaggacagcgccggaggtggcgacggcggcggcgccgtgctcatgcagctcagcaagagcaaccccgtggccgactacatgttcgcgcagagctccaaacagtacggcgatttacgtcgcttggaagtacacgacgccctgctctttcactacgaacacgggctagggcggctgttgtcagtgaccctgccgcgtcatcgtgtgtccactttgggctcgtccctctttaacgtcaacgatatttacgaactgttgtactttttagtgttgggttttcttccgagcgtggcggtgttgtaatttccaccacgtgtcgcttgctgcataaagggcgagcgtccccggagagggtatattcgttcggcgagagcgggcggcggtggtgggtatgtcctcttctgcggagaagactacctcagttaccgattccatcatgctcgctatcgtgaatttcaaatacatgggcccgttcgaaggctactctatgtcggccgatcgcgccgcttcggacctgctcatcggcatgtttggctccgttagcctggtcaacctgctgaccatcatcggttgcctctgggtgttgcgtgttacgcggccgcccgtgtccgtaatgatttttacttggaatctagtacttagtcagtttttttccatcgtggccaccatgttgtccaagggtatcatgctgcgtggcgctctaaatctcagcttctgtcgcttagtactctttgtcgacgacgtgggcctatattcgacggcgttgtttttcctctttctgatactggatcgtctgtcggccatctcttatggtcgtgatctctggcatcatgagacgcgcgaaaacgccggcgtggcgctctacgcggtcgcctttgcctgggttctttccatcgtagccgctgtgcccaccgccgctacgggttcactggactaccgttggctaggctgtcaaatccctatacagtatgctgcggtggacctcaccatcaagatgtggtttttgctgggggcgcccatgatcgccgtactggctaacgtggtagagttggcctacagcgatcggcgcgaccacgtctggtcctacgtgggtcgtgtctgcaccttctacgtgacgtgtctcatgctttttgtgccctactactgcttcagagtcctacgcggtgtactgcagcccgctagcgcggccggcaccggtttcggcattatggattacgtggaattggctacgcgtacccttctcaccatgcgtcttggcattctgccgctctttatcattgcgttcttctcccgcgagcccaccaaggatctggatgactcctttgattatctggtcgagagatgtcagcaaagctgccacggtcatttcgtacgtcggttggtgcaggcgttgaagcgggctatgtatagcgtggagctggccgtgtgttacttttctacgtccgtccgagacgtcgccgaggcggtgaaaaagtcctccagccgttgttacgctgacgcgacgtcggcggccgttgtggtaacgacgaccacgtcggagaaagccacgttggtagagcacgcggaaggcatggcttccgaaatgtgtcctgggactacgatcgacgtttcggccgagagttcctccgtcctctgcaccgacggcgaaaacaccgtcgcgacggacgcgacggtaacggcattatgagcggcggcgttgtacggcagcggggagaaaagtggcagataaattacgtcaggttcacacgtcgttagccagcgtcggcatatgaagggcgcgggcggccagtacggcctctgggttgagacaggacgaggcagggtgagaaagaggaggatgggggggaccggggtggtggtgctgctgctgttgtgggtgcggacggtgcgggtgccgggacagcgtgccggcgaacgttctgtaatcttccataataaaggtaaaaatgcccgtttcgtgtcgactccgctggatctcgaaggcgtcgggggtaatgcgcatcttgccggtgccgatgagataaaagtaccacattttttgacagatgatgcgaatcaagggttcgtacgcttcggcaccccagtggcgtgtgaagaaggccgccagacgaaacaggcggtgtccgtagagcgtgcctagggagaagaggatgttgccgttgcgcgccaggtcttcggggaaaacgaccggcaggccggtgtggcgctgcacaaagcgcgtcagcagtccgccgctcaagcgcgggtgacacaggcgctggctgagacgggcggcgcgtgtttcatcgaacacggccgcctcaaagtccagccccgggaaggcctggcgcagttcgcggtacagatgaggccagtagggttgcggcgtcttgcggctaagcacggcgtggtccgagacacccaggttgttcatagtttcgcgcagtagcagcgtttcgagaccgcggtgaaagaggaggacgcagatgaggcgtacgattttgagttcttccaaacgcagcgagctcagcggctgtccgcgcgacatcttctcgctaatctgtaatattagatgattggcgcaagtaaaggagaatttgcctgtgcggacccgcgggacggcggggttctcttcgtcgcgggccatcatcgttcgctcggtgagcgggtagcgacggtgacgacaatgacgatggacgagcagcagccgcaggctgtgacgccggtctacgtgggcggctttctcgcccgttacgaccagtctccggacgaggccgaattgctgttgccgcgggacgtagtggagcactggttgcacgcgcagggccagggacagccttcgttgtcggtcgcgctcccgctcaacatcaaccacgacgacacggccgttgtaggacacgttgcggcgatgcagagcgttcgcgacggtcttttttgtctaggttgcgtcacttcgcccaggtttctggagattgtgcgccgcgcttcggaaaagtccgagctggtttcgcgcgggcccgtcagtccgctgcagccggacaaggtggtggagtttctcagcggcagctacgccggcctctcgctctccagccggcgctgcgacgacgtggaggccgcgacgtcgctttcgggctcggaaaccacgccgttcaaacacgtggctttgtgcagcgtgggtcggcgtcgcggtacgttggctgtgtacggacgcgatcccgagtgggttacccagcggtttccagacctcacggcggccgaccgcgacgggctacgtgcacagtggcagcgctgcggcagcactgctgtcgacgcgtcgggcgatccctttcgctcagacagctacggcctgttgggcaacagcgtggacgcgctctacatccgtgagcgactgcccaagctgcgctacgacaagcaactagtcggcgtgacggagcgcgagtcgtacgtcaaggcgagcgtttcgcctgaggcggcgtgcgatattaaagcggcgtccgccgagcgttcgggcgacagccgcagtcaggccgccacgccggcggctggggcgcgtgttccctcttcatccccgtcgcctccagtcgaaccgccatctcctgtccagccgcctgcgcttccagcgtcgccgtccgttctccccgcggaatcatcgccgtcgctttctccttcggagccggcagaggcggcgtccatgtcgcaccctctgagtgctgcggttaccgccgctacggctcctccaggtgctaccgtggcaggtgcgtcgccggctgtgccgtctttagcgtggcctcacgacggagtttatttacccaaagacgcttttttctcgctacttggggccagtcgctcggcagcgcccgtcatgtatcccggcgccgtagcggcccctccttctgcttcgccagcaccgctgcctttgccgtcttatcccgcgtcctacggcgcccccgtcgtgggttacgaccagttggcggcacgtcactttgcggactacgtggatccccattatcccgggtggggtcggcgttacgagcccgcgccgtctttgcatccgtcttatcccgtgccgccgccaccatcaccggcctattaccgtcggcgcgactctccgggcggtatggatgaaccaccgtccggatgggagcgttacgacggtagtcaccgtggtcagtcgcagaagcagcaccgtcacgggggcagcggcggacacaacaaacgccgtaaggaagccgcggcggcgtcgtcgtcctcggacgaagacttgagtttccccggcgaggccgagcacggccgggcgcgaaagcgtctaaaaagtcacgtcaatagcgacggtggaagtggcgggcacgcgggttccaatcagcagcagcaacaacgttacgatgaactgcgggatgccattcacgagctgaaacgcgatctgtttgccgcgcggcagagttctacgttactttcggcggctctccccgctgcggcctcttcctccccgactactactaccgtgtgtactcccaccggcgatctgacgagcggcggaggagaaacaccgacggcacttctatcaggaggtgccaaggtagctgagcgcgctcaggccggtgtggtgaacgccagttgccgcctcgctaccgcgtcgggttctgaggcggcaacggcagggccttcgacggcgggttcttcttcctgcccggctagtgtcgtgttagccgccgctgctgcccaagccgccgcagcttcccagagcccgcccaaagacatggtggatctgaatcggcggatttttgtggctgcgctcaataagctcgagtaagagagacgctatatttagggcttccctctcttttttttctacaccgtgataccctaataaagcacaccgcggttattatcaacgtctctgtttttattatttagaaataaatacagggaatgggaaaaacacgcggggggaaaacaaagaagtctctctctagatgcggggtcgactgcgtggggtgctggaagtggaagcggtgctgatgggcgagggtcgtggcgcgggcacggaccgcaacgtgctgctgatgtctgctgcggtacgcacgtcgccgtccatgtcgctgcgcagataagaggtaggtcgtagtgcggcgtgctgcacgctcaccgttaatggtaccaggtcgtccaagctcgcaaagacgtgccacgaggggatgacgagcgtgagagccccgttgttaccgcttcggcgtctttgtccggtcaggatcagtgcccgggacagtccggcttgggtgtccgagtcctcgtcgccgctggcctcctcgaagccggcaaacatggcctcggacaggggggtcggtgtcggtgtggaggagaggtcatcttcgtcgtcctcttcctcttcttcctcctcttcctcggtgggtggtaatcctggcgattgcgggagaaactcggagacggcgccgcgcatgacgttgctccgtggaaagagaccggcgcgcagctgcacctggggacgcttgatcttgtccggtttaccgggtgtgagagtccaaaacccacggcggaaaaagtggatgcggcctagcggctgtcggtgttccaaatgaacggcctgatcgccggtcagcgtgacgcggagggtgattcgcacacgatcgggtagcgggccggcttctatggagacgcccgggatgttttccgggaaaaaaatggtgtcgtgagtctgattggtctcgaaagcattctggatctgcacgatgtactcgggatgtatgcgcgttagcgtaaaacttttgggaatcaacagctggaagccgttgtccggcaagcgtcgtaggtgcgggtacggattgtgtcgcgccaccacctcggcgcgatgcgtgtaaaccgaaaagtgcagaaacacgctggtcggcgggtgcggtgagtcgtgatgcagaaacagcatgatccattggcctcgctcgtccgtctccgttttgtggatgtacgtgttagggtccgaacaggccagctgctccagggcgtctaccagcgtcagcgggatagcgccggcgcgaaaggcgaactggctgacaaagatctggccggcctccaagctgctgtcggttctgcggcgccagttcggcgttacggtcagtcgcacggcccagtagtgagccgtgcggcggatgatggcgcgcgcctccactcgcggccgattttcttcgccgccgcgccgctggctctgaaagaggtgcagtccgctaacgggcacgcggtccagcggcagtgcaaaggccagtaccgagaccgtgttgttttctgagcctggcgtcaggcgtcgtgggccaaagttgttgaggtccaccagcagtcggtcctgttcgcccaccacgcagcggcccttgatgtttaggtcggtcaggtctacggtgtcgtgcggagatttgttctcctgaaaacagcagagaaccgagggccggctcacctctatgttggtacgcaggtccaggagtcgcagacgaccggcttccagcgagccgccttccacgttggtgatgagccgaagcacctggcagtgcaggcgaccaaagcttccgctggcggcttcggcctcgctgatcgcggccgcttccgacgagggtccctcaccgggcgaggacgatgcctgagacatcgcgaaggcgggatgagggggggggtcaggggatgcgcaaaggtgaacgggtcttcgtgggaggtcgggaagggttccggcaactgtcgcaaatatagcagcggcgacaggtgtggcggccaaaagtcgcgtgtctgagtggacgtgggtttttatagagtcgtcctaagcgcgtgcgcggcgggtggctcaacctcggtgctttttgggcgtcgaggcgatgcatggcccgggcaaggcgtcttgccggtggcggcgacgtttgggttgcgcagcgggctgccatacgccttccaattcggcgaagatgcggtagatgtcgttggcgtcccagaagaactcctggtacttcagattctgaccctgaaccgtagccaccatgggcaccaggttgcgggccaggatgccggcctgccagggcggccaggtgaacacggccggattgtggatttcgttgtcggaatcctcgtcggtgtcctcttcgggcgcgacggtggactcggccttaaggcggccgcgtgtcataacgcccgccgtgcacgccgtcgccgaggatgctgatttgcgtttgcggcccgcggaagtggaggcgcccgccatggcgccgccgccggtaacgcggggcgtcttgcgctcggtggttacgagttcctcgtcggagtccgatccgctggtccagacgtcgtcgtcgccctgggcggcaccctcgtcgtgccggtcccaggtgtgtcggtactcaagcttgccctggatgcgatactggctggtgaaggtggggtgttcgctgtactgaggcccgcgctgcagcagcaagtcgatatcgaaaaagaagagcgcagccacgggatcgtactgacgcagttccacggtctcgcgtatcgcttgcacctccaggaagatctgctgcccgttcatcaataggttacctgagatgctcaggcccgggatgctcttgggacacagcagcccaaaatgctcgtgtgaggtaaaagccacatccagcatgatgtgcgagatcttgcccggtttgattatcatatttttgggacacaacaccgtaaagccgttgcgctcgtgggggcgcatgaagggttgcgggttgcgggtcatcgtcaggtcctcttccacgtcagagcccagcgtgacgtgcataaagagcttgccggagggcacgtcctcgcagaaggactccaggtacaccttgacgtactggtcacctatcacctgcatcttggttgcgcgcgtgttctccatggagcaaaccagctcgtgcgcgcacaccacgtgccgcagtgccacgtccttggtgggaaacacgaacgctgacgtgtagtagacgtcgggctctttccactggttctgctgacgcgtccaggccagtcccgagaccgtgagacgcgcctgccacatctgcttgcccgacgcgtgaatcacagcgtcagctacgggcaggtgtcggtgtttgcgctcggccgccgacgggtagtggtgcacgttgatgctggggatgttcagcatcttgagcggcagcgcgtacacatagatcgacatgggctcttggctggggcagatgctccggcccgtggggttgtgcacgttgaccgacacgttctccacctcgctgcccgtaaagtacgtgtgctgcacctgcagctgattgtcgccgcggtggcatggcgtcgagtcgggcgtgtactgcgacaccaggatcagcgagggctggctcacgcgcacgtggatacccgtctgcaggagtcgcgtctcgtgcggcagcaccggcgtgtcgccgcgactaaacacggctttcagcacgtgccccgaaatgggacccagtacggatatcatttcgggacaacggcgaccgcgcgactccatgctgcctgcgcgtacgggtgtaggcgactgagcggcgcgccctctgcggccgccgccttacataggcaggcgaccagacgcggaacccgaaataaaaacgttctacacagagacaaccgcggattattgagtgtctttttttattaaaaaaaagaggcaaagccccaccgtcaccacaccccatcacacaccaccaccgatttttttgttttaaccccgtatcgcgcggacgcctagtgtccgtttcccatcaccagggttctctgtttagagatcgccgcagaccatggctaaagtgacaggactcgttttctctgtcgtattttccgtaagcttacagtcttgcggttccgtctccggggacgccagccgcatgggcagcaggtcctccaacgcgatggaagcgcccagcaccgagagctgctgttgcgacggcgaatgggacgtggaccgcgagtgtagcgtggatttgacttggtgcgtcattgctgacaggcaaccgcgattcagcgtatgctttgacgagataaaatagaggcgtcccaggagcgcgtcccgtgggaacgtggcgccattctcgtcgctcaccagtacggttaattccaaccaggagcgcggtagccagaccgtaacgggcattttgagtccctgacggttgtgtggtacaaaaacacccagataaggcccgtaaaagcggcggtagatacgtaacgtgtgcgagttcttcagcgtcaattcgtaagggacgcgcacctccagtccctcgtccgccgcgccagagcgtggcggtacaaagtaaggcagtggcgcgtccgaaaagaagggtcgtcgcaccgtttcgcgtcgcagccgcaggcgaaacgccactgggtcggctggcgcctcggtgcggtcgcaggtcacgttgaaacgtaacatgccgtcttggtatagcgtgagtgacgacagcgtcaggtccggcggtgattcgttcgggtctagctccaatcgtccaaagacggagggtcccaatgtcttggccgtggtttccgagaggcgcgccgagatacggctggtgagtccacgcggccccgagatgccgccttccactcgatgccagcacagcgcgtgtcgtacgcgcaccgtcagcgtgggcgtcagatccgcgtccgttgactccgcggcatcggcgacggaagccgcgttctccgttacgttgtttatatccagcgtcgactcgaacgtgagttctggcagatgcagcgccagacagtcgtgtaacgccgtgtgatgcgcggctttacgtcgtagcggtagccgtttcagcagcggcgtgatgatacggagcgcgaagagattgagtgataagcgcacgatggccatgcgcgtcagttgttggtcgattaccgagcgcaggatatggcagcctgggcgtgcgggaaagagagagaaggccgggcgcacgtcagaatcctcgttggagaccacgcatagaatgccgcgttcacgatcgtcgttgcggtcatcctcgtcctcttcttctttcttctcttctttttccttttttttctcgagctcgtgggaagccgccgtttcttcttcttgcgacgtcgcgggggcggtttgagactcgccgttcgcttcccccaattgcagcggcgtagagagcagaatctggaagggatcccgcaattcttcgggtcggaggtcgaggtgcaactggattagatggtaagttccgcggtgcacccgaggctgacggatgtcgtgtttatccgtcaatgtaaggatggtctgcggcgagccgctgtgcttgtccagctcgtccggcgttttcaggaggaggctgtcgtcgtcggtactggcgacgcccatcatggtcgtggtggtagtggtggcgaggaaagtgagcggcggcgccgacagagctcggcgttggcggcggcatttgccgctgtgtcggctgctattgctgccaacgccaccgccgccgcctcgtctggctcgtggccggcgggcccgattccgaaggttggggtcggcgcgtggcatgcttggtgtctgcgggcgcgagagggccggctcagcctttaaatatgcaggtcgcggatttgttatcgggtgaaacgtcacacaccgtgaagacgacctgttcgcggatgaggtcatccagctgtcgcagcatgacgaaaagcgccgacagccgcgcgatctcgtcgtcgggcgacacgtgctgcggccgcgcgggcgtgcgcggctcgccgacgctgcgctcgcggtccagccgcatcagcagctcctggcacttgacgagcagcatggagctgtcctctagcgccaacttgcgcacgtaggtcatggtcagctctgaggctagattggccaccatggacatggagaggcaggcggtcttcatgtcgatcagcaggtgctggtcgatgaccggatcggggatggtgaaggtggcgtcgcgaaaagtaatggtctgcagctgctgcacggcagcctttacctcctcgtacgaacggtcgagcgagaagaggcccatgatgagtagtcgctggttgatttccagcgccagtggcatgggcacgatccagggcagcaccagctcccactggcccagcgtcagcaggttctcgcgcgccagcggtccgtggaagagcggcggcagcacgcatagcgcgtcgcccttctcccaagtcacgggtcccgtgttgaggacggtgtagagcagtccgtgcgtcggtacgtgtaggaggatctggttgccttctacgcgccgcatcaacgtcagcgtcatattgcgcagcaggccgcgcagtcgcacgtagccgcgggtgtgatctacgaactggtgtaggcccagctggtagtgcttgatgagatgtagacgctgcggaatgggcacgactgccgctactagcttggtcagtttgcctacgtcggcgatgctgagcttgtggtcgaaagtgcagaagatgttggcctccatggccgccatagcggcggtgaaatcgtggccgcgacggaggagaagcggagacgaacaacgtctgcaccgggcgcggcgtcagagcgagcgtggcgcgtccgggcccgcgtttgcgtctaggtgactcgccgctaacctgcggtcgtcgccgtcctcctcaccggacggcctcacgagttaaataacatggattgctgcagcgggatgatttcgcctacgacgtagttaccaaagtgcgtctcggacgtggcgaaagccccggcgccacccttgagtttggtctccatcagcgccagcgtggtggtgctgagaatcggcaacgcttcctgcgtcaggcggcacgggttttcgatgagttgttccgtgccttcgacgcagacgtactgcgtgtccgtgtcgccgcggatgcagtccttggcgcgtagtaggtactcgtcgatggttttgaagagcgttttgttggccgcgataatctcttctgtgttaaagtactgcgcacaggggctgtagaatttggagttgtagcccaaacgttcgcgatgtcgggtgttgtacagtacgtcgcttagacagccggcttgcgaggcccaggggttgtgtgtggccgcgaaagtctgtgcgtcagcttcgcgatgatcgtagatggccttggtggcggcctccgtgtcgtacggatcgacgcccagcatgcaggaggcgcgtccgcgcgggttgttggtgattttgaagtaattaacgtccatcgttaccggcgtgaggatgagttcgcacacggccttttgtccgtgcaccgtggcggcggcgttgcgctcggacatgctgccgaacgtcagcatggagatggtctccgtatctaacagttgcggccgttccacgccggccgcgtgccggatccagcggtccacctcgtcgtggcggtacacgttcatagggaagacgcgaaagaggtcttgcacgcggacgcccatgtcggtccgcacgcggtttacgtaggctacgcaggtatttgacgtgtaacccagacccatgtctacggtgttaatgttctgcgtgacgtggtacgtggtgctgatgtcgcgttcctccttggtcacgatgggattgttgatgataactgacgtgcatgatttgccgctgtagagcagcatgtccacctcgaaggtgtcggtgcgtacggccgtgagtgcgaatcccgggtggatgtgcgccttggtctgcagcaccagtgaaactggtgagattttgtataacatggcggccagcgtcataactgagtgcaacacgttgggacaggtggccgagtagcgcgaaaagggcgagcgtagccagttgtggtactcgtgtgcgaaggctgtgggtagcggaaaaccaccgtcgtgacggtgatagtgcgggaactcggtcacgtagcgtttaatgtcgtcgctcaacgccgcgcagatggtggggtttgagtagaaacggtggaaaggtacgggtaggctgtactcgatcagcgtcttaggcgccgtcacgacgcagcagccgttgtaaagcacgtgctgacgtgagataaagtccggcaggccctgacgttgcgcgtgatccagaggcgcgcgcacttcgagcaccttgacgtgctcgcccacgaattgcacggccaaaaacagctcacgacaggcctgcagcagcggcgtatgcgcgtcggtggcgacgtcctccaccagctcggtcagcatctcgcctacggcttgacgttgcgccgctaccgagtcttcgggggtgacgccgcttgtgctctctttcgacgtcgtacctgacgtggagaccgcggtggcggccggcatcaggagaaacgccggtcggtaaaagaggtctactagcagcgtcttgaggttgagtcccaggccgcaggcccggttgttggtcatggcgggtatgaggcagagataaaagaccttttgtaacgtccattcgtcgtcggtggcacggtaatcgtccacaaacagcggctcgtcggcatccatggcgcccaaacgcggtacgtcagaaacgccgtggtgtcgcgcctcgatgttggccgggttcaacggttgccggtcggccactacctgtacgccttccatattacgcggcaggtgcgtaacgaaggggggccacagccggtggtcgtgcagcgcgttcacgtaagccgatagcggttcctcggccagttgaccgttgttaagccccggcagcgctgagatgcgcgttaccagacgcagcacggcgactagattgcggtagtgaaagagcaactgcggtggtagggcgccatcggccaggtgttcggcgatcaacgtcaccagcgcgtagctgtgtgcaaaaaccagcagctgacgtgtgtgaaacatgttgacgatacaacgtgctatgaaagcgcggattagcaaaaaagcgtcggcgttgccgtgtaccagtacgtcgaccaggtagcagagctcggggtaattggggctggtcacggtggttttgaaaagtcgcaacgtctcttcgtagtcgggtggtggccgcagtcgcatgtgttccatgatctcccaggtgcgcagttcgtggaaggggcccggtgccagtccatctggcaaattaccgatgacgatacgcggcgtacacagcgccaccgtttcgctgttttcctggcagtgcgtaaagtcgaagaaggggtgcagctcggtgtagagcgtgatgttgcccaccttgtagaagtcggtgaccacaaaatcctgcttcatttcgttcaccgtgcgcgggacctcacgccgtacgcggtaaaaatgtggtatgcggcgcgccgcaccgcccatgggctcctgctgaaaacgacattcgagcagccgttgcatggcgggttccgagggcggtccgcgttccgtgaaggcctgcagacagggcgcgggttcatgcagcaccgggtggcacagcgtcttaagcgcgtccacaaagtctatcttttgcacggcacggtcccggtttagcaggtaggccgtggtgggcagcgcgttgcggacggtgtcgttgagcttaactttgctttccaccgtggtgtaaccgcgatcctcgggcagatacagccctacggggaagaaaaacgtcaggtccacgttacgttctagcggatctttggtatcggtgtttttgtagacgcgccgcaagttttccataatcaccgttttttcgcccagtcgaatcacatccatgcttagtggcgttaggctgtgcgccccggcctgcgaaagcgagtcgttgggcagatgcggttgacccgaagtcagatgggccttgtatgagttgaaatcggccaggatcgagtgataggaaatggcggtgacggcgttttcgggactgagcacaaagttgccgtaggtggccggcgccgagaccgtctctttggtgatgtggcttgagagcagcgacatgatgatctgcataacgttggccgtgcttaccatcacgccgctgatcttggcccccgagctcgtggtatacgtggtggggttgtctaggatgctatcggtggccgcttcggccagacgcgtgaggaacttgagcacatagtcgcgatcgcgcgtgcgattcagcaaaaagagcgtggccagcattttggccttgaagctctgcaagatgttgcttcgctggatgcggttcaatgcctgtcgcgccagcgtggcgttttctaccagcgtctgcaccacaaagtacggcggcgccttgcgtagcagtgtctgtaaaaagctgtgaatcaagccgcgctccatggcgtcggccgtgtttttaagcgcgcgcagcaccgtgtgcatggcttccacgttgaggatcttgtccaagatggtgccctcgaatgtctcgcgcagatacgtgaggcaggctgcgctgagctcgaaggggatggtgatgggggatttttcactgtatttggtgaccataatggtggtctgacgactggtgggcaaaccggcgccgctggccacacgcggcacctgcacgtggaacagcattttgcccgtagtcagtttattgaggtcgtggaacttgatggcgtgcgccgccgcggccaagccgctggtcaaaaaataaacccattccaggcgattgcagaaggtgccgaagatggcttcgaagtgaatattgtaacgctcggggtcgtcgccgtagtagatgcgtaaggcctcgaacatctcctcgccggcgctggtcttgacgtgcgtcagaaagtcagtgggaatgcctactttaggcaggagctcgagcgccgaccagttctccatcgcggcggcggcgtgagcgcgaggcgtcggagctcggggaaagcagcgcgacccggagaatggccggcgctgcgccgcgccgcctcggctgcgacgctctaatagtcgtcggcggctccgctacgccgcgccgggttttacacgtccccgtgcacgttcgcgcctgcaacctcacccaagagctatcgacgggcgaggacgcccgcttctgtcgtccgcgacccgttaacgtcgaacgggtacgcgctgttttcgcggctctctaccgtgcctgtcccgtacacgcgaggaccgagtccgagcgtgtcaagctggtactgggtcgtctgttgctgggacccgtggccgtaccctgtttttgcgacggtgaagtggagggccacggcgagcatctggtacccacgacgcagttttgtcgcgggccgctgctctacgtgcaccgacgttgttgttgcggatccgtgaccgccgggcgcgcgctgtcctaccacgttctcgaaaaccacgtggccacgcatgtgttacgcggattgctctcgctgacggaatggaatcgagagttgccgggccttttttgcgactgtcctggcagcggtggcgccttgggaaccgaggaacgctacgccatggcctgcttgccgcgcgacctcagcctgcacctggacgactatccttacctgatggtggaaatcggacgcgtactcagcgtcagcgaggtagacgactacgtaaccgccgtctccggctacctgggcgaggccgcggcgccgcgcattcaggttcactacaagctgctctttggactcaacgtgcgtccgcaagcgccgtgcgcgttggacgctacacgcgacttttttctgctggagctgcaaaagctttggctgggcgttgaatatcaccacgaagtcacgtcggagtttttcggtcgcgtactggctcagctgcatcgcgaccgcgcccgcgtcatgatggcacttcgcttgcccgagcagacggtgtgccacctaagcaccttcgttctcagtcgcttcaagcgacaggtactgtacttcaagttacaggtgagctacggcaagtgccggactggccacgctgacagaagtgggggagggggaaacggtggaagtcagggacaccacaacctactgtgttatcgacgtcttagcgtcacgtttgccgacacggacacggtgtggagaaaccttttctacgtttattatgaactagctcgggatctggggtcccatgggacagaggaccgatccgtaagccgcggttacggtgtttcttgcgctccgaggacgtcgcggctaccaccgtcagaaccgacggtggtttcagccaacggacacgcgctgtcttccaccgcgctcccgacgacgagcgcgggtcacaagctgtcgctgccgcgcgacccggccgcagatcgcgttcgacgttacgtgtgcattatctcgcgtctcatgttcgcccggtatggggagagatggcgtaaacaccgtcgacggcggtcggagacgggagaagaggaggaggaagagacggtggaatcgggggagactgacgccacgccgccatttgactttacggggcagcagctgcgccgggcctatcaggaacaccgacgtcgtaaacatctagccgtgcagcgttacgcgccgtgccgtcgtaagctcatcggcgggatggagtttgccgaggtgacgggcgttagtctggaccgcatcgccgtcaacgctttcaacaccaaccgcgttatcaatatgaaggccgcactctcgtccatcgccgcgtcgggtctcggcgtgcgcgcgccgcggcttcccaagaacatgacccacagttttgtgatgtacaagcacaccttcaaggagcccgcttgcaccgtcagcacttttgtttccaacgacgccgtctacatcaactcgctcaacgtcaatattcgcggttcctatcccgagtttctgtactcgctgggcgtgtaccggctgcacgttaatatcgatcacttctttctgccggccgtggtgtgcaacagcaactcctcgctggacgtgcatgggctggaggaccaggcggtgatccgctcggagcgcagcaaggtgtactggaccaccaactttccgtgcatgatctcgcatactaacaacgtcaacgtgggttggttcaaagcggctacggccattgtgccgcgcgtctcgggcgctgacctggaagccattctgctcaaagaactctcgtgcatcaagaacatgcgcgacgtgtgcatcgattacggtctgcatcgcgttttcacgcaactagagctgcgcaattcgtaccagatccccttcctggccaagcagttggtgctgtttctgcgtgcttgcctgctcaagctgcacggtcgagagaagcggctgcagttggaccgcctagtatttgaggcggcacagcggggtctctttgactacagcaagaacctcacggcgcacaccaagatcaagcacacttgcgcgctcatcggcagtcgtctagccaacaacgtgcccaagatcctggcccggaacaaaaaagtcaaattggatcacctgggccggaacgccaacgtgctgacggtgtgtcggcacgtggaagcccacaagatccctcgcacgcgcctcaaagtgttagtcgaggtgctgggcgcgttgcagagtatcagcggtacgccgcacacgcgtgaagtgatccaccagacgttgtttcgattgtgctcggcggccgcagccacctcgggcctgtgttcatcccctcccccattgtgtgtgtcctcatcttcctccgccccttctgtcccaacctccgtcagcgttgacggcagttctgaacccacgtcgccgcgagcgcggtttgcatcacgatgatggaagccgcggccgctgccgccgcggcgtttcgtccggaggagcgtccgacgccgggttggcacgacgcagcgttgttaatggacgacggtacggtgcgcgagcacgcgtttcgcaacggaccgctgtcgcaactgattcgccgtgtgttaccgccgccgcccgacgccgaagatgacgtggtttttgcttcagaactgtgtttttattgcagcggtcgttttaaccgcaggtcgtccgtcttctccatctattggcagaagcatagcgatctggtatacgcgcttacgggcattacccattgcgctaagttggtggtggaatgcggtcagttggggagtggtaggctacggtggcgcgacggtgacgtgggtggtgaggagcgccggggagacgacgacagcagggacgagctgtacgacgtgccgggaatttacatgatccgcgtcaacgacggcggcagcaccggccccaggcacgttatttggccgggtaccagcgtgctttgggcgccggacgtggtgatcactacggtgcagcgacgaatctcggcggcgcgcgccctggtgaacacgttccgccagtatttttttttgctggaacggcgctcgcacgaggagctggttctttgtccgcccgagatggaggagcgtctagcgccgttgttgcagagtgccacgcgtggtgattcggacatgtttgacggtgtggtggccagcgcttatcaccgtttgcgaataagtaatattccgcgttcatccgcccgtctgctggagcactgcgtggggctggcaggtgctaagaagctgctcttgctcgacgtgccgcgtctggagaactattttctttgtcaagtctgtctttacgagctggacgaggacgagatgggcgaggagatgctgggtatgttggccggaaagcccgaggacgccgccgtctcgggcgcaagcggcggttttctgctacatcgcaagacgatgaagctggccgcctgtctatgtttgctgctcaattcgctgcatttgcaccaggaggcgctggaggccttggatcctccgccgccgcgcgtcgaggagaacgaccttgtcaacgtggtgctgcgccgttactatcgcagtcacggcggcgtgcaggcgcggacgttggcggcggcccgggctttgttagccgactacgccgaaacgttttcgcccttggggagttttacgcgcctgggttacgatcgtctcgtttctgccgatgccggcgtcagtcgccggcacctggtggctctgctgcgtgcctagctgaccctgaaacggatggcgtgtatctcgtcacacaggtaggtggccatgatgacggctatgataagatcgtccgagatacgattctggcgcttggccgagtagcgtgccgtcgtgccttcggccagcgtgacgcggtgcaggttctgaatctgctccagaagatactcgatggggtcgtggctcagcttgatggtgtaggagacgagctcttgcgaggctttgatgtagcccgagttgaaacgcgagatgaactgttctacggccagcgccttgtcgcggcccatgaggtagaagggctgttcgatgtggttctggtcgggcgtgtggtagaagagcacgcggatgagcgtgctactctgcacgctctgtcggatgaggcaggcgatgcgcacggccgccgcctggttagtgttgccctccacggcgatacgcagttcgtccaggtaagggtgcaggctcagcaccgagatgatcatgtgcgccgcgcactcggcgatggctacctcagaactctcggagaggtcgcgcaaaaagaaatgctctaggccgtaaatgagaaactggtgtcggtaggcgcctacggccgccacgcccgtgcccgaggccttgcggttggtggtgaaggccgggtccagatatacgtagagcgtcttgccgaaataatcgtaggcgttggtgttgagcgtgctgtaacgcaaaatatcgaactcttcgcggctctggtccgtgatgagcacggtgttttgcgagatcttattggtaccgccgatgatctcgtccatgaaggcgcccggcataaacatgttggccgtcttgcgcacctgcgagttgaggctgatgaaggtgggcttgtgcagtcggtagcaaggacaggccgtggcgtcgcccttctccgtgaagctgtgcaggtgctcttcgcacacgtaagagaccacgttgagcatgtcaaagggcgcattgttgaggcgcgtcaagaaacacgtggcgtcactggtagtgttggtggacgatatgaagatgatcttggtggtattctgtgccaggaaccccagaatggtgttgaaggcctctttcttgatgaagtgcgcctcgtccaccagcagcaagtggaagttttgtcctcggatgctctgtgtagagaggagacagaaaagggactcttatgattacgcacgctcggctggaagcctacagagtcggggtggggccggacaggtgagccaggtgagccgccaggtgaggcgggatcgccgtgtgccaaccgggctgcgacctgaaaaccggaaccaatccgccgacaccggcgccgcgtgacgcgcgcccataaaaacgaaagtgtcgtcgtcgcgacccgccacagccgccatgaactcgttgctggcggaactcaaccgactgggggtcgcgcacgccactacggaggatgtttttatctttgtcgaccgcctctttcaacacttttccttccttttccaggccgaggagtcaggcccgcgccgcttggaactggtcgcgtccgtgttcgagcacctgacggtggagtgcgtcaacgacatcctggacgcctgcagccacccggacgtgaacgtcgcggagacaagcaacacctgtcgtccctgcccttctcctgttccctccgcccccaaaactgtcagcgacgctcagacgtcatgtgcgacgtctcgggcgcctgtgacatgaggcacgtccagaacgcgtttaccgaggagatccagttacactcgctctacgcgtgcacgcgctgctttcgcacgcacctgtgtgatctgggcagcggctgcgcgctcgtctccacgctcgagggctccgtctgcgtcaagacgggcctggtatacgaggctctttatccggtggcgcgtagccacctgttggaacccatcgaggaggccgcactggacgacgtcaacatcatcagcgccgtgctcagcggcgtgtacagctacctcatgacgcacgccggccgttacgccgacgtgatccaagaggtggtcgagcgcgaccgcctcaaaaagcaggtggaggacagtatttacttcacctttaataaggttttccgttctatgcataacgtcaaccgtatttcggtgcccgtcatcagccaactttttattcagcttatcatcggtatctactcaaagcagaccaagtacgacgcgtgtgtcatcaaggttagtcgtaagaagcgcgaggacgcgcttctgaaacagatgcgttccgaatatggaaacgcacctgtattcggatctggcgtttgaggcgcggttcgctgacgatgagcaattgcctctacatctggtgctcgaccaggaggtgctgagtaacgaggaggccgagacgctgcgctacgtctactatcgtaatgtagacagcgctggccgatccgcgggccgcgctccgggtggagatgaggacgacgcaccggcctccgacgacgccgagaacgccgtgggcggcgatcgcgcttttgaccgcgagcggcggacttggcagcgtgcctgttttcgtgtactaccgcgcccactggagttgctcgattacctacgtcaaagcggtctcactgtgacgttagagaaagagcagcgcgtgcgcatgttctatgccgtcttcactacgttaggtctgcgctgccccgataatcggctctcaggcgcgcagacgctacacctgagactggtctggcccgacggcagctatcgtgactgggaatttttagcgcgtgacctgttacgagaagaaatggaagcgaacaagcgcgaccggcagcaccaattggccacggccacgaatcaccgtcggcggggcggactgcgtaacaatttagacaatgggtcggatcgccgattgcccgaaacggctatggcttctttggagacggccgtcagtactccatttttcgaaattccgaacggagcaggaacctcctccgcgaatggcggcggcagattcagtaacctggagcagcgggtagcgcgtttgttgcgcggcgacgaggaattcatctatcacgcgggtccattggagccgccttccaagatacgcggtcacgagttggtgcagctgcgcctggacgtaaatccagacctcatgtacgccaccgatccgcacgaccgagacgaggtcgcgcgtacggacgagtggaagggcgccggcgtctcgcgtctccgcgaggtttgggatgtgcagcatcgcgtgcgcctccgtgtgctgtggtacgtcaattccttttggcgcaatcgcgagctgagctacgatgatcacgaagtcgaactataccgggcgttggacgcttatcgggcgcgcattgccgtcgagtacgtgctgattcgcgccgtgcgcgacgagatctatgctgtactacgacgggacggcggcgcgttgccacagcgtttcgcctgccacgtgccacggaacatgtcctggcgcgttgtttgggaactttgccgtcatgccttggtgctctggatggatcgggcggacgtgcgtagctgtattattaaggcgctgacgcctcgtctgagccggggtgccgccgctgccgctcagcgagctcgtcgccagcgcgagcgcccggcgcccaaaccgcaggagctgcttttcgggccgcggaacgagagcggtccgcccgccgaacggacttggtacgctgacgtggtgcgctgcgttcgcgcgcaagtggatttgggcgtggaagtgcgcgcggcgcgttgtcctcgcaccgggctttggatcgttcgtgatcgccgcggacgcctgcgacgttggctctcgcagcccgaggtgtgcgtgctctacgtcacgccagacttggacttttactgggtgctgccgggcggctttgctgtgttctcgcgcgtcactcttcatggcttggcgcagcgggctttgcgagaccgattccagaactttgaagcagttcttgcaagaggaatgcatgtggaagctggtcggcaagagtcggaaacaccgcgagtatcgggccgtcgcttgccgttcgacgatctttagtccggaggacgacagctcgtgtatcttatgccagttgctgttgctctaccgcgacggcgaatggatcatctgtttttgctgcaacggccgttatcaaggccactatggcgtgaatcacgtacatcggcgtcgtcgacgcatctgtcatctacctaccttgtaccaactgagcttcggaggtcctttgggtccagccagcatcgatttcttgccgagctttagccaggtgaccagcagtatgacgtgcgatggtattacgcccgacgtgatttacgaggtctgcatgttggtgccccaggatgaagccaagcgtatcctggtcaagggtcacggtgccatggacctgacctgtcagaaggcagtgacgctaggcggcgccggcgcctggttgctgccgcgtcccgaaggctacacgcttttcttttacattctgtgttacgacctgtttacctcatgcggcaatcggtgcgatatcccttccatgacgcgcctcatggcggcggccacggcctgcgggcaggcgggttgcagcttttgcacggatcacgagggacacgtagatcccactggcaattacgtgggttgcacccccgatatgggccgttgtctttgttacgtgccctgtgggcccatgacgcagtcgctcatccacaacgaggaacccgcgacttttttctgtgagagcgatgacgccaagtacctatgcgccgtaggttctaagaccgcggcgcaggtcacactgggagacggcctggattatcacatcggtgttaaggattctgagggccgatggctgcccgtcaagaccgatgtgtgggacctggtcaaggtagaggaacctgtgtcacgtatgatagtgtgttcctgtccggtgcttaagaacctagtgcactaacggggtctgacagttcacggggagaagaaacaagaaacaacaaaaaaaggaggacatggactcgccacggtttgtggcaaggcgtatgttatcatcatggagctactcacgttggtgttgtagcaactggcaaaaagcgccgtgctcttggcgccgcggtggtcgatgctgatcacgttgtccttgttctcgaccacgtagtcgcgcgcgaaggtgtggcggcagcggaactcgacctctttgagcacaaactgcgacacgtgcttttggtgcgccacgtagccgatgctgatgccgatcatgtgcttaagcagaaacgagataatggggatgatgaaccaagtcttgccgtgacgtcgcggcaccaggaacacggtggctttctgcttaaagatgtcgatggaggtctgcgagaggaagtcgatctggaaggcgtggatgaggtactgcagcacgcgattggccagcacggggatcttggtcacggctataaaaaagatgacgtgtatcaataaattcttttgaaacggttcgagtcggatggcttttgcgtcgccctcgacggcggtactgaagccgccgtcgagccactttttaaagtcggtcatgaagttgttgatctgctgaaactgcggatcgcggtagagctcggtcaacgcgtccagcttctggtaggaggcgcgctgctcctcggagcacgggcgaaacgtcagttcatcgagcgcgctcttgaggcgctcgtgaaacagcagctcgcgctggctttcctcgggcgagttgtagtcgcggtggcggccgcagaaggccatgagcggcaggaaggcctcgttgcacgagtgggccagcccgagttcggggtgcatcatctggtagcgcttgcggcacagcgccgccacattggtgaaggccgtggagatgcaggaggtggggtggctcttgcgcttctgcagctccgcgtagcgctcctggatcttggcggccgagtctccgcgcaacatgatggcggcggcggtggtgcgagcggaggttaggcggcagcggcgagaggagaggaaaaagatggcggccgcgaggacgacggaggatccacccgaaaaccacgttgttgcggacgtggcttgtgggacgggcgccgtcactcgttcgtcttcgtcgtccctagtggtgtcgtcttcctcggcgtcaggctcggacgaaccttcctccgcctctcctctcagtttccccgtctgctccccctcaactgccgtcaggtctccggggtccgccggggtttcaacgtccctgtgctcggtggaacggatggtcgagctgtcggcgcagtctccggccgccgatttctcggtctccgaggcttggcgcttcgaggaggccgtaaatatggcgctggtggcctgcgaggccgtgtcaccttacgatcgctttcgcctaattgaaacgcccgacgagaatttcttgttggtcaccaacgtaattccgcgcgagtcggccgaggtgccggtgttggatagcagtagcagcggtggcgatagcgggccggaggacaaaaagaaaaacgtcgggaataaaaccgcgggggaaaagaacggcggtgggtctcgggccaaacgccgtcgtagacgacgcgctccgaaaaacgacgccgccacgccgtcttttctacgtcgacacgacgtgctggagcgtttcgcggccgcggctgagcctttgccgtcgctttgtgtgcgtgattatgcgttacgcaatgctgaccgtgttacctacgacggcgaattaatctacggcagttacctgttgtatcgcaaggctcacgtggagctgtcactctccagcaacaaggtgcaacacgtggaagccgtgctgcgacaggtgtacacgccgggcttgttagatcatcacaacgtgtgcgacgtggaggccctgctgtggctgctgtactgcggaccgcgtagcttttgcgcgcgtgacacctgtttcggtcgcgaaaaaaacggttgtcctttccccgcgttgttgcccaaactcttttacgaacccgtgcgggactatatgacctacatgaatctggctgagctgtacgtctttgtttggtatcgcggctacgaattccctgcgccgacgccgcaggcgacgacggcgggtagtggtggcggcggcggggccggcgcttgtgcggtcgagacgagcgcgtcagcaggccgggtcgatgacgccggcgacgaggtgcatttgcctttaaagcccgtctcgctggaccgtctcagagaggtgttgcaggcggtgcgcggccgcttctcggggcgcgaggtgcccgcctggccggcctcgtcgcgcacctgtttgttgtgcgcgctctacagtcagaaccgtctctgtttagatctcgcgcgtgacgaggcgcggaccgtgagttatagccccatcgttatccaagactgcgccgcggctgtcaccgacgtcactttgagccacatcttgcccggccagagcaccgtctcgcttttccccgtctaccacgtcggaaagttgctggacgccctctcgctgaacgacgcgggtctcatcacgttgaatctatgacgtcggtcaacaaacagctcttaaaggacgtgatgcgcgtcgaccttgagcgacagcagcatcagtttctgcggcgtacctacggaccgcagcaccggcttaccacgcagcaggctttgacggtgatgcgtgtggccgctcgggaacagacccgatacagtcagcgaacgacgcagtgcgtggccgcacacctgttggagcaacgggcggccgtgcagcaagagttgcaacgcgcccgacagctgcaatccggtaacgtggacgacgcgctggactctttaaccgagctgaaggacacggtagacgacgtgagagccaccttggtggactcggtttcggcgacgtgcgatttggacctggaggtcgacgacgccgtctaacaggtatagcaatccccgtcacgcctctgttcagattttattaaaaaaaaaaaacacaacataacgacagtgtcggtgtggtagctagtgcagctctaggaacagggaagactgtcgccactatgtcctccgcacttcggtctcgggctcgctcggcctcgctcggaacgacgactgagggctgggatccgccgccattgcgtcgtcccagcagggcgcgccggcgccagtggatgcgcgaagctgcgcaggccgccgctcaagccgcggtgcaggccgcgcaggccgccgccgctcaggtcgcccaggctcacgtcgatgaagacgaggtcgtggatctgatggccgacgaggccggcggcggcgtcaccactttgaccaccctgagttccgtcagcacaaccaccgtgcttggacacgcgactttttccgcatgcgttcgaaatgacgtgatgcgtgacggagaaaaagaggacgcggcttcggacaaggagaacctgcgtcggcccgtggtgccgtccacgtcgtctcgcggcagcgccgccagcggcgacggttaccacggcttgcgctgccgcgaaacctcggccatgtggtcgttcgagtacgatcgcgacggcgacgtgaccagcgtacgccgcgctctcttcaccggcggcagcgacccctcggacagcgtgagcggcgtccgcggtggacgcaaacgcccgttgcgtccgccgttggtgtcgctggcccgcaccccgctgtgccgacgtcgtgtgggcggcgtggacgcggtgctcgaagaaaacgacgtggagctgcgcgcggaaagtcaggacagcgccgtggcatcgggcccgggccgcgttccgcagccgctcagcggtagttccggggaggaatccgccacggcggtggaggccgactccacgtcacacgacgacgtgcattgcacctgttccaacgaccagatcatcaccacgtccatccgcggccttacgtgcgacccgcgtatgttcttgcgccttacgcatcccgagctctgcgagctctctatctcctacctgctggtctacgtgcccaaagaggacgatttttgccacaagatctgttatgccgtggacatgagcgacgagagctaccgcctgggccagggctccttcggcgaggtctggccgctcgatcgctatcgcgtggtcaaggtggcgcgtaagcacagcgagacggtgctcacggtctggatgtcgggcctgatccgcacgcgcgccgctggcgagcaacagcagccgccgtcgctggtgggtacgggcgtgcaccgcggtctgctcacggccacgggctgctgtctgctgcacaacgtcacggtacatcgacgtttccacacagacatgtttcatcacgaccagtggaagctggcgtgcatcgacagctaccgacgtgccttttgcacgttggccgacgctatcaaatttctcaatcaccagtgtcgtgtatgccactttgacattacacccatgaacgtgctcatcgacgtgaacccgcacaaccccagcgagatcgtgcgcgccgcgctgtgcgattacagcctcagcgagccctatccggattacaacgagcgctgtgtggccgtctttcaggagacgggcacggcgcgccgcatccccaactgctcgcaccgtctgcgcgaatgttaccaccctgctttccgacccatgccgctgcagaagctgctcatctgcgacccgcacgcgcgtttccccgtagccggtctacggcgttattgcatgtcggagctgtcggcgctgggcaacgtgctgggcttttgcctcatgcggctgttggaccggcgcggtctggacgaggtgcgcatgggcacggaggcgttgctctttaagcacgccggcgcggcctgccgcgcgttggagaacggcaagctcacgcactgctccgacgcctgtctgctcattctggcggcgcaaatgagctacggcgcctgtctcctgggcgagcatggcgccgcgctggtgtcgcacacgctgcgctttgtggaggccaagatgtcctcgtgtcgcgtacgcgcctttcgccgcttctaccacgaatgctcgcagaccatgctgcacgaatacgtcagaaagaacgtggagcgtctgttggccacgagcgacgggctgtatttatataacgcctttcggcgcaccaccagcataatctgcgaggaggaccttgacggtgactgccgccaactgttccccgagtaaccgggacgcggaacgtgacggttgctgaggggaaaggcgacagagaaggtacaaacccaccggcggggaaaataccgaggcgccgccatcatcatgtggggcgtctcgagtttggactacgacgacgatgaggagctcacccggctgctggcggtttgggacgatgagcccctcagtctctttctcatgaacacctttttgctgcaccaggagggcttccgtaatctgccctttacggtgctgcgtctgtcttacgcctaccgcatcttcgccaagatgctgcgggcccacggtacgccagtagccgaggactttatgacgcgcgtggccgcgttggctcgcgacgagggtctgcgcgacattttgggtcagcggcacgccgccgaagcctcgcgcgccgagatcgccgaggccctggagcgcgtggccgagcggtgcgacgaccggcacggcggctcggacgactacgtgtggctcagccggttgctggatttggcgcccaactatcggcaggtcgagctcttccagttgctggaaaaggaatcgcgcggacagtcgcgcaactcggtgtggcatctgttgcgtatggacacggtttcggccaccaagttctacgaggccttcgtcagcggctgtctgcccggcgccgcggcggcggacggttcgggtggcggcggctcgcactacacgggctcgcgcgccggcgtctcgccaggcatccagttcggtatcaaacacgagggtttagtcaaaacgctggtggaatgttacgtgatgcacgggcgcgagccggtgcgcgacggcctcggtctgctcatcgaccccacgtcggggctgctgggcgcttccatggacctgtgcttcggcgtgctcaagcagggcagcggtcgcaccttgctggtggaaccgtgcgcgcgcgtctacgagatcaagtgccgctacaaatatttgcgcaaaaaggaggacccctttgtgcagaacgtgctgcggaggcacgacgcggcggccgtggcctcgctgttgcagtcacacccggtgccgggcgtggagtttcgcggtgaacgcgagaccccgtcggcacgcgagtttctgctttcgcacgacgcggcgctcttcagggccacgctcaagcgcgcgcgcccgctcaagccgcctgaaccgctgcgcgagtacctggccgatctgctgtatctcaataaggccgagtgttcggaagtgatcgtgtttgacgccaagcacctgaatgacgacaacagcgacggggacgccacgaccactattaacgcgagtctcggcctagccgcgggcgacgccgctggcggcggcgctgatcaccacctgcggggcagcccgggcgattcgccgccgccgatacctttcgaggacgaaaacacgcccgagctgctgggccggctcaacgtgtacgaggtagcgcgcttttcactgccggcttttgtcaatccgcgtcaccagtattactttcagatgctcattcagcagtacgtgctcagccaatactatataaagaagcatccggacccggagcggatcgatttccgcgacctgcctaccgtctacctggtctcggccatcttccgcgagcgcgaggaaagcgaactgggctgcgagttgctggccggcggtcgcgttttccactgcgaccacatcccgctcctgctcatcgtcacgcccgtggtctttgaccctcagtttacgcgccatgccgtctctaccgtgctagaccgttggagtcgcgacctgtcccgcaagacgaacctaccgatatgggtgccgaactctgcaaacgaatatgttgtgagttcggtaccacgcccggtgagcccctgaaagatgctctgggtcgccaggtgtctctacgctcctacgacaacatccctccgacttcctcctcggacgaaggggaggacgatgacgacggggaggatgacgataacgaggagcggcaacagaagctgcggctctgcggtagtagctgcgggggaaacgacaatagtagcggcagccaccgcgaggccgcccacgacggctccaagaaaaatgcggtgcgctcgacgtttcgcgaggacaaggctccgaaaccgagcaagcagtcaaaaaagaaaaagaaaccctcaaaacatcaccaccatcagcaaagctccattatgcaggagacggacgacctagacgaagaggacacctcaatttacctgtccccgcccccggtcccccccgtccaggtggtggctaagcgactgccgaggcccgacacacccaggactccgcgccaaaagaagatttcacaacgtccacccacccccgggacaaaaaagcccgccgcctccttgcccttttaacccataaactttcaggtctcgcgtacgattcgcgagtcgggaatgggacacccgtgggtgtttctccgtgtgtatattattttttttttgtgtgtgtttgcgcccccgtgtgtctaatgtgctgtttgaaacacgtaaagtagctggtggaagaacagataaacctttaataaaaaaaaaagtatgtgctcccgacccacggtctgcgtgtctcttttttatgtccatgtctccaagtctggtgcgggtggcggcggggtcaagcgtcctcgaagtcttcatcatcgtcgtcgtcctcttcttcgcggaggcgacggctttccaagctgtcgtggtgactgagtgcagcgacttcttcgccggaggctgtggccagcgcctggtacttaacactgccgctaccgcgtccgcgaaagtaacggacggcgcgacacgtcgtaaacatggcccatatgaaaaagagcatgccgaacgaccagctgatgccggtgcggtattcgttgctgaggaaggtatcgtactgcacgatggggtagatgaggccgcagagtccaaagaaggcgcccaggtggtagccgaattgcaccttgacgtattgaaaaaagacggcctcgatcagtaaaaagtagatgatggagatgatagcgtagaccacgaagacggctaacaccatgtggcctgtacgcacgaaaaagttgtttctgaagccgtagcatagggccatggctaccacggtggtgttgaaaccaagcgctacctccaccaggttgacgatgagcgtgcggaactgcaccgtacctttgagcttggggtgcagacgcgagaagaaaaagagcgagcgtttgtagctgcggtactgcgtgaccatgctcacgttgaaaatggtcaggcagaaaaagtgcacggcggccatgaaggcgatcatgctgggcagccgaaatgacatggtcagtgtgaatagttggaatgtgtccatgctgaggatgaaaaggaaggctgtgaggctgtcgcccatgtacgagatgtcgcgtgtcgactggtttaggctcatgcctttgtccttgcgcatgctgatcttgatccagcataccaggtagtagatggtcacggctaaaaagacgagctgcatgaacacggcgtagcacaccagctgcaccgagtctaagaaaagcataggcgtgtgcaggtgcattacgttgtaggccgacatgttgagcctttcaaagtccacgacgtgatagtagacgcaggggtagcccaggtgcggaaaattgctcagcaccagatgcacgctgacgttgacaaaagtcagcaccatgaaaacgatagaagcgctccatgtccgtgtattcaccttatccacgtgcgagggggccatggcgatagcggcggcccgctcgctcgggaggcgatgggggcgcgccgatgacgacaggctcgcgggtcgttaaatactacgatgggagccgccgcggctcacgacgcggtttgagcgcgtccgggcggtcggcgaaaaaagaccccgcgggccttcgcgactctcttctgtccgaggatgaccgctcagccgccgctgcaccaccgccaccacccgtacgccctgttcgggaccagctgtcatctcagctggtacggccttctggaggcctcggtgcccatcgtacaatgtctgtttttggatctgggtggcggccgtgccgaaccgcggcttcacacgttcgtggtgcgcggtgaccgtctgccgccggctgaggtgcgtgctgtgcatcgcgccagctacgccgcgctggcctcggccgtgactacggacgccgacgagcgccggcgcggcctagagcagcgtagcgccgtgttggcgcgcgtgttgctagaaggcagcgcgttaatccgcgtgttggcgcgcaccttcacgccggtgcagattcagacggacgctagcggcgtggagatcttggaggccgcgccggcattgggcgtggaaaccgcagcgctgtcgaacgcgcttagtcttttccacgtagccaagttagtggtcatcggctcgtatcccgaagtgcacgagtcgcgtgtggtcacgcatgccgcggaacgcgtctccgaagagtatggcacccacgcgcacaaaaaattgcgtcgcggttactacgcctacgatttggccatgtcgtttcgcgtcggcactcacaagtatgtgctggagcgcgacgacgaggccgtcctggcacgcctctttgaggtgcgcgaggtgtgttttttgcgcacctgtctgcgtctggtcacgcccgtcggtttcgtggccgtggcagtgaccgatgagcagtgttgtttattgctgcagtcggcctggactcacctttacgacgtgctttttcgtggtttcgctgggcagccgccgctacgcgactacctggggccggacctctttgagacgggcgctgcccgttctttcttttttcccggtttcccgcccgtgcccgtctacgcggtccacggtctgcacacgttaatgcgcgagacggcgttggacgcggcggctgaggtgctctcgtggtgcggcctgcccgacatcgtgggctcggccggcaagctggaggtggaaccctgcgcgctctcgctcggcgtgcccgaggatgagtggcaggtcttcggcaccgaggccggcggcggcgccgtgcgtctcaatgccacggcttttcgcgagcgaccggccggcagcgatcgtcgctggctgttgccgccgctgccgcgtgacgacggcgacggtgaaaacaacgtcgtggaagtcagcagcagcaccggcggtgcgcacccgccgagcgacgacgccactttcaccgtgcacgttcgcgacgccacgctacatcgagtgctcatcgtggatttggtcgagcgcgtgctggccaagtgtgtacgcgcgcgcgacttcaatccctacgtgcgttatagtcatcgactccacacttatgcggtttgtgaaaagtttattgaaaatctgcgttttcgctcgcgacgcgccttctggcagatccagagtctgctgggctacatctccgagcacgttacgtcagcctgcgcttcggccggccttttgtgggttctgtcgcgcggccaccgcgagttttatgtctacgacggctattcgggtcacggacccgtctcggccgaagtgtgcgtgcggactgtggtcgactgttattggcgcaaactttttggcggcgacgatccaggtcccacctgtcgtgttcaagagagcgcgcccggcgtgctgttggtctggggcgacgagcggttggtgggtcccttcaacttcttctacggcaacggcggcgccggtggtagtccgctccacggggtggtgggtggtttcgcggcgggacattgcggcggcgcttgttgcgcgggctgcgtcgtcactcaccgccattctagcggcggcggtggtagtggcgtgggcgacgcggaccacgcgagtggcggcggtctagatgccgctgccgggagtggtcataacggcggtagtgatcgggtttctccctccacgccgcccgcggcgttgggtggctgttgctgcgcggccggtggcgactggctctcggccgtgggtcatgtcctgggccggctgccggcgctgttacgggagcgcgtgagcgtgtccgagctggaagccgtgtaccgcgagatcctctttcgcttcgtggctcgccgcaacgacgtggacttttggttactgcgcttccagcccggtgaaaacgaagtaaggccgcacgccggggtgattgactgcgcgcccttccacggcgtgtgggccgagcagggccagatcatcgtacagtcacgcgatacggcgttggcggccgatattggctacggcgtctatgtggacaaggcctttgccatgctcacggcttgcgtggaggtctgggcgcgagagttattgtcgtcctccaccgcttccaccaccgcttgttcttcttcttccgttctctcctccgccttgccgtccgtcacttcgtcctcttcgggcacggcgacggtgtctcctccgtcttgttcttcttcgtcggcgacttggctcgaggagcgcgacgagtgggtgcgttcgctggcggttgacgcgcaacacgctgctaagcgggtggcttccgagggcctgcggtttttccggctcaacgcttaacgagtcacgtaggggaactacgtgggtaagtgacgtggatactagtaaaaaaaagtgcgtcaaagctctcagcgtgtgacgtggatactagtaaaagggacgtcaaagctcactacgtgttgcgtgtttttttttctatgatatgcgtgtctagttcgcttctcactcttcctctccccgttcccagcgcggtggcagcttggggggtgagggcaaattggggtagttggcgttgagcacgtctagcaggcccaggcccacgggccaaccgtccacggtcttacgctcggtcagcttgaggctgaacgagtgtgcctcgtcttgaccggtaaggcggaaaaagaagcgtgctaccagctgcaggcaggtatgctgcgtctgctggaagagcacgaaggtagcgggtacgtactgcacaatgtgcggttctttttcctcaaagagtaggtagagcgcgctgcagatcagccgccgggcgctgtggtgcagcagccggccgaagctttcgcgcacgttcaccgcgtccaggtactggagcaggtcgtgcaggcacttgcgcgttaagttgcaattttccacgcatgaaataacggtacagagcgcgaagtgcagcaggttgtcggccttgacgatgccgcagcggtgtttgagccgcagatccgagagcctcacctgcgtgacggcgtcttcggtctcgagcaaaaacacggcggagtagcccagaaaggccgaggtgcacagcagctcgctgcggtactcggccatggagaccagcagcccgtgctccgtgtgcagccacagcttgtcgccgcgcaccgtaaagtcgagcacttgcggctccatgatcatcacattctgtctagtgaaatccgtatggacctccagcacgccgcggatcatcagggcctccatttcgaaatcggccgacacgctctgggccgcgccgctcctcgtctgccgtgatcaggcggcgcggcgcggacctttcaagcgttcctgggccgccgctcgaggcagttcccctttctggcactccgcccgccgcttcgcggctcatttggcgtcggcgcgccttctcgcggctgcaaatcagctccacgtatcggcaaaacttgctgtcgtcgtaggcggcggccacgatctcgccgaaggagagctgcaggtaggcctcgggtacggggtccagcgtgcccagcgccaggatgtgacacagatagggcagggtcacgcgctctaccgtgtaattggagtagacgatggcctcttcggccccctgatgcgtgaccagacgccgcaggcgaaaggtgcggaaatactcgttttcccacagctgcgtgaggaagcgttccagcgactcggtgccgggcacgaactgcgagaagaagctgttggccaccaggcggttgtcctccaccgccaacggacggaaaggcgccgcgtcgcgcgccttgcgcacggcctccaacacgggcaggtggtagagttcggcgtcgcgcgcgcccaggctcatggagtcctcgcggcgcgaggcgtagcgcgtgagcaggtcgcgcagttcgcgcacgcgattctcccaggtctggttgagcgtgcgcaggtcctggatctcgtctacctgcgactggatctgctcctccaggcacttgatgacctgcttcttaaacaggtcgcggatgtcccgctcgggcgccgccgggccgggtggcggcggcagcagcccgacgtggcccgcgggtcctcccaccacggcaccgccgggccccaccacgccgggtccacccggaccacgcgcgggtagcagacggttttggtccaccagcgaaggggtcaagtcctgcaggaaggactcgacgctgtcctcgatgccgatgcgcgatttgctgtccgagacgttaagcaaaaacttcataatggactttttggcgtcgctgccccggtcgtgctgctccatcatctccaccagcttcttgcagttgagctcgtggcggctggcggtcaccactttcacaggaaaggtattgagcaactggcagatcttttggtggcggcagagcccgtcgtagcgcagaatctcctcgtgcaggtgtgccaccggcgtggtgaacagcagcttgtcgcgctcataagccagcggttcggtcgccacgtacaagcggatgtgcttgccgcgcagctgcgcctccagccgctccgagcgcaccttcttgaagacgcgtacctcgggcgcgttggctacgcgcacagctcccaggcgctcggccacctgcagcagcagcgccaggttagcctgcagcaggtcctgcgccagcgggtgtgtctcggtggctcgctgcacggccgcgcgtacaaattgcgcccgctcggccgcctcgctcggcttggtcttcacgtccagcagcggtaccagtcccaccgttacgcaccaatccacgtagagaccatagtcgtcgttatcggcgtactgatataaaatgtcgcggagcgcgcccagcacgcccgtttgcacgctctggcgcaacgaggcgctccacaccaacagatactgctccaggtcctcttcgtccagcgcgcggtagggaaacagcgccgcgtgcaacttccactcttcggccacgcgccgcaccgtgatggtgtcaaagagcgttttgcacactccgtagagcagctgcttgcgcagcacgcacgggtcgcgcagcacttggtgcatgctttggccgcgacacgtccccagaaagccgtgcagcaaccgcaggaagctcatcgtctggcccgtggggaaaatgtcgatgacggcctcgtcatccacaccgcggcccacgcccaagtacgacgacgccttgatcctcaacctctcgtcggccgccaagatcgaacggatcgtcgacaaggtcaagtccctctcgcgcgagcgctttgcgcccgaggatttttcgttccagtggtttcgctccatcagtcgcgttgaacgaacgacagataacaacccctctgccgcaactaccgccgcggcaacgacgaccgttcactcctccgcctcctcttctgccgccgctgccgcttcgtccgaggccggcggcacgcgcgtgccctgcgtcgaccgttggcccttctttcccttccgcgcgctgctcgtcaccggcacggcgggcgccggcaagacttccagcatccaggtgctggcggccaatctagattgcgtgatcaccggtaccacggtgatcgccgcgcagaacctcagcgcgatcctcaaccgcactcgctcggcgcaggtcaagaccatctaccgcgtcttcggcttcgtcagcaagcacgtgccgctggctgacagcgccgttagccacgagacgctggaacgctaccgcgtgtgcgagccgcacgaggagaccaccatccagcgcctgcagatcaacgatctgctcgcctactggccggtcatcgccgacatcgtggacaaatgcttaaatatgtgggagcgcaaggccgcttcggcctccgccgcggccgcagccgccgcctgcgaggacctctcggagctgtgcgagagcaatatcatcgtcatcgacgagtgcggccttatgctgcgctacatgctgcaggtggtggtgtttttttactacttttacaacgccctgggcgacacgcgactttaccgcgaacgccgcgtgccctgcatcatctgcgtcggttcgcccacgcagaccgaggcgctggagagccgctacgaccactacacgcaaaacaagagcgtacgcaagggtgttgacgtgctctcggcgctgattcagaacgaggtgctcatcaactactgcgacatcgccgacaactgggtcatgtttattcacaacaagcgttgcaccgacctggactttggcgacctgctcaagtacatggagttcggtatcccgctcaaggaggaacacgtggcctacgtggaccgcttcgtgcggccgcccagctccatccgtaacccctcgtacgccgccgagatgacgcggctttttctctcgcacgtcgaggtgcaggcttacttcaagcggctgcacgagcagatccgcctgagcgagcgccaccgtctctttgatctgcccgtctactgcgtggtcaacaaccgcgcgtaccaggagctctgcgagctggccgacccgctgggtgactcgccgcagcccgtcgagctctggttccgccagaacttggcgcgcatcattaactactcgcagtttgtcgaccacaacctttccagcgagatcaccaaggaggcgctgcgccccgcggccgacgtcgttgccaccaacaactcctccgtccaggctcacggagggggaggatctgtaatcgggagcaccggcggcaacgacgagacggcgtttttccaggacgatgataccaccaccgcgcccgatagccgtgagacgctgctcaccttgcgcattacctacatcaagggcagttcggtgggagtcaactctaaggtgcgggcctgtgttatcggataccagggcacggtcgaacgtttcgtggacatcttgcaaaaggacacgtttatcgaacgcacgccctgcgagcaggcggcctacgcctactcgttagtttcgggcctgctcttctcggccatgtactacttctacgtgtcgccctacacgaccgaggagatgttgcgtgagctggcgcgcgttgagctgcccgacgtgagttcgctttgcgccgctgccgccgccacggccgccgctcccgcttggagcgggggagagaatccgataaataatcacgtcgacgcggattcttctcagggcggccagagcgtgccggtatctcaacggatggaacatggccaagaggagacccacgacatcccctgcctgtccaaccaccatgacgactcggacgccatcacggacgccgaactcatggattacaccagtctgtacgcggatcccttttttctcaaatacgtcaagccacctagcctggcgctgctttctttcgaggagacggtgcacatgtacactaccttccgcgacatttttctcaagcgctaccagctcatgcagcgtctcacgggcggtcgcttcgccacgttgccgctcgttacctacaatcgccgtaacgtggtgttcaaggccaactgtcagatcagctcgcagaccggctccttcgtgggcatgctttcgcatgtgtcgccggcgcagacgtacacgctcgagggctacaccagcgacaacgtgctcagtctgcccagtgaccgccaccgcatccaccccgaggtggtgcagcgcggcctttcgcggctggtgctacgcgatgcgctcgggttcctctttgtgctcgacgttaacgtttcgcgcttcgtcgagtcggcgcagggcaagagtctgcacgtgtgcaccaccgtggactacggcctcacttcgcgcacggccatgaccatcgccaagagtcagggcctgtcgctcgagaaggtggccgtggactttggggaccatcccaagaacctcaaaatgagccacatctacgtggccatgtcgcgagtcacggaccccgagcacctcatgatgaacgttaacccgttgcgactgccctatgagaagaacaccgctatcaccccctatatctgtcgcgcgctcaaagacaaacgcaccacgcttattttttgacacaacaccgtgtaaggaaaacgtgactttattgagcagggtaaaaaccacgtacaagaaccacgttgtctatccccaaaaaaacacacaccgtcagggaacacatcgcctatagatagcggcactttacataaaaccaccgtacctgcatcacggtggctcgatacactggaaattcaataaaaaccaccgtatctccgtgacagtacttatcgggtcagcgtctttctcttgagatttctgttcgtaaacttatccgtttccccggtccgcggtgtctcctcgcgaggctgacagtctacgggtggtacctgcaagagaagaaacccgggtgggagcgacgccgtcgctgggtatcaaccccgcggctgaccgtcgtccggtaaaggaacgacccgtcgtcgcaagccgggttcgaccaagagaaaaaacccgggtgcggggggagacgggtcgtcctttggttgttcgcggacggcgtacatgccgcgtgggtcagtcgacggcgtcgctccgtgcggtcggtcatcattctgcttcacatatatgggttgtttgtgttttttttataatgaatacgcactgatcctatccgtgactgcgcgtgtggcagagaggatgccttataacatgtattttgaaaaattgccaacagctataatttctctcatgtagcagaatagagaccttttgtcgtctttttgtttgtcattacttgttttccagggaattagagagagggaaccgcgcctccggcggcggtgcccgcggaccccggccccttctcgcgtgcgcggtgtgactggttgagcgaatgagcagctaggcttggtggtgctccgcgtgcgggggagaagacgattaacaacaaaaaataagtggaagtggccggtgggtctttgtccgcgtgcgcgcccatccgtcgccgggaccgagcagaaagtgatgtggtggtacattgattttttccttgacaggaaagaaaaaaaagagttttgttttcctatgtgagaggagaaaggtatgtgaggagatgttcgatgatcgtatgttacagttatgctgtaaggaagcttttatcgtgcgtcctgtttttcatttgatgtatatgacacaattgaaacctatcgataggcgtatatcgaggattcatcaattcttagaatcgtcgtctttttggctaattggactttgcccatgttggttgtcattcgtggcctgaggtcatcgtcgtccacgacgacgtgtctatagcgtgcggtgtgatcattgtgtcgagccagagaaagcgcgcctcgcacgacgtttgcggatcggctcgcgggtgtgtggaattcctaagaacataatcagctggtcgtctttctttgatgtgttgttgtcgtcgaggtcttgcttcgttttcttttttctttttagtcgatggaacttttcttcggtacgggttcttgttatggaagcttgtgttttcgaacatgaattcgaaaaaataaaaaggcctatcttcgtttcaaaaaaaggacagatatcaatcttcttaacttatatcatggtaaattcagaatcctatggtgtcttattatctctaaagtagtcaacattatggtctaacttgtatttccctgacgagatatatatgatccttataacctggctactatcatgaacaacaatatccttacttacagtcatcttcgtgagttaatgaagtataatatcggtcatctatcaacttatctgctatgtaacgtacccttttaggtattttgcgtttcttaacgagtgtacccgcctgtgtgaggcgaaactctgagaagtctaccgagtcgagttacaagtcactaaaacacttacacgagttatctatactaaaatcactatctatgttgtttgcttacctaattattatcctacatgacgaagctacctcccaacgtaaggtagggggagaggagacagaacaataaaaagtaactaatgtttcttagaacttacccgctaaggacttaccaaactatattcaccaaaaaacaacagctacgtgtttcatttgttttaatctaccgaagtaaaaaaaaaaaagatgattagctatccagaacctacttacttcttaatgttttaactaaggatgcctatgggattggaaaaaaaatcacagcaacttgctactaatcagttgacagcgaagagactcataacaaagatttctgggtaatacggttataataatgcttatggactaaaggatacttggaaaaaaagaacgggctatgactatagagattcgtcgagatatcaaacttcaaataggcggctatcattcatggttgtggtgactatatcgtggagaaaaaatgtgatcgttagttagctaggtgagacttacagctatccatccgtctagtttttcgttgtaatgatgatagtacgtctatggtggtgatcgattttggttaacaatttgttcgtttaaaggcttaatgtacttatgctacatgatgtattattctttgattcatcgttcctcctaagggggtgtatgtatgtatgtactagtcgtatagtgttcctaacatcatgactattcagactatggcttcatctatcgtgtctaaagttcacttattctactattactatatatatgcactactatgtaactaggatatggtcctataaggtgtcttctatcacggtggcttgtttatcgcttggcggttacgagcaagagttcatcacggaccagccgtgaggcagggcacacgcgggtcggcggcgataatgtccctcgcgaaggggacaacgaaaacaagaggccgccggccgcggccacggacgcgtagcggttacacaatgtttggttgagcgttttgtttcatcgtcgtggtggttttgttgttctctgtatatatcgtgtggtggctttatcgtcatcattattatcatcattcttgtttccatcatcacgatgagttttctccgttttcctctcctccagtggtagtcgtgtatcatcatcaatcatcgtagtgacgtcgttgctgctgctgctcttgccttcatggcggtatttctcttcctcccccctaaccccatattaactcgtgagtgtgatggttagagtggctgcttgttttttttttcttttctctttggaacaacaaaagaggataaagatggtcggtgaatgtattattattattatcatcattatgatacggtcgcggtcttcttctccgatgacgaaacctgcgcacatcgaagaaaagacgagcgcgcgaaccgatagccgtccgtctgggacgaaggagaagatgatggggagaggaggagagccccagaagccagagcgagaggggagacgacagacatacgtcgtcaccgtcctctggaggaggcacggcggcgctgtttgttgtttggatgcttgattatatcctgttctatggggtagattattatcaataggcttggttttcaaaggtcagcctgtgtattgtcgtgtcttttttttcgttctcatgatcgcggagaccacacagacgtgcgcgtctcccaatggctaggcgttctttttaggtagtaattttttgatctttttttttcttaacaagtctggcttgatttcttttatctatgatcgattcttctttttctcgggggttgcatcttccgtgaaagtaaagtgacactactctaaatggtaaccatattatctgttgattaggagaaaaaataattttttcgcacgaaatcgatcctaagtgaggtgatttacttgctatcacacgaaatgattatcttttgctgctaacgtactgaattttttaacagaattgcttctccgtaactatttccgcagattcagacagattgtcaaaaaaaaatacggcacagaaatagtgggtctgtggcttttggttcgtgtacattcgcgtttgcgtgtcgagatttctacggtatgtttattcttcctgcgatgatgtagggtccttggtgtaagtaggatttcgagtatctctcttagagcgaacaaaataatcaaaaaacaacagctaggaaatcgagggttactctacgataaagtgtctctacaaagtgaagaatgttacgttgtggtggaataataagactcgcgtgatcgatgagtgatcgagagcggctcgaaccttctttaagagctttgtttagtgcaactttaaattacaaggagtagaaagctgaaatgaatctatgaaggtgctattctttgaatatcttactttgtacgcttcacattcgttatttggatagagagttgtctagagaaaatctgtgattctctatgagtgttatttttattatccttttggggactacgatttttcttcttgttctacataccactactactcgtaatcacatacatggacgaaaaaaaaattcgtcaggcagtagataccagattctccgacgttacggcgtctttttttcttttgagagagtatctgctgagattgtccgtggtgtatctagtcgctatttttgttgttactagtagttttgcacacagtttattcagtatagtttttcttcttgccatgatcaattgagcccaccaccttttttttaagagaggaggaatttcgtcttgatctccagccggagataacggcggtggtggtggtggcgggagagacttcaaggcaatgaaaaaaaaaaatttcgttttgccatcaagtggtgacgataacccgtcagattgataattggttcctacagaaactattctaaccgcggaagaaagaaattgaaaaaaaaaaattgacaaaaaacatcataacataaaggaccacctacctgggacgcgcagttgggcggcggactggggcggcatgctgcggtgatgctgtcggtgatggtctcttcctctctggtcctgatcgtcttttttctaggcgcttccgaggaggcgaagccggcgacgacgacgacgataaagaatacaaagccgcagtgtcgtccagaggattacgcgaccagattgcaagatctccgcgtcacctttcatcgagtaaaacctacgttggtaggtcacgtaggtacggtttattgtgacggtctttcttttccgcgtgtcgggtgacgtagttttcctcttgtagcaacgtgaggacgactactccgtgtggctcgacggtacggtggtcaaaggctgttggggatgcagcgtcatggactggttgttgaggcggtatctggagatcgtgttccccgcaggcgaccacgtctatcccggactcaagacggaattgcatagtatgcgctcgacgctagaatccatctacaaagacatgcggcaatgcgtaagtgtctctgtggcggcgctgtccgcgcagaggtaacaacgtgttcatagcacgctgttttacttttgtcgggctcccagcctctgttaggttgcggagataagtccgtgattagtcggctgtctcaggaggcggaaaggaaatcggataacggcacgcggaaaggtctcagcgagttggacacgttgtttagccgtctcgaagagtatctgcactcgagaaagtagcgttgcgatttgcagtccgctccggtgtcgttcacccagttactttaataaacgtactgtttaaccacgttgcgtcgtgacgttgtttgtgggtgttgctaggcgggctggaaagatgatgtataaatagagtctgcgacggggttcggcgctctgccggctgcggcggcactcgctccacggcctccgacgagcgttgcgctcgcgctttgcgccgccgcgtcatggatctgcctactaccgtcgtgcgaaaatactggacttttacgaatcctaaccgcatcctgcatcagagcgtcaatcagactttcgacgtgcgccagttcgtctttgacaacgcccgtctggtcaactgcgtggacggcgatggcaaggtgctgcacctcaacaagggctggctctgcgctaccattatgcagcacggcgaggcttcggccggcgccaagacgcagcagggcttcatgtccattgacattacgggcgacggggaacttcaggagcacctctttgtacgcggcggtatcgtctttaacaaatccgtctcctcggtggtgggctccagcggacccaatgagagcgcgctgctcactatgatttccgagaacggtaatttgcaagtgacttacgtgcggcattacctgaaaaaccacggcgaatcctccagcggaggcggtggttgcggcgccgcgtctactgcctccgccgtctgcgtgtcctcgctgggtggcagcggcgggactcgcgacggcccttctgcggaggaacagcaacggcgaaggcaggaacagcgtcacgaagaacggcgcaaaaaatcgtcctcgtctgccggtggtggtggaggcggcggcgctggtggtggcggtggcggcggcgggagcggcggtcagcactcctcggactccgccaacggactgctgcgggatccccggttgatgaaccggcagaaggagcggcggccgcctccctcctccgagaacgacggtgagtcccggccctcctcgcgtcacggtgctttccgagtggactcgtgagccccccgtagcgcacgagcgagcaggcgagcggtgttggtgcgctggtggttgtgtggatgataaccatgtgctttttcgtgcgctatgtgtcgtcccgtctgtaggctctcctcccctccgggaggcgaagagacaaaagaccaccgcacagcacgaaggccatggcggcggcggcaagaacgagacggagcagcagtccggtggtgctggcggtggtggtggcggcggcagcggccgcatgtcgctgccgctggacacgtctgaagcggtggcctttctcaattactcgtcctcatcctccgcggtctcttcttcctccaacaaccaccaccaccatcatcaccaccataacgccgtgacggacgtggccgccggcaccgacggtgcgttacttctacccattgagcgcggagcggtggtttcgtcgccgtcgtcgacgtcgccgtcgtcacttctttcgctccctcgacccggcagcgcccacagcgcgggcgagacggtgcaggagtccgaggcggcggcgacggcggcggctgcggggttaatgatgatgaggaggatgaggagggctccggctgaggcggcggaggcaccaccgcagtcggaggaggagaatgattccaccactccagtctctaactgccgtgttcctccgaattcgcaggaatccgcggcgcctcagcctcctcgcagtccgcgttttgatgacattatacagtcattgaccaaaatgctcaatgattgtaaggagaaaagattgtgcgatctccccctggtttccagcagactcttgccagagacgtcgggcgggactgtcgtcgtcaaccacagcagcgtcgcgaggaccgccgcagctgtctccacagccggcgttggccccccagcagccgcatgtccgccactcgtcaccaccggtgttgtaccctcaggttccgtcgccggtgtcgcgcccgttgccgccgcagtcgaaacaccagctgctcctccccggcccgtgtgtgaaatcaagccctacgtggtaaaccccgttgtcgccaccgccgcggctgccagtaactcttcctcgtcttcttcggctccgctgccgccgccgccaccaccgccgggcggacgtcggggtcgggcccggaataatacccgaggaggcggcggtggtagaaacagccggcggcaggccgcatcgtcgtcgtcctcctcctctcggagatcgcgacggagaaacaaccgccacgaggacgaggaggacaacgaccctctgctccggttgtcgcaagtcgccggcagcggccgccggcgagggccctcgttcctcgaggacggactcgaaattatcgatcccagcgaggaagctgcgatcgccgccgcctcgatcgcggcgtttttcgacgattaaaaaaccgagccgagaccggaaaaattatgaaacaggacgcgcttggacatttgggtttccaccccctttggtgtgtgtctatatatattggtcactgattttttttacaataaagagatagacatcacagttcaccaccttgtctccccggtgtgtctattatcatcaatcacccacagagtcgccagtccatggtctctcggtaatgcgtgtccagatacgcgttggccagtataaaatggtcgttgcccacaaaggcgcgggtggtgttgcgcggcgacgggtggcaggacttgagtaccaagtgccgccgtcggtcgatcaggtactcgcaggtgtgcgcgtcggcgccccatagcatgaacaccagatgctcccggcgctctgacagcctccggatcacatggttactcagcgtctgccagcctaagtgacggtgagatccaggctgtccgtgcaccacggtgaacacggtgttgagcagcagcacgccgcgtcgcgcccaggcgtccaggcaacccgaggccggacgctgaaacccgtccaccgtacgcgccagttcgcgaaacacgttgttgagggagggtggcggcggtcggcccgccagcgtgccgaaggccaggccgctggcgctgccgtcgcagtacgggtcctggcccacgatcaccacgcgcacctgctcgggcggacacagatagctccagcggtgtacgtgctcgggtgccgggtacaccatctcgagttgccgcgcgccctccaccgccgccaccgtgtcgcgcagcagcaccgtgtcgtggtcgggcaagctgaggaagcggatccagtcggcgctcagacaaaacacgcgagcctgctcgtcgggggttaacagagagcctttattatcagcaatgttagcgagcatccactgcttgagggccatagcgcgagtgagccggcaggttgacgcgcgtctgcttcagctcgggcggcagtccggcgtagtatttatctaggtggcgtagcagcggcgggtccagctggtgacgcaggcagaattccttcactgcgttgtacaggccgtaaaagagcgtgatgccctcgggcgcggcagcggtgctcacgggcagacgcacggcgcggttggtacgcgtggcttcgttgcgtatggccaccaccacgttaaagagagacggtggcaccagctcgaagcctaacacgtgttccgtgaagatgctgcgcccgtatgacagtcgcgtgaggtcgtagccgcggcacaggtcgtccacgcacgtgtacacggccggcgagccatcgccgcactcgctgtaaccgcgcatcaccgtcatccagcgcggcgctgtgtccgagctcaacagcgtcagcaaggcccgcaattgatccggattgttgtacagcagggccagagtgtccaggaaagcatcgtccaacagcacggagttggcggcctccggcgtaacgggacggtaacgaataagttgcgatagcgggccatcgcgtctggtaacattcaccaacgggcgcagccaactttcatacttgtcaccctgaaacacctcacccaacaggcatcgacgcgttagttcggggcactccgcgggaactttctcggcgacggtaggagcgacgctgacggtggctgaggaaacgatgggcagcagaaggcaacaccacagcagtgccaccggtccaggtgagaaagagaagccgcaatccgggcggcggcacatcaagtctgcggcacgatgagagtgtgacggtaaggagccagttggcgccgaaagttggcgctcaggtcttcgatccctaaaacgttatatattgcatccagcaggtgagccaggctaaacggattcacgtaccaggtttggttacccgcgacgataacggccagaccgtgggcgctacagttggagaggttcctgggtacgaaggtaactgagtcgatgtcgcgccacggggggaatgagacagacgactggcgcacgctgtaatcacaactgtgattgacgtattgtagcgtgtaatttaggttgcactcagcctcgaagtagagggggaaccacagttcgtcgtactcgtcgtcgtcctccagttctggctcttcttcatccaccgcaatgtctacgctgctctgagattcctcttcgtacaggatgattgacaggttatggctacaaaggtcctgggcgggaggacgcgtgggagcgcgggtggtggtaatgttttccagatcgtcaaaagtcggagtgtagtctgacgccgtgacgacaccgtcgacggagatagtagaagttgcggccggtgtcacggtggtaagtatggatacagaaggggagggggaagtagcgttcgtaccgatggttgtggtattattattccttgtatttcttgtttcagaaaccgttgacgttgagatgggaatcgacgtggcgctggacgtcagattgctgaccgaggaaaccgtggtgggagtggtgacggtgttactcgtggttgaagtgacgttaggggaggtagtagtggtaccggtggtggcgacggtagtgtttgtcgtggcggcggcagcggtggtactggtaacggtggtcgcgttggtttccaccgcttcacacagtaagcaaaagcacagggccaggaaaagcaaccagccccgccatcgccgccgccgcttcatgaggtgggcaggcgaaagctggtgaattcgttgtacagcggcaagtggggcgccgcgatcgaagggtacgtcaacaagctgacgttgatattaaatacgtctggctgcttttctacgatggaagcgcacagggttacggcgtcaaacaggtctttcttggtggcgcccgagacccacatctggtatacacccgtctcgtggtacgaagtagagcgcggcaccaccggacggatgcagtccagaacgcggttgggatcctggtgaaagaatttgaacgtggctacggcctgtggcgtgtgcggcatcgtctgcgtgatgagctgctggcccgctaacacggtgacgttgtgcaacttgagcagggcactcttgagggcctggaaagcgttgccgcacgaggcgctgatctgcagctgcacggccgtggagtcgtgcagccgcatgagacgtgatacctcttcgaagacgtacttgtatttgctggcaaagagtggcgcgtaccgacagtcggccggcaaaatgtaggtggcgttaccgccgttggtggccacggcgggcgcagcggccgcggaggccggcgtaaacagcgtcagcggccggtggtggctggtaaggtcgatcatgggcggcgtggtgaccgtggcggtggcgggcatgacggggtttgcggcgacgggcactccggccacagcggcggcagcggcggccacggcggcgctggccgagcccacacccgccggcagtcctccgccacccatgacgccgccgggcagagcgtcgcccagacagacttccacagtggcgggcgcgctctcggcggtcagtacggtttgccgatcgacctcgcgacgaaagctggtgaggaactcactatgatccatggccgcagggcccgagatcccgggattctgcgggtgctgaccgagtgcgggccgagttatatggaagacgattagcttggagcggagttttgcgtccctagctgacctgcggatcagcgacgtgccatagggatagactgtgagcggcggccgcaacggcggggtcggccgccgctcgtcgtcacggggcggcgcgagggaggaggaggtggtgggtacgatcttgacgtggttgacgtcctgcccgtccgggggaatacgcaaaaaaccccgccgcggcgctaccacgatggtgcgatgggtctttctcttgttggccggggccagggacttgcagatgcgtgtggagccgtagacgatctggacgtggtcctgggagaacatgaccatcgccgccaacgctcagcggggggacgggttgggaacacagaggctgaggggaaaccccgtagaagtcagcgaaataaagacaacacagcagccgctcctctcgtttctggccctaccactgcttgaagtagggcaccgggtgtttcttttcctcaacgggctcctccagtctcttataggaccagtcccgccggcgcgccagcatgtaggtcacgtacaaaagaataattaccatgaacaccaggaaagccagcacgccgtaggccagcagccggtcctcgaacagcgggtcgctcttgataaacacgtaggtggtggtaaaacttcggcccgcgatctgaacgtggagacgcacgacagtatacgtgccgttgaggtagaagacaaactcgcgtaaccgttgtccgttatacgtcacgttactaatattccacggcggaatgagctggtcgccctgatgcagatgcacggtgctgtttgggtgatagaggctgctaccgttgagcaagcagtgttcgtgttcctgaagcagcacgcggacccgcatcgtggtagcgttcaagcgagtcccgtacacggcgtagatgggataggtgaaaaggtcccaagtggcgttgtgatggcggccccagctgaaaaaagagcacgtgtactcagtggtctcctgcggcctgagtcccgagataagcagctcttgagcagtagcgttgtaggagagatgtagttttcctgtggataaaattcatatgctgtttattctgttagcaggttggtgggggaggaaggggaatagaacagaggcggtattacttacctttatcaccgggcgcaaaagcgctaagataccccacctgagtgaagggacccttgcagtctgtccgtgcataacaggtaatggacaaaatgtcgggatttacggtgttgttcaacagggacactttacaggtggcgttgagagacacctggtcgtagctgtagctggcttcgcaattcacagtatacaggtgcccctctttctgcgtcgtggctgccacggaggtagcggcggatgtgaaggtagagccggacgtggaaatagaggtttgtaccgtggtgctgacggcagaagtgacgttattagaggtacttattgacgtagtggacgtgacggtggtattaatgggggaagtgacggcgcttgtggtgctactttccactcccgggtgcgtgtcgcctaagagcgtaaccatgagcgcgatcgccagtacgggacacatgttgccgtgtgacgagacggagtgtggacgagctatatgtggcaggaggccgcgtcacctcttatgacgcttaaacgtccagctccagataaaagaggcgttaataatgaacactacaaaaaccacttgcgtcaatatgacgatcataaaggctcggtgatcgctgcgcctaaagtatgcgggattctccaccagctcactgtctttgacaaagtggatagatgtactagtgttaccggccgtttcgttgaccatggattgtactatgaaagtcccggcgccaaaagttccattagagccccagcaagtaacgctgccgtttacgtaggttcccggctggcctgtcagcatgtatgtcagttggtgggtataattctgtttaatgttttccatgtcctcgctgtagttgacttttctagtgagaaattgcgtacgatgcggaaggacgatcatcatccctgaggccaaaaagggcgaatcataagctgtcgtgttacaaaaaatagtcaggttagtatcgttgtgctcatagatataagccatttttacttgaggttcataccaccaccctaccctaattgtagttgccaccgtcaccgagtcccatctcccgaaacctaccaccgccaccactaatagcgtcacccccgcacggtacatagttaccctctcgacgtcgccggctgtcaatgacgtgcctgcgtcagtggctatgatttatagcttttggacacaaccgcaacggatctgtcgtaatctaccttccacagggccgccgcgacgatgctgaacgacaggatcagacagacggcgtataggagtcctaggtcggcgtcgacgcggcaggtgcggatgtctcgcagggtgggtagatgggcgatgcacaactccttctccccccgcccgtacattccatcccgtatcagcagccgtagcgtggcattgatggtcagcggggtaaccaaagaaatcacatagggatgtgtacaggaagtgcagtgacgggtatccgtgagatgtaagtcatcaccctcatcaccctcatcatgaaagaccaggactcgggtgagacgacccgatgaatactggatctcccaccacagtctttggtccaacaccgagagggcgcaggagattctaagtctccctgggttgggggagcagatgtaagccccgtgtgtgccccttgccatcaaagccatacacatgagggggagaaggacaagtatccgggaccacccgcacccccacatcacgagaccagagacggagatgtataaaaaaagctacttttattaaacagcattctcaccacacgttaatactgtcacggggaatcactatgtacaagagtccatgtctctctttccagtttttcacttactgagacttgttcctcaggtcctggatggctgcctcgatggccaggctcagggtgtccaggtcttcgggaggggtctcggtgggctgctcaaactgccccacggcgtaggccttcgtggccgtctcgtagataggcagcatgaacccaccctggttggtggagaagatgcgcaccatgacctgtttgggaaacttttgcatcaggggcaggcacaggttgagagcgcccaacaggtccacgggggtggcagcgtggatgatcatgttgcggtaatcggaggaacgggggcataattggtgggtgtgcaattctttgaggctccacgcggccttgacgccttcgttacaagcatcggctgtgcgctgcgccactttgggtggatgtgtcacgggcatggtgtgctccatgaggaagggagtggagagggccaggttgcacatggtgcccaggcgacaccgcaccgcatccacctcactcttcacctcatgattgcgggtgtagataatctggatgcccttgttgttcacctgcatggttttgcaggctttgatggcctcatctaacacctggtgcatactgggaatcgtgaagggcaggttcttgtactcaagagagcgattggtgttgcggaacatgcggctcacctcgtcaatcttgacgcgaccccgccgagtctgcacgttgggtgtgcagaagggggtgttcttatctttcatgatattgcgcaccttctcgttgtccaactcggagatgcgtttgctcttcttcttgcggggtccggtgctcgccccgccgctgctctgatggccgcagctcagcagagaggaggaggccgcgccaccaaaaccgccgcgcccatggtggctcgaggtcacggatgctcctccgccactgctgcatttcatctcctcggactcactctccgagtccgaagccgaactgcaggaggaagacgaagaggaactatcttcatcgggccggcccaagggatcgggaagaggagggtggttcatctgggagagcgggtgcgtgggagaggtcactcgcggcgtgccgctgccggtggaaggggaagacgcggtagcaccgcgggtttcgacttcttcaccctgttcttcctcgctatcagagatcacgatacagccggcggtatcgataatcttgttgcggtactggatggtaaagtcgggctcgggcttgatgtcttcctgtttgatgaggggcagcatgataggcgcgggaggcacgggcggtttaataatcaccttgaaaggacgcgtggttttgcgcggtttcttacgcgggctgagctcgggagtagcggatgccccggggagaggagtgttagtaaccgcgacgctggtgggggtcggcttgttaagaggggcgctgctaacgctgcaagagtgggttgtcagcgtggggccggtgctactggaatcgataccggcatgattgacagcctgggcgaggatgtcacctgatggtgataagaagacacgggagacttagtacggtttcacaggcgtgacacgtttattgagtaggattacagagtataacatagagtataatatagagtatacaatagtgacgtgggatccataacagtaactgatatatatatacaatagtttactggtcagccttgcttctagtcaccatagggtgggtgctcttgcctccagaggcggtgggttcctcagcaccatcctcctcttcctctggggcaacttcctctatctcagacactggctcagacttgacagacacagtgtcctcccgctcctcctgagcaccctcctcctcttcctcatcactctgctcactttcttcctgatcactgttctcagccacaattactgaggacagagggatagtcgcgggtacaggggactctgggggtgacaccagagaatcagaggagctggcaccagcggtggccaaagtgtaggctacaatagcctcttcctcatctgactcctcggcgatggcccgtaggtcatccacactaggagagcagactctcagaggatcggcccccagaatgtactgggcaaagaccttcatgcagatctcctcaatgcggcgcttcattacactgataacctcaggcttggttatcagaggccgcttggccagcatcacactagtctcctctaagacatagcagcacagcacccgacagaactcacttaagagagagatgcccccgtacatggtcatcatacaagcgtcactagtgaccttgtactcattacacattgtttccacacatgtagtgaggatatccataaatatgtgatcaatgtgcgtgagcaccttgtctctctcctcatccaaaatcttaaatattttctgggcataagccataatctcatcaggggagcactgaggcaagttctgcaatgccgccatggcctgactgcagccattggtggtcttagggaaggctgagttcttggtaaagaactctatattcctgtagcacatatacatcatctttctcctaagttcatcctttttagcacgggccttagcctgcagtgcaccccccaacttgttagcggcgcccttgctcacatcatgcagctccttaatacaagccatccacatctcccgcttatcctcaggtacaatgtagttctcatacatgctctgcatagttagcccaatacacttcatctcctcgaaaggctcatgaaccttatctaagatatctaaggcattctgcaaacatcctcccatcatattaaaggcgccagtgaatttctcttccgtctgggtatattttttcagcatgtgctccttgattctatgccgcaccatgtccactcgaaccttaatctgtttgactgtagaggaggataacaacacatataagtatccgtcctcctgactcatttatcgctatctcgatgccccgctcacatgcaagagttaatctttactctatctgacatacacaagtaaatccacgtcccatgcaggttagtatacatcacatacatgtcaacagacttaccgagttctgccaggacatctttctcggggttctcgttgcaatcctcggtcactcgttcaaaagttttgagggattcttcggccaactctggaaacagcgggtctcccagactcagctgactgttaacctccttcctcaacatagtctgcaggaacgtcgtggccttggtcacgggtgtctcgggcctaaacacatgagaaatagagtcataagcacatgggtcacatacaggagatatgtatataacattaatacaattttataaaaaaaagggggggcacaaaccccgacacgtaccgtggcaccttggaggaagggccctcgtcaggattatcagggtccatctttctcttggcagaggactccatcgtgtcaaggacggtgactgcagaaaagacccatggaaaggaacagtctgttagtctgtcagctattatgtctggtggcgcgcgcggcagcaacgagtactgctcagactacactgccctccaccgttaacagcaccgcaacgggagttacctctgactcttatcagaatacaacaactcagctgcctgcatcttcttctgccgctgccttaagtcttccatctgcgtcagcggtgcgagcccaatctccgagctcattttcagacacataccctaccgccacggccttgtgcggcacactggtggtggtgggcattgtgctgtgcctaagtctggcctccactgttaggagcaaggagctgccgagcgaccatgagccgctggaggcatgggaccagggctcggatgtggaagctccgccgctaccggagaagagcccatgtccggaacacgtacccgagattcgcgtggagatcccacgctatgtttaataaaaactgcgggcacgggggacggcgttgttgtatatgtgaatttgtaaataataaatgggaccccatcctgtaaaaatacagagtccgtgtcagtctctgaaggacagagtattggcatatagccaatagagatagttgtggcaaagagccatgttatggattagtaatggaaagtatcgtcaccaataggggagtggtcaataatggtcaataacccacacctataggctaagctataccatcacctatagcataaggaagcgggggtgtataggccccaagccaaaaacagtatagcatgcataagagccaaaggggtgtgcctatagagtctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctctgcttatatagacctcccaccgtacacgcctaccgcccatttgcgtcaacggggcggggttattacgacattttggaaagtcccgttgattttggtgccaaaacaaactcccattgacgtcaatggggtggagacttggaaatccccgtgagtcaaaccgctatccacgcccattggtgtactgccaaaaccgcatcaccatggtaatagcgatgactaatacgtagatgtactgccaagtaggaaagtcccgtaaggtcatgtactgggcataatgccaggcgggccatttaccgtcattgacgtcaatagggggcggacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacatggcggtcatattggacatgagccaatataaatgtacatattatgatatagatacaacgtatgcaatggccaatagccaatattgatttatgctatataaccaatgactaatatggctaattgccaatattgattcaatgtatagatcgatatgcattggccatgtgccagcttgatgtcgcctctatcggcgatatagcctcatatcgtctgtcacctatatcgaaactgcgatatttgcgacacacagaatcgcccaagtcgccaaagtcgtctatcgccatcccccgtaaacgatataagcgctatcgccagatatcgcgtatgcccaaaaatcacttttggaaaaatggcgatatcagttacacagaaactcacatcggcgacattttcaatatgccatattttcaaatatcgatttttccaatatcgccatctctatcggcgataaacaccactatcgcgcgacatgaatttagtcggcgacagaaatctcaaaacgcgtatttcggacaaacacacattttattattcactgcagcatatagcccattttagcgcggcacacatccagccgtttgtgtttcttaacgctctccaggtactgatccaggcccacgatccgggttatcttgtcgtattccaggttgatccatcgatagggaacgctgccagcggcgcccagcaggtactgcgccttgtcgttcactttgccgcagcgtattcgcccgtcagcttcgagatataacctacaacacggaggggaaggggggtacaaaacgtgaaattagacttttttttaatgatgttttgtccctctctgtcttactctcccataggctgtaaggccctcgaggaagagacttacggattgtagttgcagctcgtcagtttgttgtgtacgacctggcgtgtcaatgaatgggtcatggtggtgacgatcccgcgaatctcagccgttttctcgggactgtagcagacttcgccgtccggacaccgcagcctgtggattcatgaaaatctactctggcattcccgaggatcgtcgatggaacatggctatcagaaacgtcgagagacagatccagacgcaccacagaacgcagacaatcatgaaaatacgtacgcgacggtgaagcgattgcacattttgaaatcgtaacagcgttccggcgggtggttgacgtttatgaattcgcaacattcttctgcgcgcacccgcggcacgcggctgtgacccaatagcagccacaacgccgtcaagaacggcgtcaggtttttgggactcatgacgcgcggttttcaaaattccctgcgcgcgcgacgggctcaaacgatgagattgggatgggtgcagaaggtgtaaaagtctggttattggcctcggtgaacgtcaatcgcacctgaaaagacacgctgtagtcccggaagacgtgagcccagctctccagcttcatcacacacatctgataacgtgtgccatcgttgacgacgaagcgtagcagcttggtctgcttgggcaccatgtgcgctccaaaaatcttggcgtcttccacgctgatctgcacgtttccgtcgctcggtttcgaagccgttcggggcatccgttgaaggatggtctggttgcgaccgctcaggtaccagatcacctttttcacccaggtggagcttctctccaccaaggtctggccttcccggttatacagcagatacagggtctcgttgcgacactcgggacccgttaatacccgctggaaccccgagaattgcaagggggaccgtgggggcgagggatagagaaaaggacagtaaaacgtcgccgcgtcatgcggtttggaatacgtcagtttagaccatggcggggacggattctggtttgccgttagcgtcgaccagggagacgccagacagggcgttgcccaaaccgcgcacagaagcaggcagtgaaagtggtgacgaagcagaagccgcagcatattatttcccgtgacgcaggctagttggcaaagagccgcacgctgaactcgaggctccgggcgtgtggcgccagcgaaccggcggcgttgaacgtggtccttttgttggtgccgccgcgacggttctgacgtctaaagtcgctgatgagcaacgacacctcggtcacgttgattctgcaagcacaggttccaaacgtcatttcataccccatgcggttacttagccgttacccgttcgctcttaccttcccgttgtcatgcacctttagcgcgtaccctcacctcttgagcacgtcaaagttgtccaagccgtggctcgcatcgtagtggtagttcaacgtgaggtccacgagctgttccacatacttgtaacgggtttggtcgggcagcgcgcgagagcacgcgtcccagtaatgcggtactcggtaataatcgtttttttccgcggtttcccgctggcactgacccagcaccacggcgcacagacaaacagacagccacacccgacacagccgcatgttgcagactgagaaagaaagctttattatgagacatcatacacatagtataggcgaggtgatggggcggggaaagagttggaaccgaaagacaaaaaaaaaagcctagtcgtactcgggatctctgagcgagacgggttgcatggcaactttcattagtttgggaatctgccagctggtgctgttcgaaggttcttccatttccgaggcggtcagttcatcgtacaccgaaacgtagtacctgatggggtcctcctcattgtccgagaggtgagattcgatggtcaaaggcgagcctctcccataattgggattcacgaacgacgtgtccaagttgccatcctttctgaaatagatgacgttctcaggatcatgtttcatgcgctcgcgggccgcggacgcctcctcctcctcgtcccagtcccgagtttccaaccgctgataagggctcgaggaacaaaatccggcggggatctgagaacctcgtcgggaaccgctgccaaacgggctgctgccgccactgtcgtccgtgtcgtccaacaggttgacggcctcttcgtcggcgaaacgaaagcggcccgggtgcttgcaacacgaggagtaaactaccgcgatcagtaccgctatgaagctgaaaatggaggtgcctgtcacgatgtagaagaggatagccagcactttcatgatttcgtcattgcgcgcgtcgtgaacggaagattcgcgggcggtggtcatgttggtttcggttgtaggttcgctactcgtggtgctctcgacggtatttctgctgctggtgctagtagggacgtttgtgctgctggtcatatttgtagcgtcgctgaagtcgatgtgaagcagcaacccgaacgcgaccaggaccaggaatgttgcgcgaaggagaccccgcggggccggcattcttgagacgtggcgacgtggatttctcgttatgtccgcgaacgacgtgtgacgaggacgtggtttccgcaagcctctaccgacgccgcgacaccaggtaggttatcaaaacgcgagcccatatcgccgccatcattgtaatcagcaatgtgttgaggtactgcacgatgaatctgtctagtgacaccagccaaccctctgcttttgcgggcaagcgcgctttcggtgacagggtgtatcgtacgtagccgcgggtcaggcgcgcgttgtagcggtacacgcagaaatctatccacaggccaacgcccggctgtagcttaggatggtggataatagcgcggtgacgtacgccacggggctttagaatctccacctgtaaggccatctcctccaggtagtgggtctgactgcgacgcagcgtccagttcatgtaaaagtcggtctcgccgtgtccggccacgtagaggctgcttactaaatcgggcgccagagctagatcaggcgtatcaaattccactgccaggcgacctgattctaacggttccacgatccgggagagcgtttctagatatagagcaaagcgtaccacgtctacctgcggtgtaaaaaactgttgtgggcgttcaccgtcgttgaccacgtaagccacgtagaggccaacattttccaccacgggttctagctgcaggcggcacgtaaagcttagaaacgacggctgtacggtttggttcccgtgaagctgaagcgtcacttccttgccggggctcaccgtgctgtaacgccgcaccgagtcggtcatctgctccagatcggtagaccagaagggcgtgcaatgcatactgtcccagtcgcgacacgcagcccagcctagctcggtgaagggtcgacgcacacccgaaaaagtgtgcttgaagaccagggggtcgcctcggtagctcagtagccgaacatgcacatagtcgcggctagcgttgacagacggcccgtagagggccagcaggacaagcgtgaacagcaagcgcaacatgctgcgcgggttagaaaatgcggcgtgccggccaccgcccgactcataaacgctaccagcatgacgtctcagatcacacaagtgacgaggagcgtaccgcaaatcactagggaaaaggccagcagagcccgatagtcttgctcttcgcgaacgatctcgtccggttcctcgcagtcttcgtggtccacagaagatgaggagcaggattcttcgttaatttctgccaggatactagtgctgtaccacaccagagcgctcagcgtgcccagggctaccgcacggtaaaatagggacatgatcaccagcgcaatctgaagtggtggtagttcagtttcttggcgtatttccagagaaaggctttgtaggccgtagggactggccaggcaccgaactcaatattggtagacactacgtcgtaaatgcgttgttcctcgtctaagattaaccgaaaaaatagccggttgatgtgacgacgcacggcttgcgcgttaggattgagacacttggtgcccttgtcctttaaaatagccagcacttcctgacgattgcagctttcgctcgccgcgattggcttaagcaattcagttccgattggcagagtattcaacagaatttggttgttacaacgacagcgtttgtcgtaatcttccaattctaaaagatggacggctaggggacatacgacaaataacatgtatgcagtcaattgcatatatcgtaccgataaaatgttagtgtgcggattcagaatcggatgatgcaaccgtcttagcatcatatcgaaaaagtatacatattaccgattcattataattagggaattatttccaacgcggacgtttgttagtgacagcgttttcttctacatgcggtccattactatcctttacttttaccaatactctgtgccatgagttgtcttttttaccatccagccatttggacaaatgatgatcgggagctaaacatacaggtttacctcgaggaggcaatagataatgttgaggtttgtcacactcaggaggattgggagggtcacgaccaacccaaaataagccacctataggatgatgtaaagctttgtgggtacacggacaacgcaattctctactgtgaaccccatggtaatacataaatgccatcaaaagactaatcagcgaaccaaaaattaatcgcattctaattttattaactacgtcactatcagtaattcgtaatatccggtattcccggaaaatcactcaaaactgcgtccatgacacatcaattcccgataagtacccccctttgaaatcggatccccccacataccaatcaatcacacaacacacaggtttaaaaatcgatcacacgtcaattaggtttcaaaatcgatactgtttattatcaggaatctagactaattctacaatgacagctctgaatttctctctcgtctttcttgtcaggttctcatcatcaatcttcacttccacccatcgaggagtcatcgtcgctccaaaaccctttggggtcgctggttggaaaagtctctgacacgatccaggcaccccgtacccagtccgactgatctagcttacggagcatctcaacaggcatgagctgcagggccacggctgtcacggcagggattattactaccgttcaggtaaactgtatctccctgagttaccgtgatgggtctttctacatgttgactttgcgtaaaaaatcgccggtaaaatgttttttcttgttcatgtaaaagtaccggaactaaaatgctagttagaatggttgcagttgctattagcgcggctagtaacagtagtttagtgttacattgtatacccatgtttttaataactatgaatattctgcttcacaccataagtgcttaacccacaaaaaccacacggagacattattggctaaaaataaaaacaaaagtttattgatgtgcatgttaggttttagtctaaaattcatctgggtcgtatttgggaagttttgtataacgcggtcttctggggacgcgacggctacccatgtataaggctataagtgccacagataccactatacccgcccatacagcatgaattcccaggggaatgttagtgttttttacagtttttattacattgtcccacgttctgctattatgctggtctgattcctcttttgttttacatttatcaggtataggagacgatgttgcagttcctgataacacggttaaatagtagttttcctttttaccgtcactgtaacgttgcaaaacgtattttccagcgtgttcggtagttacgttgtatatagtgagagaggtcttattgcagtctaaacacatgccgttcagtggggaagttgaataataatgtccaatgctgcacagttggtgtgcgcgaggtccatattttatccattctatatcgtgccatacatccgttctactgcagtttttcaaagtgacgtatccaccgacatatcctgttacattaattacttcgtaatttaaattagagtgtttataaacggtgtacaaactgccattgcaagttatgttgctggtattcaaccagggagtagtactatgaatggtagaaaacgttaatgttggcgtagcgcttgacgatgattttgaaagcgttgaagtggttgctgatgcgactgaagaagcggtagagggtttgtgcgtggttccatttgcgatagctgaagtgctgttagcatcggtgacagagttagaagaatttgtgatagtggaggcggtggaggtaaaggcaattgcacggacaggagcacgtgtcattgcaaccttcagatatcgtaatcatcagtaacgtccacttaaccgtaaatctccagtccataacgttattaaatttcggttaacgggcattgatgtttcttcggacgttgttgatctttcttgcccgtttattttctgatatggtctcataagacatttatccggaaacgttgcttagtcctcgtgctcaggattgtatcgaactatgaattctgattcacttatatcgtcacttaatggatgatattttttatttagagctcgtcggacgaaaaataggagaatgcaggctacacaaattaatgctaacgtccacgtagtgcgtctgccgtgtgatgtgttagaatgattgttatagcggtataaatgatctatagatgatgtggctgtattgtcttcataattggtcggtttatgagaagtgtcccattcgtgctttggttcttcacatacccagggattcacgtgtgtcccgtttgtgttgtttctaggatgtatttgcagattaaagttttgattttgttcggagggatgcccagttttataacatcgaaagctatatttaccagaatgagtaaaattaagaccgtacagagataaagataaattacgatcgcatgtaaaacataaatcatagtgatgttttagataatttgtgtgccactcacatagtatacgcgaatggaggattttcaatgaatggttatgatattttccatttcttatgttgggatgggtgtattttccgtgtgtggatatattaaaatgtctaagccaggctgttttgtagcacgatgtgatggttaggttgtgtgttatagtaatattgtctccttgtgccgcctccaataatgtttcagattcttttgatatcgtattatttgtactgttaggcgatgagcaagttggaagcggtgtagtgacgttttcatttgcatttatcatagtagtagtgttggttgataatgatatagtttgcaaagtcacagtactatcggttacatgctgtgtcgatgaattcgtgtcgccgtttggtgaagttgttattacagttacgttagttgtagatgtttgggtagatatggtggaaatagttgaggtcacgtctgtgccttttacagagcttgcagtgaatcctgtggatgtgttgacgttgccattggaggatgtgaacatagtggtagacatttcggtggtttgtaacgtagatgtcagttgtgtagtagatattaagcttgtgggtgtaatcgacgtggaagtattggcgatagtggtgttgttacacttgcttttctgcagaatccaaaaaataataaacatgcatattatttgcgtatatgatgacttgttccaccgtcgatgttgtgtgcgcatcttttactccaaatccccgtccaccgtcaacaacagaggttccgtatctaggtccgtccgcaaccgttcagcgtcctgttccccgattcgttgcgaccgcagaaagcagatgaccagtgcgccaacaaagatcatcagtcccgaaacccaggcgcaatggagtgagaggccggaccactggcgttttaaatccgagataattgctcggtctgcctcttgggaatccgtaaccacaactctccctggtcccggataaaagcatcgacgcgtttccaaagctcggcagaagctacgtgggtggatgatgaggtaaaaagcctcgacatcaccggtatactgatcctgcaggaggtagactcccgtatctttaaccgtaagattgtacagcgtgagattttggcgcgtgcacgtgaaagttgcgccaccctgatgcgtggtttctttataggcgtctgtaatgatgcaaagtggcggcatacgacgcatgtatctgctgtagatatcataacgttgccagactacgctgtgatggctagtgttaagcctggtaaccagagtacgtgtacggtcctcgcaggtggcgcggtaattggcgagctttaggggttttttggttggttcgacggcgttcgatgaacttccctgagttgtgaacaaaaacagcgacgtgactatgacaagcgtgaggggggtgctgtaggtctgcatggtgcaaaacacgttctcgccttccttgtcagacgtcgtcgtcctcgtcctcttcgtcgtctgtgcccgtcggttcgatcaacggggagttatctttctgtctggagggtcggtatggaatccgttcgtagatgttctgctttttagccgcgtgttgttccagctttttgcgtgtcaggctccgataggccagacattgatctacctcggtgcccgtgttgtttttctcctcctcgcgcgcgtaaattacgaagaagaccaccagcaggactatcagcgtggccacgaacgagcccgcgccccaggccgagtatgcgcctagcattgtaatgggttctgtgacccggcatttgcacatcgcgtggcacctgctgccattggtagatgtgctattcggattgcacttacatgttaggtgggtattttctgttttcacgagacaattggtggtaaccgtgttttcggcgcaaacggccacgtagcttatcaaaccgagtgctaaaaagcacaccgcgtgcattacacgcggatacatattaaaacaccgtgttccacaagcaccgcacacgtcgatcctccccgcacggtcttcagcccgcccatgacatgatctccctcacgttacccttcaacactctgtagtactctgtctcggcttccggtccccatgtcctaatcataacaaaacaccgtgtcactgtccatctccctgtcttttcgcgccgccggtcccccccaaaccatgtctctagatgccgccagccaccaaccggcggcacggcggctcttggattcggcattggtgcgccgcgtcttggcctgcatgatcatcgtcatcatgatcgccattagcatctggatcctgacctacgtgctgtttttctaataagaaccccggcccctgacggtaattttcctttcttctccgtttctcctcagctgccgtacgtgatgcctcacggccatctccgacaggccctctccccgacctcctggacatgtgagggcttgttgctcctcctgggattgctggtgctcttctttcaccaccacaaccagtcggccgtagagaggcgtcgccgcgtctcgttcgtcgaggtcgatcgactgccgcatgagagcggatggtattcttccgatgacgacggagaccgggatggcgatgaggaaactggagagagccacaacagaaacagcgtgggactgtccgctgtttttagctgagactggcgtgcgacctgtaaaccgttactcgggtctcaagatggtttggaagttgtgactcatcttcctgtgggcaatgcccaaccggacgcgagtgtcccataaaagccgggcgctccggcgagaccatgccatcctcgccttcggacgccccgctcctcttctctctcctctcctccccgctgccgcggccactgccgccgccgcccataccatcggcatgtcggccgacaaatcgcagctgtcgtcgtcgccgccgcagctgtagcagttaacgtcgccggccttcaggaggagatggcgctctgcgtcgtctcttcgtcccgcctccctctgtggtcgtgggtggtgcgagagtacacgatgggtggctctcgtctcgggggaccacagggggaggggggtaatttattattcgtattactgtaattttgtatcgcttaatttgtttagagccgcacgcttgacaacgccttgtatagccttatttatcccgatgacttttttctccgtacaagaaatggacgtcacttgagcagacacagtttcatcgaccacgacagtctcatgatctgactacctctgacccgccaatgagaaaaccgaaaagtaaaagatgaccgcgccctcggagtccttttttccttttcaatcatgaaagcaagaggcagccgagagaatgccagtaagagacgaccatcgcagacacagtacgatactcatcttagaacgaaccagcgaataaccatcacacgtacagcagaatctcatgaactagtcaaccaacgtcataaaatcttcacacaatcgtttttgcgaacttttaggaaccagcaagtcaacaaaagactaacaaagaaaaaccatcttggaattaaaaaaagtagcatcgttaccttatgaaccagcagcattcagtatatacaccagatataatatatttattaatgtatcctctctttctcctgatgtaattttgtttttgtaaattcaattgttgaaagtctctccctgggggaattgcatatcttattgatgaagaagaaatccctgccatatgtgttgtcaaactatcattatttctctatatgggtattttttttctaagaagcaaaagactagcagcagccaaaataaacctgatgaaatctttaactgaactcccggtggtctgtgtgtatatttctgttggtggtcggttgtctgaacccgggtgggttgttcggaaacggcgggacggggaaacgggtggaaacagcgtcgctatatacgtgacttttgatctaaacggacgtcgctaggctgacagtttacgaattgctaaacaaggtggtcaggaacacaacaagcggggctttgcctggtaggatttcctgtggaaacaatcaccggatgttatcgtggctggtacataagctggttctggctgcaagcgctttttactgcattaggttcggcgttagctcttgcttaggaacgccatggctataacgggaaataaccggtttggcagcattccattgtgggggggggggtacttatagcgtgtttcatgacggtgtttatacatgaaggtgcgggtttcaataaagtagaggttaaaagtggtgacaatgtaaccattgaacacaaaaacgacccgatgactacgaaatggagccatctgaatcaaggatggttatgtaatgtaacagggagacatgcacctctagtgaataatggatcaagcgtttgtgtaacgaattgtactcatacatctttagatctgtgcaatatcacgaagggtaacgatggcgttgtcgaccttggtcgttggttcggagagaataaagacgagtacagcggtgaattatggtatttgactactaaaaattaggtttagagagtgttaggttacgttgacctagttagatttcctgtgtagaacaatgaccggacgtgcttggactggtacatacgcaggggctggacgtggttaccggtcactggactcggtttcgctgtagctgtggttcaacctgaacatggctcccagagctgctaggaaccggtccagtcacattttttggtgggtggggggtactaaaaaagtgtttaatattggggtttaatgataaaatccaggttatggatatgaggaaactgaatacctcgcagggtcgaaatcttaccacagttgatgatagaagacggttttccatcgggtgggaaacatgggatgacggtggagagtctctatacgatgtgactaataatggtacaacggtcatcaatacaacagcctgtgtttcaagttgttcgcatacgtcgcttgtgctttgcaatatgacgcagcagactgattcgttgtacggagtgggtcatcggttgaatgacgaagaagatggtgaactgtggagagtttcggtttcttaataatcccatacgacatgtgttcatttatatctgaattttaggatgatgactatagtataactctggggaacaaatatcatacgttaatcactttaagttacgccgttaggaaaagaaaatcagtccgaatgaagcatagtcagccgaatgatacagcaatagcttgtttacaacgtgttcttttttacattatgaacgtgccttgctttttatacacacatggagacagaggtccctcagcccttgtcacgacaactccctttttctaaaccgtatgtgctccaaaccgcatctcctcatcgtcacgtgaaataccatgggaccccttttcgtcacacacgtctttccgcttactcaacgcgtcagcccgcgctcggcagagctaccatataaaaacgcaggggtttagcggcttccccagatcgctgctgccccggcgttctccagaagccccggcgggcgaatcggccggctggtcggtcggcgctcggacggatggggagaacggcggtgacttagccgcccgtggccgggagaagatggaggagccgagatgacaacggcagtcgtggaagggtcgccaagccccggtccttctcttctgtctggtcgaatctcgttttcttttttcaaccgctctttttatcacctttttatgtgagtttctcttccgcgtctcccggccgtaccatccacccatgcagcatgcacgcgtgtatgtatgcatcgtctctcctccgtcccgactaccatcagcagcaccactaccgccacccccagcgccaccaccgctgccgtcgccaccgcgttatccgttcctcgtaggctggtcctggggaacgggtcggcggccggtcggcttctgttttattatttttttttattttttatcttctcctttccttaatctcggattatcatttccctctcctacctaccacgaatcgcagatgataaacaagagggtaaaaagaaaaaagctacagacatttgggtacctcagctttccgataactcgaagaattcaaagtcgacgattcccaacgagagaaaacagaacaaaaacaaggtcatttttatttatcctcatcgtcaacaacaactaccgacaacaacgaaacaccaccaagaatgtcaatccgcaagggtgttcctgccccctcgacgcgcctgtcgcgatcctcatggcgaggaccgcgatctccgtataggtagatgaaattatcccgtgtccggtcctgattccccgcatgccctgcacatcctgacgcgtcggtcagcagccaaacaatcataggaaatgaaccagaagaacaaaaagatcatctctctcggtgtatagcaacaccaacaacaaccgcatcgcaacatcttcatccgcaagacggaaagaaaacaacaataatgagaatgaaatcaccacaaccaagccagatttcacgtccatgagtttttattatattattatcaaaacgaaaaacagaaaaactgtcatagataaatataaaaaaaaatagaaaccacaaacgactactagtactccaatcttagatgtatatgctcctagataagatttagtattaccataatcatcgaagaatgaaagacgacgatgattccttaccgctcctgccacccggtctgtatgtagagagagaagagagaaaacggtgaatccaagatccccgggtcggcgtcggcatgccgctgatcgcagtggccccacctcggcatgccggcgccgggcgaggaattgctcatgaaaaaagtatctttctgtaaaaaaagaaaacaatacatgattaaccgaaaagaaaccaacaaaaagaacccgagatcagtcgatttcgatcactacgataaacacatggaagatttcttgaaaaaagaaaagagaaagagaccaccttcccggcggcggacacgctcctctccgtcgccgttctgcaccatgattcgatcaataacaacatcatcatcggagaccatcttttaatcaatcagcgttgcagtagtcgactccctggacacgaaggagtcatccatttttatcctcgcacttcttcgctctcaaagccgcctttaaagttgaaatgaaaggatggaaacatggaatacagttttaattgcacgtatcaccattttactacaaaaagaaaaaaaaacaacttacacatagtattaccttaggtttacggataagtagagtgtaggcgtttttgaaacagttcagccaatgcaatcttgtctcggcataatcactctttctgcatataatagtagtagtagatttattcacatcaacacagcgaaaaactccagcatcaaagtacacctagagacagcccttaaaatatagtttgcagcttttagatgtacttacaccaaagaagattaccgtccttacgagaaaacagatactcggatataggaatcaagacagctctgcactgaaaacacactctcctgtcacgacaccgcgccacaccagaggcgtacgcgtgacttcatcgcaacgatccatcgtgatgtccctcgcagaacctaaaaagaccaaaaaaaaatcttggaccacagttgtcgattcttgaagacaatattctcgtgagaactttgagattcgcacttgaaacctcttaggatccacaaaaacaacaacctctgtatggaaaatgcgctattttatctcagcttttctcccaaacctcggtttcttcctattcttaagttttccctagtatatttgcctccttataacaaaagaagcacaagctcggtcgcacggattattccttctgctaatctattattttgttccttttttttttgtttgccttcacccccttcactccctgtagcaacacagagtagtagacacaataaatgagaagtttgcatgcatttgccgtgtccgtggtctgttatagcgtgtggagtgctcgggatggatggacgtggggacggattcctgaggctacaaagatacgcggagacgtcgtggcgaggggatgggtttattggatatcggtgaagcagcgtggcggcgaaatacgcgatccctgggctggtagatccccctaccccgtctaccggggacgtttatccttgggacatgtaaatgtttcggccggcatccacgcgccacgttcaccgcgtcgtgcccagcgccatgtgcgggtcgtttcggcgtgaagttggacggcgtggtttcggggattgtgaaccgtggctgagggtgtagaagggataggaaagagcgtgtcatgtgggcgagtcgtagcatgtgggtgcgatgcggtggatatggtgggctggggtggttttgggcgtggagatgtggagatgggggtgatccggatgcgtggcaataggcctcgagcttgggcttctcccgcggatggacgttctaactgtacacggcggccgtggcctccgagtaaaaaaaccaggtgctgacgccagacacagacgccgtcctcggaatcgtgtgcgcgaaagcctgtgccgcggcagcgtacgacgttccagtcagcgaggccgtcgcgttggcgcgccaacagtaaggtcacgataggttggcggcccatggttccgaagcgtccccacatgcaccagcagtcggcgtcgaagtcgcttgcgctgtcggcccggtcgccaccgccgcggcggatttccgcgcgggggacggggtagccgagcgctgcgccttcgccaatgttgtgaagtagatgcgtcagttgatggtgatgttctgtggaaaaatgagcgctttcctgagggttggcgtcggggtatgcgtgtagttggggttgtgttggagcgtagaggtgttggcgggcctgcgcgcaagcggcgtaatccgcggcgtcgagctccatctgcgtgcggtgttcttcgttggcgtgtttgtccgaggtttggataggcggttgtgtgttgctgtggtgtaagggtagcgtgtgttggtactgtgggtgaagcggcgtggtgtgggtgctgtttgtggctgtggctggcatgattgtgcggcaggtgtgtgttgaagtgggtggaggttaaataggcgagggcgagtccccgtccccgcacacccgcgtcctcgccgcaaacacccgcgccacccccgtccctcggtccggacccgcaacacccgcgtcgccaacgtaacccccgtacccgcaacgccccggccctaccgccgtcacgcacaccccccggcccgcagcccggtacccagcgcgcccaaaaagcgccgtggagacacccgtacagagatccctcagcgcgatgacgccccgcaaacctcacgcagtccggtcccgcgaacagataccgtgggacgacacgcaccggtagtgcgcacaaaggcagccgcgcttacgggcctcaaagttccctcagccccgtcccgcgccggcgtcgggttgggtgtgccgggggcgcggctgggtgggtgcgtgcgtgccgggtgtgtcgcgggcgtgtgtcgggtgtgtcggtcgggtgtgtcggtcgggtgtgtcggtcgggtgtgtcggtcgggtgtgccgcgggtgtgtcggtcgggtgtgtcgcgggcgtgtgtcgggcgcgtggcgggtgtgtcgcgggtgtgtcggtcgggtgtgccgcgggtgtgtcaggggtgtgtcagcggtgtgcgcggcttcggggtgcgtgtcggcggccggagggaacaacaagtgtgccccggggcccgcgagcccccccccctcccctcggccggacgcctcttctgcgtgtgtcctcgacgcgggtcgcgccgtactttgcggccgttgcttcccccgcggtccccagggtcgcgcggcgccgcgcgcttcctcttttccgcgcgcggccgtccccccggggacttcctcttttccgcgtcgtttccgcgtcgctggcccctgggaggcgttcttcgtgtgtccccggggacccgcgctgccgtcgtcccctggggacttcctccgttccccggggaatcaaacagacacagacacgcgtcttcttttcgccgtgcgcgccgcacgccgcttttatgcgccgccgccgtcccaaccgcaccgcaacgcgactccaagactccaaatttcacccccccgctaaaaacacccccccgccccacggggacccaacacacggcccggaatggatgtcaggcgtccacctagatgacagcgctcgagtgctgcgggcctgtctcgcgtcttccttcgggcgtctgcctttcccagtcgagtgcgtcgtcgcctgccgggtggttttccacgggcttccagactgcgcgtcgccaaggcggcgccagcaagcgccgtgcacggcgctgcctataaaagccaggtgcgtgtcggccgtggcacacggacaacggagacgtccgcgtgtgtaaacggcgtgctcgctgacgcgggttgtgttgctatatagtggacgtcgcctcgacgtcggaggtgtccggcggccatggcccagcgcaacggcatgtcgccgcgccccccgcccctcggtcgcggccgcggtgccggagggccttcgggggttgcttcctctccttcttcttgtgtgccgatgggagcgacgtcaacggcgggaactggtgcaagtactgcgggttcggcgacgccgggccacggcgtccaacgggtagaaccccgcgggccgccgggcgcccctccgggtagcggcaacaatagcaacttttggcacgggccggagcgcctgttgctgtctcagattccggtggagcggcaggcgctgacggaactggaataccaggccatgggcgccgtgtggcgcgcggcgtttctggccaacagcacgggccgcgccatgcgcaagtggtcgcagcgcgacgcgggcacgctgctgccgctcggacggccgtacggattctacgcgcgggtgacgccgcgcagccagatgaacggcgtgggcgcgacggacctgcgtcagctgtcgccgcgggacgcgtggatcgtgctggtggcgaccgtggtgcacgaggtagaccccgcggccgacccgacggtgggcgacaaggccggccatcccgagggtctgtgcgcgcaggacggactgtacctggcgctgggcgccggattccgcgtgttcgtgtacgacctggcgaacaacacgctgatcctggcggcgcgcgacgcggacgagtggtttcggcacggcgcgggcgaggtggtgcgggtgtaccgctgcaaccggctgggcgtgggcaccccgcgcgcgacgctgctgcctcagccggcgcttcgacagaccttgctgcgcgccgaggaggcgacggcgctcggacgggagctgcgccggcggtgggccggcacgacggtggcgctgcagacgccgggcaggcgactgcagccgatggtactgctgggcgcgtggcaggagctggcgcagtacgagccgttcgcgtcggcgccgcaccccgcgtcgctgctgacggccgtgcgtcggcacctgaaccagcgtctgtgctgcggctggctggcgctgggcgcggtgctgcccgcgcggtggctgggctgcgcggcggggccggcgacgatgacggcggggacgacggcgatggcgacggggacgacgttgccggcgggggcgagcggcacggagacggaggccgccggcggggacgcgccgtgcgcgatagcgggagccgtggggtctgctgtgactttacctccgcagccgtacggcgccgccggcgggagcgcggtttgcgtaccaaacgcggacacgcacgcggtggtcggaacggatgcggcggcggcggcagcggcggcgccgacggtgatggtgggtccgacggcgatggcgggtccggcggcgtcggggaccgtgccgcgcgccatgctggtggtggtgctggacgagctgggcgccgtgttcgggtactgcccgctggacgggcacgtgtacccgctggcggcggagctgtcgcactttctgcgcgcgggcgtgctgggcgcgctggcgctggggcgcgagtcggcgcccgccgccgaggccgcgcggcggctgctgcccgagctggaccgcgagcagtgggagcggccgcgctgggacgcgctgcacctgcacccgcgcgccgcgctgtgggcgcgcgagccgcacgggcagtgggagttcatgtttcgcgaacaacgcggtgaccccataaatgatcccgtcgcatttcgtgtttcggacgctcgaactctcggtctcgacctcaccaccgtcatgacagagcgtcaaagtcaattgcccgaaaagtatatcggtttctatcagattaggaaacctccttggctcatggaacaacctccacccccatctcgccaaaccaaaccggacgctgcaacgatgcccccaccgctcagtgctcaggcaagcgtcagctacgcgctccgatacgatgacgagtcctggcgcccgctcagcacagttgacgaccacaaagcctggttggatctcgacgaatcacattgggtcctcggggacagccgacccgacgatataaaacaacgcagactgctgaaggccactcaacgacgaggcgccgaaatcgacagacccatgcctgtcgtgcctgaagaatgttacgaccaacgcttcactaccgaaggccaccaggtcatcccgttgtgcaagcttatcgcgataccgtcgacctcgagggggggcccggtacccagcttttgttccctttagtgagggtta

SEQ ID NO: 5 - DNA, 229700 bp, Human cytomegalovirus
gaagctaggcgcgcctgtttaaacatggatccggccgcccttaattaacgtgggagtctgatccaacactgaacgctttcgtcgtgtttttcatgcagcttttacagaccatgacaagcctgacgagagcgttcatcggggcatgaagtacgcattacacaaactccatatatttgttacgatagaatacggaacggaggaggctttcgccacacctatcctgaaagcgttgcattctttatgataggtgtgacgatgtctttaccattcccacggctgctttgcgtgatgatgacattcatcatgtatttccattcacacataccttttgtgcatacggtttatatatgaccatccacgcttataacgaacctaacagtttattagcccttgacaggataggtcaaaagattatatgtaggttttccggtaaaccgaattgtgatatttctctgcaggaaatagaacagcctggtacctataaaacggacaatgcagtactgtagcagcgtaaccaagtaggtccacatgaacacgtacaaaattatggtaagccatcgtttttcataccacagcctgtagctgtcgtacatgaatgaggacggtcgaggaacccagggtagttgtaattgggggcgacattcgtactgtccagaagacaattgcacgggtttcagtgagatgagtactttagcgatgtcggcgggggcgctacgtttcaccgtgacggtgagaacttgaccgtcgttttgtatttcatgaggcacgttatacaagccactggtatcatgaaggatgacctctgatgcgatgtgaggattaaattgtccctcaaaccgccaaacgctggtcatgttaccaccgtcaattacgcagctgacggtgtgagagaccacgatgttggacttaggtttgggggctaattgccttttcacaaattccctttggtattgcaggtcctgctgccactgcttttccgtgcggaaagtcgccatgtcttccacacgtttagcgacgatacacgccaccagggtggataccagaagcagctggatccgcatggtattaccgtatgtcaattagaaagttgagcggacacggctatcgttcctggcggatataagtatataaacgcaagttagcttttcccgtccgttttgtacacccgttccccacacaaatgacgaatacggccttttttttataaaaataaaccacgtgtattgtataaaaacatttacatagaaaagagacacacggatcaacataaggacttttcacacttttggggtacacaggcgtgccaccgcagatagtaagcgctggatacacggtacacagtcctggccagcacgtatcccaacagcagcaccatcgccatctgtatggcgatcacgaccccgagctctaagtgtctgtattcatagtgtagtcgtcgcaggttatccattgaattcccgtaactgaaataacgtatatggtaccgaggctggcaccacatgggtttgcatttggtgcacggcaccaaatgcagagtgagatggtccaagtccgtgggcacccactggcgcaaacggaatacggcttcggtggtctccacgaggcactccggggcgtgcagacggccccactttcgtccgtgacggcccgaccagccgacccgagccactatccctttctcgggatagaacgtaccctgtacacgccacacagcgtccaacacgccgtccttgacgacgcagctggcctgatagctggacacgttgttaagcggcggaaagcgaaactgacgtgccggcggagccacatagttcggttcaccgtgttgtcgcggttcgtcctccctatagtaatagtagtcgtcgtcctcataggggttgccggcgtgagccagcgttacccaacagcagcccaggccgacgaggaggcgcagccaccgcctcatggcggcttcgccagtcaatcgtctttagcctcttcttcccgtgaggtccttccggtggcgcggtgccgacctcggacccagggacgtatccacctcaggtacacacagcaggctacctggacaccgaagctgaacaaggctacgtgtttcacaaactgcaccagtaccacatagaggaatgtcaggtagcgtctctccgcaaacagccgttccaagtctgagggcgttgcccgcagcggcaaccagggcagcctggacgccggccggcaatggagcacgctccggttacaggcactgcaggggtaaacggttaacatcacgtaagagagtcgtgcgtccacctgtgggagctcagtttcgtaacgtagagccccgtcattttccagctggggtgcgccgaccttgaaatgggtcgcgctccgctcgttaccccaggtgccgtaggctctcggggccgtatcggagaagttgccgcgcacaagccaggcggccacgagtaccccgtgctggacgtaacattcggacacggaactggagacacggtagccggacacgtccccgaacccgcgagggtactggggcagacggacggacttgctatctgacaacggacagataccagacgacgaggacgcagacgactcgtcgctggaccacgacaaccggagcgactccttggagcggctcgagagtacacttactgcgatcagacaccagtgccagaagaaggaacaggtggacggagaccacaggatcatagccgccggcaccgcggccggccgcaggaagccgcccggcgcgtcgtctgtgtgcgggagccgaaacaccgtgcctctttatatcgtcctgacgtgacgcgagtattacgtgtcagggaaaacccccgtcatgacgaacgtgatttgtaagtgacgcggggtgctgacggggttcggcccaagaggtgatggagcgcctcacgtcagtatgatgtccgatccgcgtcagccccgacgtggttgtggtcaccaaaacccacgtttatatggacgttgagagcagcgcctgaccacatgattcatcataccatttctcggaatcgggcccatgccgggaaagcacattccttttcagtaaacaatgacatcataacaaatcattttattcgcgaggtggataataaccgcatatcaggaggagggatcgggtgatgacgcaggccccgcaaaacagtccgaaataaatttttagtatcgccccgtagtcgcctagataccagaggtacgtcaagttcatcaaaacgcccatgggcgtcccggaatcgtataccgggcacacgaagcgttcataacaatcccgggaggcgagtgttagggtagcagaatagtttcggggtcggtttccttccggcgacgacagctccgtaggcagcagaatgtagagcgcctcggtagccgtcgcggtgccttccacgaggatgggctgccggtgcctttcgtgattttccccgtcgtgtagccaagccgaggcccgcaaagtcttaggcgaggggaattgtccatagagtttcaccgcacctttcagtacatgattctgaataacacagccgcacgtaaagtaggtcggttctctcgtctcctctgtggctgccgccaccactcccagccaccacaacaggcaggtcgcgagagggttccggaggcttccccggcgtagcatggtttcgggttaaagcaaaaagtctggtgagtcgtttccgagcgactcgagatgcactccgcttcagtctatatatcaccactggtccgaaaacatccagggaaaatgtcggtgcagccaacctttcacatacagcccccaaaacacttgaatcactgccaccatcatcagcgtatactgcgccgacttaatcgtgagcgcgtagtacgccattagacggcgatcttcgaacaatagtcgttcgatgtcctctaacgagctccacaggggaacccaaggcacaaggcaccggggttcgcactctacataataagtttggcattgatgacagggggaaaagtagaacaacacgagttttgtgcgttggggaacacgatagtcccggagccagtagcgttttgcgacgaggctttcggagatgtcctccaccggcgtcggcactcgatccgcgtagccctccagcgtctggtagtacacccggggtgtcggcgtgggcacggacaggttcccgcgcagggtccacagagcctccagtcgaccgcccgatcggagcacgcagcgcgcctcggaatactctactcggtactccgaaacatcgggcagaggcggtaacggctccgtctccaccaagggcggaggttcatcgaaaagagtcatggataattcaggcatactacccgcgaccggggcccagagggctagaataagcattacaagattcattctgtcttacaagggaagggtgttcccctgtctagactcaaaagctgtaaggctatcttatagcatgtagtcttgcacgtcacggggaacagggtggtgatctagtgacgtcgggagaacacggtgttttagggtgcgggggacaaaggacagtacgacagattaggtgatagaaacgtttttttttatttatgaaaaagccagtgtgccgtgcggcctagggccccggcgtagtttggataccagatgggggccgtcaggggtactaccacgagcagaaacataatgacttggtccatatatagcagcatagcggtgcgcagcaggtcgccgtccgtgtagcaatttgacggtgagcgataaagcaccgttaatgtgtcgcggatgagcacgatcttgaggccgtagatgaagctcacagtcagtgctaaaatgatgcgttggtatggttcccaggactgcacggcgatgaagagccagagtatgggaagcatgaagcttagcaaacagaggatggctaatcgtcgttgcatgttccaggccatgagccaggctaggcccgtacaccagacgcagagcatggatgacaggacataggcctggattaccacggtgcgatcgaaacacagcccgatggtggacacggatatcgtagtgagggtggtatataccatgaccagcatcagggtcccgggtcggcgctgacgttccagccagtacgcgtggcaacgcagagcacagggtagcagtgtgctccagaagggcagtgtatcgcgcaggtagggggtcgtcacgcgccacggtatgagcatgaaaaggatggtagtggctatggtggcgctggtctggaacacgacggtgccgtagagacgtaccatccagagaaagtgttgaacgctccgcagggtgtcttcatctttggtgattacggtgactcgacggatcggcggtggtgacggcggcgacacgggtgggggtttctctttcttatggccgagtggctcgccttggtgaaactggatctgtaccatgacgggtgctcgacgaacagtcgtcggggcttcaggtacccggcaagttttatagagaaagggggacgatgggtggtggctacgagccaccgccaccttcgcaatacgaggatctgaaggcggcaaagacggtcgtccagggcaggcgccagaggttgggactgagcacgatcagcgtgattttaaacatggtcaccagtcctacgtagattagcagcgagccgcgtaacgtctgagcagccggcagttcgtcgcggatgtaacgcgtgccgtagaaagtcacggtcatcataaggaagacgatggcgccgtagccgtagagtagaatacgctgatgatggaacacggtctggtcgccgataacccagagcgtgatgaaaaaaacgctggtgagcacccgtgagcatatgagctcccaacgcttagcgcgaaagctgtccccaaccatgacagcgccggtgcaagctatccacagcgtgaggaccagtgtgtagtcgatgaggatggcgggcaggtcggagcaccaggtgtagaaaaccgtggtaacggagaggaggcctacgtagcccatggtcaataccacgtcgtcggggtgcctttcgccctgtatcaagaccaaacaccagagaagggagggggcaaaaaccagcagcagaggggaagattcatgttgacatatgttgtgggaatcggggatacccagccaaatcattccgcagaaagccgtactgatggcgatgtgaaagaccactagggcgtagacccggacgaggacagcaaaacggcgcagccacataaggccgtggtgcagctgcaggagggaagcccattgcggcgaatgtagcgacggcagcggcgggtccatgaggcgggtgatgcgcccgagtgaacgggtgagcgtctcggtggagtcttcttataaaccagcgggtctcaagcaaccctgctctggaacgtcgcggtggtgctgttgaggatgacgctgagcgtgccgttgtcaacccggtaatgatgataggtgcccagcttggccaggtagctgaacatttggtcccagcgtgccgaccacaccacgggcgtgagcatcaggagtgtggtgtgatagatgagtgtctcggtggcgtaaagtaccagcgagctgcggatgatgtggctcacgggcattttggtggcgatgtagcgcacgtcttggaaaaggacagccaggatgcagcccacgaacacggtgtagagacacagcagagtcttatgcaaccaggtgtaagtagaagccaggacgctgaccatcaccgtcaaaagtgtggaggtgaaaagcgcgtcacgccacacagagctgagacggtgttcccaagccacgccgttgcaggccacgaacaacgtccacgttaggatgaggctggaaacgccgatgggcgctgtggcgcacagattgagcccggcggtggtgaacgagagaagcgccacatacagcgcaaacaccaggccgttgctggggtgtctgtggtcggtgagctccagcgcgcccagaaccaacaccggtgtgcagctaagcaatagcggcgagggatcgtcgcggcactcgtagcccagtgaggggtaacccagccaaaccagcgcgctaatgagtacgctgaaagcggtttccagcgtcagcaatccgtagacacgcatgacgatcgcggtccgacgtagccaacacaccgcatcttcggaagctgtggacgctgtttccgaataccgggaggagatcgtgcttccctcttccaaggatcggaaagtagcgtccgtcgtttccgcggacgcggcttccctggtacgctccgtttccgacgacgcggtttcccgctgcgtggaaactgtctccatgtcgggaccgcagcgcccggcggcgtatccgcaaggtctcgaagctacagcttgtcagaggaaaagtaggtttgcaaaaaggtgcgcagggtcatgattctcagcaccatcagcagagtgaaaaccaggctgagaaacaccttgacggccgccaaaagcgcgcgttccagcggcgtctcgtagcgtacagccagggccgcttcgtggaaatgcgagacggctagacaggtaatgagcacgctgaaggacaagacgatcttaaagcaccaggaccaaccacgcctcaagatgaccaccacgattgccgtgaaggtcaacgtgatcaaagcatggacgaccacgatctgacgacggacggtacgttcgggagccaacaacgctacgccggtgcagctgagaaaggccagtaaggtgaacaacgcggccgagatgaccaacgtaccgtccaggcagagacatatcacgatcaacggcggcacgtgaagcagcgtgtaaaagagcagaacgccgatattgctgggatgcgatgtttcgtaacagtgaatgaagatcaccgacgtgacgggtatgacaaagacgaggctgggcgaggactccgtgagacacagacgggaatggtgaaaccacgtcgcgggcgccgcgtagcagaaggcgctcaacaacgcggtcaagccggccagctgccaacccacggcgccataggtgtgcagcgccacgcggcaacagtcgacccaagccagactgcgggtcgccagccgggtctcttggatcccggggggcacgtagatgaccgtgccatcggtgggtacttgaaaccctttttctcttctcatggtgcgctgcgttctctggaaacggctgctctgtccgaaaaccagttccgaacgaaaatctagggcgagagggtggacaacggcgtcgacgacgaagcatgggacaggtcgttcggcgttaacgtcatcgcgtcggacgacggtagttctaagagacgtagatcgctcagcaggtcctgacagttgcggattcgcaagatcagaaaaaaaagggaaatgaacgtaataaagagctgtagcgacgtatgcgccacatcgcgtggcataagaacgtgacggacgaaaaggacctgctgcgaaaagtggccggcgaagataaggcccaccgtgctgtagaagcccaaaagcagccgcaggggccaagtccagggccgcgtgaagacgatgagaacgttagccagaaagaccacgacccagacgccgttgatgagggtaaattgatcggacagggtgcagttgtcgcgacagatgaagactacttccgcgcagagcaaggtgatgaccaacgtgagcacaaacgacgtcaacacctcgcggggctcctggcagacacacgtgatacctagcgccgggatgtgcgccaggaggccggcgagtaatagcaccagctgtcggaacggacgacggcagcgcgggtgccggtttcgctgagcgagaaccggtcgctcatagcggaaatacacgaagagcgcggaggccacaggcaccaggaggagcacctcgggcgcccagacaacgtgacaaggaaagcccggacgcgacttaagagtcgctgtagggaagaccagagagaagctacccaagacggccaccgccgcggagatttggaagaggagcaagccggcgattcggacgacaacctcgaagcgatgcacccagcccagcacggccaccacggccgcttcatcatagtcgtcgttgttgccgctgtcgaacagccgccgaaacacgatctgtcgctgggtcgcggtgggaaagcgcagacccatgacagccggaggctatatgaccgcgcgtctaaggcgcgagatccctggggggacttttagatgtttgggcggcccgcggttctgacaggcttgattggtggagacggccggcgcggcgggtgggggaaacgacgagtttttccgttacgccatggttcgcgtgaggtttctctgtacctcccgcaaaaggtcacagcccgaaatggaggccgcgttggtggccccggtggcgcgtgacgataaccaggtcatccaagcgatgagtttgtctaatgagtcctcggtggtgaagaggataagaatgagcaggtacaagtacaccaggttctcatagagacacaaggtgagcaggtcggcctcggaccacgcgatctcaaacaggcgcgtggtgtcaaagaccgtgacgaccagcatgaagctgagcgccatggcgtaatagcccaaaaaaagtttgtgccccaacggtacgggctgcaggtaaagtgcgatcaagaacgcgataacgccgatcacaaacagcgtgacgatgacctgccatcgacggtgattatggccggctagacccgtgacgcagctgcagaggctaaaaagcacgcaagccaagaggcccgagaaggtcaccagcgtagaggaggagcaggcgctggccacgatcaccgaaagcgtcgtgagcacgctataaatggtgagcaggcccgggctcggcggcgacgtgaacgatccttcatcgcgtttgccgtgcagcagggccaaacagatggtgggcaccatcaaactcaagggtggcataaagccggtgcaacagagaaagacggtgcctttaagatgcggaaaagccagcaccaggcccagacagagcaagaaggtgcaggtgccctgcacggccacggtgctgtagacccgcatacaaagtaaaaagcgacgtacgtcgttcgtcgagacggaggaaatcataatgactccgcgcgagggtcgcgggggtgggggcgcccaggccgtctcggtggcctctgagttcggagacatgacggcggtggctatcaaaaggcgcgtatgagaaaccgtttatagagtgtaatagaatcaccgtcattcccacacggcgttcccccataaagtcacgtcacactcgagtaagcgtgaaaaagctttattgttgaataaaaaacacgagtacaacaccgagttgcggtgtcctgtctgtctactgggtgggggaggttcatcgtctgtctctagagggaaggtggggaacgtctaagcgagcgggagcgtgtcatctcccccatctttttacaacaagctgaggagactcacgccgtcgatgcgtccgccgtgtttctcggcgtactgctgcacccagacgtggccgctaaagatggcgacgctcatgtttaggagactcatgacgatggtgtacaacacgacgctgacacagacgctgtttttagacagcgttccacgctggtagatgagatccagggtttcgtaaataagcacggccgaagcggcggtcaccaccaggacgtagagtccgctgtagatcttgctgacccacagcacgggcgaaaagtaaagcaataggtaaaagacgatgacggaccagccgtagccaatcccgatgactttccagcgcgtgggattgttgccggccaggtaagtgagaccactgcagagaacgaaaaagaccatcaccagggcaaacgacagaccgatgacgcgcctttctccgcaaaagcccgtgcacacggtgatgccggtgttgatcagcaggcacgccaccgtgagatgagcaaaattggtggtgtgtgggcgaaactcggcgaaaccgcgtagcatggccagcgtggacacgggcacgatggaggacagggctggcactatgccgttggcgcactgtccttgcacatcggggaaggcgagccaagccagcaggcagaccgtgagggtacaagccagctgccacacgagcccgtgatagacctccatgagcagcttgaagcgtttcaaccactggaagagctgctgttcggccaccagcgcgtggctgcgatggagcggcacgatggtgaccgtcggcgactcatggtgttcggaaaccgaggcggtgtcgcccatgctgccgcttacgaccgctgtcggtctaaggtaggcgtcgatgaaacagtccgtcttatcagcacccggttaccacggatttgattgacgtcacgagtgtggtcaaaccgtggcggcaccctgtatccgacccgtcgtcatgggctccacaaccagagcctcagaagatggtacatgccgatgaataaagccacattttcgacatagaggcgtagcgaggactgaaaactctccgggaaagaactctgacaggtgatcagggacagatcgtgaattagcatcagcgtcaccgtcaacagcgtcgtcgcgtgtaaaccgagaaagaacggggtcgcggcctgcagcagccaaaatcccagcgccgtagcgcagagcagagacaggaccgacggtagccacagccgccggagagacgcgccaggatcgcaacccaaaagcgaggcccccaggcagccgagatctaccgccagggcgagaagagccgcgccgagaaaggcctgcagcgacggctgacacatcagcaaggtcagaaaggctagcgcgtgcggcaggcagtaagccaacaggagtaggagtttgcggggacaacggtcgatcgacggaccgcgtagcagcaggaacaggcagccgacgggtacgacgagactgagatgagaaagcggcggtgggtcgtcgtcccgtccccgttcgcatagctcggccaccggtggcggcatgagccaccagctgagcacgctgagggcgacggtagcgataagctggaaggcgacgaggacggaggcgcgcagccataccgccagcctctctaggtaggggactacctcctcgacggtccattctagcgggacgacatgaagcatggcgacaagcgcggctgctctgaaaacgggcacggttttataggcattaggacgtccccgtcgtactggcggctgtcaaagtcccgttgtccaaagacgcgccgtccgaaagactaatccaacggggacccgagagcatgagcaacaacgtgagaaagatggccatgctgtccaggtagagacagacggcatgacggatgcactggttaggtgggcagaaaaagatgaccatgagactgtcgtaggccagaatacccaaaaagaaactgatggagaaggcgcacaacgtcactactatcttctgcagccagtcggcgtcgcttagcagagcgagcgtgaggaacgaaagcagcatcaccacgtagacgcagctgatgcatttccagcgacgtcggtcacggccacctagaaacgccagtcccgtaaaggagataaacaacgccagggtcatcacgtaggaacctactagtacgcggctttcagagcacatttggaagatggccgccgtcaggctgttggccaacagatagataaaaagcaccgtggcgttactaggatgctcgttgcccaacgtgtacgtgatgaacatgcagacgatgggcacgagcacggtgagaaagaagctgtagttctcgacgcaaaagttgcggttttgtggaaaccccaaccaaaaaacgcttcccaaaccgaagctgaaagccagctgaaagatgaagatggcgtacacgcgcagccatacggtgaactttttgaaccactcgagagcctccatgcgggagagcaacagcgcgttagcctcctgcgcctgcatggtggcgacggtctcggcacaaagccgctgcggcgcacctacccttctcttatacacaagcgagcgagtggggcacggtgacgtggtcacgccgcggacacgtcgattaggagacgaactggggcgacgccgctgctgtggcagcgaccgtcgtagcgaccgtcgtctgagcagtgtgggcgctgccgggctcggagggcatgaagtagagcacggagacaaagaggtacatgaggtccatgtacaagcagagcgcgcccgggatataactctcatactcgatgtcgtgcaggatgtcctgtgtatcgcacaccaccgaggtcacgatgacggccaaaccggctatcatcaccaggatctcacttaccgcctcgggaaaaagagaaaatacggcgaacagtaagagaatcagcgtggatgcgcccgtcaatagggaacgctgtaattccacgtcgcgggcaaacagatacgtagcgagcgtaaggaaacaaaatagcgttactgtggccaccatggcataaatgactgaatgatgactaaagtggaagcctgacgccgtgacagccacgctggtaagcaacgtgtacgtcagtaagatccatacgtttttgggaaagttgggctcggcccaacgcaacagacctaggcacacgatggagatcattaagcaagacagcgtcagacgcacgctggaaaagagctgctccagccggtgcggcaacaccagccagcaaaaggcgcagacgctcataaggatgaggcattgcacccagataaggatgtagatgcgcagcaggaagaccgaccgggctatctggacctgaccgcggagcgacatggcggcaacgccggcggttatcgccgagatccgtctaaatacacgaagcgaactagaaaacgcacacacgttatttgcaaaaagaaagcagctgccggcttattattttattaaaaatttatctgtgcagaatcataagtttatgatgaataaaaacggggaaagggaatctgcttttagggacccgggtctggtccgtcatctcccatctggtcgggttcggggatggggacctgtttcagcgtgtgtccgcgggcgtgcatggcttttgctcgccgaccgcgctgtaaccaggcctctttctctgtggtcggcgagtcttccgacgggtagggagtctgggagtccatcgcttcaggcccaccgctcgttccctcgaccgtcgtgtcgtcctcgttttcgctattacacggggtttctggagtatcgcctatacggttagcgattctccgggggcggccgctctcgtcctcgtcgctgctatcgccgcccggtaattcgacgccgcattcgttgtacggagcgcggcacatgggcggcggaaagaacttgggcatgcgaaagcagcgttgtccatccacggtctgcgtggtttcatcgttatcctcccataatcccccctgtagcgccggcagcgtttccacgctgtgagagggaaaggcccagttttggttgtcttgcagcgcgcccgtgggcagtaggtccgtgcggccccaggcgctgctgttgttgggtaccttgtcagtgccgcgagtaggtcgcagaaaccaatccagagcgctctctagctgcgagcgtgtgatggtgcccagtgcgccgtgccagcgcagcacgtctcttttcagcgtgtggtgacagacgggcagctcctccaaccgacactcgccgcgcaatccgcggtcgaagcggcagagaccacgcagtttaagcagaccgcacttgagaaacatgtgaaaattatcggcaatgcgatacaggtctgagtcctcgatcttgtgtaggtagaccacgccaaacttgtcgagcagtaccaggccgctgggcacaaaaggcccgtaggccaggtaatagcccacgaggccgacgacgtaccactcgcagcacaagcgttgacgaataaagttcagaagatcgcgaaagtccgcggccggcatgtggtcaaaaggccggcaggcgcgcaggccctcgatggagcccagcatgagcaacggctccacctcggtgcgacccggcgtgcggatgaccaggttgagaccgctcatttcgcgggccgtcttggccacggccgcagcgtcagtggggtcggtgcagaggaatttttgcacatggtagcgcggttcggtggtggcgaacggtgtttgtgggtgccgatacacatattcgcaccagagtagaccgttcttggaaaaagctttgatatcactggccacctcgtagagcccgtcggtctcccagtcgtagacgtagacggtgccgtaatgacttagcatgagcacgcagggcagttcctgcgcctgcttggtgtttcgtgttagatcgctgtcgggtggacgtacggctagtacaccgacggcttccagggtgtcatcgcagcagagatagtcggcggccagagaacgtgcgtaaatctgcgggatagcggcctgttcgcgcatcactaggaaccagttggcggggttgcgcagtgctacggtggttccctggtggcgctgcacgtaggttctcagcgccggaggatcgtactggcgcagatagaggccttgcagcatcgataacgtcttttgaaagacggtgtttctaaattggaaaacgccgtagtcgcagcggatagcatcttcgcagcgctcgtcgcgctgtcggagataggtgccccaggcttcggcggcggctttggtgagtagggacatgccggcaaagccgtctcgacagcgagtcggataaagcgcgctgcgcgaaagcttaatataggagcagcgtcagacgaatcgcggctggtggcccggggggtgggacgcgccgcctacacaaagtgctcccgaaaatcgaaactcttgacccactccggagacaaatccgtattcagattgatgcgtcgcgcttccacttcggcttccgaaacctcggcctccgtccggtaggcgttaacgatacgctgacccaggtgccaacgttctttctctgccaaacgccgttgctcaaaccattcgtctacgtccttgaggtcaaagacagtgtcctcctcaaggtcaaagcctaggtcttcccactcgtcgtcatcgctctcgtggccggcagccatacgcgcggcaaccgcgtcttcccctcctcttctttcaacgttgggtaccacgttgttttcttcgggttccataggttctgcgccactgtcgtcatcatcctctccctgctcctcatcgtccgtcaaggcgtcgtggattacctccaggttctgattgtcgggtacgacgtggttatcttcgtcgtcgtcgcgcggcatgggcggcggccgacggcggacgaccggcatggcgcggccgtcgtttctttcgtcttcctcttctccgtctcccagggaacgcggtcgacggcgttccgcgaagtcgccgcggaccacgcgcgcctgccagatggtaaatgcgtcccaaccgtcccagttatttagcatttcggcgcggaaacggtcgcctcgacagagccagcgaaactgccgcgcgtagtcgcggtctacgccgctgtcgaacatggtaaagtgaagacgcgccgcctcgcccatgtgtacgcagcctccgttgcgttccagcctggccgcgcgccgcagaccgtgttcgtagcggcgacgcacgtacaccttcatgaggccggcgcgaaagagttcctctaggctgtcggccagacggtagatttcaccggctagacgctgcaggggcggcgagcggtccaggtgcgacttgacgattaccacgtaaaaacgacagaaacggtcgaagatgatgaggaatgacgtgtcaaagaaaccaccggcgcggtaggagcccacggcgcccagcaggtaccagcggcaacgcagttgcagcgtgacgtacatttcgcactcggccaagcgggcggctggcgctacctcgaagggccagcagtccgtcaagcagccgaaactggtcaggagtttcaacgttttggcatggcgtccaggtgtatgaaagttcacgtcgcgtccgtggtgttcgccaacgcaggcggccaacgcgtcggcgtcatgaccgtgacgcagcagcatcgctaccacgtcgtgcggtacccgcgtagcaaacggcgtctgtggctgacggtatacggcttcggtgtacatcataccgtaacgcgccagttcgtccagatgacgcgcgcacagcagcagaatctcttgcgagggttcgtagatgtagaggcgcgtaccgccacccatgcagagcaccagctccgtctcttcatagtgatcttccaccatgatcacgcatttgcctagcacgataaggcgttcggggcaacaaatcacgtcgtccagcagttggtcgcgcagctccggcatggtgctgccaggccgcacctgcaggaaccagttgtgcggaatgccgagcgacaacacctggtcgacgtggttacggacccagtcgcgaagcacgtcggcgctgtactggcactcaaagatgccctgaaagtcgcccatgacccgcagaaaagtttcgtagcgcgtgtggcaatagaggaattcatcgtttcgcgtaaacgtgggagctccgtcttcccagcgtgtacgccacatgtcaaaagaggccgccagctagacaccccagaaaagaagcagagaaagagagttctttgtgcgacacgttttattccgcgtcctccgctcgacgctcaaatctggatgtactcgcgcacacccgtcaggctctttaagggaaaagggtccgagtacgtcactaaccgcgactgatgcaccagggcggtaatcacccgctctgcgccctcgcgcgtcgacgaacgcgtcgtcaccaggcagtgcagccgcgggcccgtatcgtcctgatgaccagcggcctcgcgctcggctgcttccacaccgacaatgtcgggatccaacacgtagctctgcgagttggtgtcgtagcggtgtagcaccaacgtgttggggtccagacgctcccacgcgccctcgtgcgggtcaaaacgctccgttaaacagagccagtcatactgctgctgcagaatacgccgctcgcgctcacgtcgctcatcgggcaacgcggcgtcttcgttgaagagaatgtcccgcttgtggtctacggcacgctcgtggtggtgcgggcacagatgacggtgttccatacgcgtctgacgttgacgctcgcgctcaaaacgccggtgtcgaaagaccattttcagcaaccccatgcggaaaaactccgtgatggtgttggcaacgcgtcgcacgtagtggttggggtcgtccatctggatggcgtacacggcaccgaaccagtccagcagtaccagcacttcggccacaaagctgcgtcccggtcgcggacgtcccgtcacgcctagcacataccacggcgtggccagattagcacggacagcccaccaccaacgacggctctccacctcggtgagcgcacaaaagggccaaatgcggtgtaactgctgcaccgttttcatcagccgcataatcaccgtgccgtaacccggtgtatgcaacttcacgtcgcaacccaggattcgttcggccgtggcgtacgagccctcaggcgtggtgtcattgagaaacaaaacatgcatggtacgcgcgcccttagggtatcgtcgcggaacaggtaccgtcattctccgcaaagtggtgtgaatcacgtcgcgatacgcaatctccgaacgtgacacaccgtaacgtgccagttcgtccaggttgtgcgataccaacaccatgtacttttcacgggtgtcgtaggcgtagacgcgagaaaagcgacccataaaaaccacgtacggggtagccaccatgccatcatggtgatcgcgacgtggctcgggcaacaaaataacagcgtatcccaacggcgtcagcggctcgcggcaacagatgagctttgacgccgcctgtttggcggcggtaatgatcccgtcctccgtacgtaacatcacatgccagcccttggggggacccaaggacagacagcgtccctcgttacgatgaacgtaacgcgtgatttccattggctccaggcaaaagaacagttccttaaaatcccgcaacacttgtcggtataacgccatgggatcctcggccgccacaggcagcgcggggagctccggcggcacaactgcagcgccgtcagggccagaacccgcagccggatccatcattgcgcgacactctcagccggacaaccggcgtcactgacagaagccgaaccaaatacagagaaagcaacgctacaccgtcaccccgctcccaagcgccgcggaaagtgctccgatttttcaccgtcgttcgcgacgttgatttgcctcggtctgagaaccgacctagcgttcggaccggtgcgcagaaacagccggcggtccgagccactgagcggttcacagccccggccgccgatagttaccggagagacgttcgagctgcaggtacatcggcgctccccgcttcgccaccccgcgcccgccccagtttatactctccgacgtcccgtccaacgcgcctgtggagggccaatcggaccgcgggagctctccaagtggatgacaggcacagccgggtggccgaccgtgaagagccctcatccacctgaacagaccgctaaccgaaggaccccgagtcgcgtccgttggtcccgacgtccgtcgccatctggctccctgctgttggctacctctcggatttcaaaaaagagcacgtgccgatgacggtgcacaggaaagagccaaagtgtcacagcgtctttttttatttgtattcctttcctgttttgtactcgtaaactgttgacgttgtttttacatccaaaagggcaagtaagaaacaggatgaggcatggtaggtttgggcgcggggcggccctccagcacggcggcccgggccgcccggcgggtgagcacccggcgttgcgccgtatctatcttgtgtttcttctgtgtctttttcctatcttgttccgcgacggcctctttcatcacgttcagcatgcgttcctcgacgccctccagggatcctggggaggagggagtcctagtgaggcttccaatgttgttttgtggattttcggtttcctcttcttggtcgtcatcgtcggacgtgttgtcttcctcttgatcctcttcttcgtccgaatagtagacgcatagtccctggttcatcaggctgggattcatcaggttctgacggggaatccgctgttgtagacgtttaaccgcccgttccaggcgagagctcatgccgcaccagacgctgtaacgccgcacgggcccgtagcgggctgtttgttcgcgtacatgatcgttgagctcttgccaatattgtttggcacactccagatcggaggtttgtggatagtcgggtcggatccgcggatcccaactgacatcggcggtgccagagacttcgtccagactgttacgcatagagcaccagtcgggtcggacgataaacctgtccttgcggattaaccatttataacgtagttcgtgatggcgtgtagaggcccgtacacgctccacggtcccaaagcggtcccagaagggaaagttttcgtgagggcagcgacccggcacttccagacgttcggcgtcgtccacggcgtagtgaaaacgccggccggcctggtaaattttgagcagacccacggttaacaacatatccacgctgtcagccaaccgccagatctcgcgtcgagacacgtcaaaatagaaaaattcacaggctcggtcgaccaggatcacgaaatcggcgtgaaagacgccggagggtagcgactcgcccaccacacccattatcatggtttcacagcataagcggtccacaaagaacttcaacaggtcgttgaattgctccgtctccatacagatgaagggccagacgcctttgaggttctcggcctggccgcagagcagcaacggacgcgtcatctcgcctggagtgcgcagaggcacgcattcgccgcgataacgacaggtcacacgctgcagttcgctgatgctgttgtcgtgcaggcgaaggtcgcagataatatgatccggttgcgtggttagcagtggcgtgcgcatctgctcgccgtagatggcctcgcagtgcaacagtccgtgtcgcgcaaaatcatccagactgtgcgccaggtagtaaagcaccccgcaatcgcggtctaaacaccacacggtttcgtaacgtcctagcaggagcaccagacgggcctggctaggtggctcaatttcctctacatatacgaaaaagtcgtcatcgtccgagtcctcgtcctcagaagaggaccgcggcccgtgtactctgggcaacacggtggtagagaactgcaggacgcccagagactcgagcgactcttcgcagcagatgagctgaccccagggcgtttcgggcccgtcggtgacagccgcgctgccaaagatgtcctcaaactctacaaaatctagacgccatccgggtggcgctgaaacgggaaggctaatgttcatatcagcatagctacgaactaagtggcggatgtcctgccgcaagtcttggcagagaatgagctttcgtaaacccttgagggtcctccgaacaacggccccagacgcgtagcgataggactggcgcatggtgccgcggcgtggagcggcacttggcagcctattttatggagtttcttcagtgacgtggcttgttcacgtcgttcgtgggctgcggttggcagctccggtctgtaaaccacccgaaaagactgacatcgacgtcaaagactcacgtaatttggaacatgtgcgaccgcaaaatgcgtcagaatagcacgtggctttaggacataaaaagtaccgtgaggtctagacgtggtttttgtgattgacacttacaccaggtaagccaagggacggtgaaactgtatgtgaggaacctgggtgcttagacaactaacgtgtaatgctttttacaggaccgttcaacaggtgatactacctgcaaggtaatgactacatctactacaactaccactaatatcatgctacaggtgagcaacgtaacgaatcacaccttgaatagcaccgaaatttatcagttgttcgagtacactcggttcggggtatggttgatgtgcatcgtgggcacgtttctgaacgtgctggtgattaccaccatcctgtactaccgtcgtaagaaaaaatctccgagcgatacctacatctgcaacctggctgtagccgatctgttgattgtcgtcggcctgccgttttttctagaatatgccaagcatcaccccaaactcagccgagaggtggtttgttcgggactcaacgcttgtttctacatctgtctttttgccggcgtttgttttctcatcaacctgtcgatggatcgctactgcgtcattgtctggggtgtagaattgaaccgcgttcgaaataacaagcgggctacctgttgggtggtgattttttggatactggccgcgctcatggggatgccacactacctgatgtacagtcataccaataacgagtgtgttggtgaatttgctaacgagacttcaggttggttccccgtctttttgaacaccaaagtcaacatttgcggctacctggcgcccatcgtgctgatggcgtacacgtacaaccgtatggtgcggtttatcattaactacgtgggtaaatggcacatgcagacgctccacgttcttttagttgtggttgtatcttttgccagcttttggtttcccttcaacctggcactatttttagaatccatccgtcttttagcgggaacgcaaaacgagactctccaaaccgttattactttctgtctatacgtcggtcagtttttagcctacgttcgtgcttgtctgaatccggggatctacatcctagtaggcactcaaatgaggaaggacatgtggacaaccctaagggtattcgcctgttgctgcgtgaagcaggagataccttaccaggacattgatattgagctacaaaaggacatacaaagaagggccaaacacaccaaacgtacccattatgacagaaaaaatgcacctatggagtccggggaggaggaatttctgttgtaattcgatcctctctcacgcgtccgccgcacatctatttttgctaattgcacgtttcttcgtggtcacgtcggctcgaagaggttggtgtgaaaacgtcatctcgccgacgtggtgaaccgctcatatagaccaaaccggacgctgcctcagtctctcggtgcgtggaccagacggcgtccatgcaccgagggcagaactggtgctaccatgacgccgacgacgacgaccgcggaactcacgacggagtttgactacgatgaagccgcgactccttgtgtttttaccgacgtgcttaatcagtcaaagccggttacgttgtttctgtacggcgttgtctttctgttcggttccatcggcaacttcttggtgatcttcaccatcacctggcgacgtcggattcaatgctccggcgatgtttactttatcaacctcgcggccgccgatttgcttttcgtttgtacactacctctgtggatgcaatacctcctagatcacaactccttagccagcgtgccgtgtacgttactcactgcctgtttctacgtggctatgtttgccagtttgtgttttatcacggagattgcactcgatcgctactacgctattgtttacatgagatatcggcctgtaaaacaggcctgccttttcagtattttttggtggatctttgccgtgatcatcgccattccacactttatggtggtgaccaaaaaagacaatcaatgtatgaccgactacgactacttagaggtcagttacccgatcatcctcaacgtagaactcatgctcggtgctttcgtgatcccgctcagtgtcatcagctactgctactaccgcatttccagaatcgttgcggtgtctcagtcgcgccacaaaggtcgcattgtacgggtacttatagcggtcgtgcttgtctttatcatcttttggctgccgtaccacctaacgctgtttgtggacacgttaaaactcctcaaatggatctccagcagctgcgagttcgaaagatcgctcaaacgtgcgctcatcttgaccgagtcgctcgccttttgtcactgttgtctcaatccgctgctgtacgtcttcgtgggcaccaagtttcggcaagaactgcactgtctgctggccgagtttcgccagcgactcttttcccgcgatgtatcctggtaccacagcatgagcttttcgcgtcggagctcgccgagccgaagagagacatcttccgacacgctgtccgacgaggtgtgtcgcgtctcacaaattataccgtaataaaaaagcgctacctcggccttttcgtacaaaccccgtgtccgcccctcttttccccgtacccgatatacacgatattaaacccacgaccatttccgtgcgattagcgaaccggaaaagtttatggggaaaaagacgtaggaaaggatcatgtagaaaaacatgcggtgtttccgatggtggctctacagtgggtggtggtggctcacgtttggatgtgctcggaccgtgacggtgggtttcgtcgcgcccacggtccgggcacaatcaaccgtggtccgctctgagccggctccgccgtcggaaacccgacgagacaacaatgacacgtcttacttcagcagcacctctttccattcttccgtgtcccctgccacctcagtggaccgtcaatttcgacggaccacgtacgaccgttgggacggtcgacgttggctgcgcacccgctacgggaacgccagcgcctgcgtgacgggcacccgatggagcaccaacttttttttctctcagtgtgagcactaccctagtttcgtgaaactcaacggggtgcagcgctggacacctgttcggagacctatgggcgaggttgcctactacgggggttgttgtatggtgggcgggggtaatcgtgcgtacgtgatactcgtgagcggttacgggaccgccagctacggcaacgctttacgcgtggattttgggcgcggcaactgcacggcgccgaaacgcacctaccctcggcgcttggaactgcacgatggccgcacagaccctagccgttgcgatccctaccaagtatatttctacggtctgcagtgtcctgagcaactggttatcaccgcccacggcggcgtgggtatgcgccgctgtcctaccggctctcgtcccaccccgtcccggccccaccggcatgacttggagaacgagctacatggtctgtgtgtggatcttctggtgtgcgtccttttattagctctgctgctgttggagctcgttcccatggaagccgtgcgtcacccgctgcttttctggcgacgcgtggcgttatcgccgtccacttccaaggtggatcgcgccgtcaagctgtgtcttcggcgcatgctgggtctgccgccgccaccgtcagtcgcaccacctggggaaaagaaggagctaccggctcaggcggccttgtcgccgccactgaccacctggtcactaccgccgtttccgtccacgcggatacctgacagtccgccgccaccgtaccagcttcgtcacgccacgtcactagtgacggtacccacgctgctgttatatacgtcatccgacatcggtgacacagcttcagaaacaacgtgtgtggcgcacgctacttatggggaacccccggagcccgctcgatcgacggctacggttcaggaatgtgccgttcttaccgccccaaattgcggcatcgtcaacaacgacgccgcggtctctgaaggccaagaccatggagatgcggttcaccatagcctggatgtggtttcccagtgtgctgctgatactggggttgttgacgcctccgagtaacggctgcactgtcgatgtcggacgaaacatgtccattcgagaacagtgccgccttcgaaacggtgcgacgttttccaagggagacatcgaaggtaacttcagtgggcccgtcgtcgtggagttggactacgaagacgtcgatattactggcgagcggcagcgacttcggttccatctcagcggactcgggtatcctacaaaggaaaatacaagaaaagacaatgaaagcgacgtcagcggtggaattcgctgggctctatatatacaaaccggtgacgccaagtacggtattcgtaaccagcatttgagtatacggttaatgtatcctggggaaaaaaatacgcaacagctgttgggctctgatttcagttgcgaacgtcaccggaaaccgtccacgccgttgggaaagaacgccgaagtgcctcccgcgacccgcacgtcttctacatacagcgtcctcagcgcttttgtagtgtggatcggatccggcctcaatatcatctggtggaccggcatcgtgcttctagcggcggacgctctcgggcttggcgagcgttggctaaggttggcgctgtctcaccgggacaaacatcacgcatcgcggaccgcgacgctccagtgtcaacgcgacatgttacttcggcaacgtcgacgggctcggcggctgcacgccgtttctgaaggcaaactgcaggaagagaagaaacgacagtctgctttggtctggaacgttgaggcgcgaccctttccgtccacacatcagctgattgtgctgccccctcctgtagcgtcagctcctcctgcggttccctcgcagccccccgagtattcgtctgtgtttccgcctgtataaaaataaagagacgagaggctgatcgcggccttcagcgtctcatttgtctttactctccagtgcggtcggtgtctcgtcggtgagacgaggccgccgcccgacaagttcgatctcatgtcgctcttggaacgcgaagagagttggcgtcgcgtagtcgactactcgcacaacctgtggtgtacgtgcggtaactggcaaagccacgttgagattcaggacgaggagcccaactgcgagcagccggagcccgcacactggctggaatacgtggcggtccagtggcaggcccgggttcgcgattctcacgatcgctggtgtctctgcaacgcctggcgtgatcacgccttgcgcggccgttggggtacggcgtattcctcgggttcctcggcgtcttcctccggttttgtcgcggagagcaagtttacctggtggaaacgactgcgccacagtacccggcgctggttgtttcgccgccggcgagctcgatacactccgtctaactgtggggaaagtagcactagcagcggccagagtagcggtgacgagagtaattgcagtctacgcacccacggcgtgtacacacggggtgaacaacactaatcgataagtcgcgtgtaggcgactggctacatcaaccggatatctgtggggatttaaaaagacgacccgttgtcatccggcttagagcaaaccgtccttttatcatcttccatcgccatggctatgtacacatccgaatccgaacgcgactggcgtcgtgtaatccacgactcgcacggcttgtggtgcgactgcggcgactggcgagagcacctctattgtgtgtacgacagccattttcagcgacgacccacgacacgagccgaacggagggccgccaattggcggcgacagatgcggcggttacaccgtctgtggtgtttctgtcaggactggaagtgtcacgcgttatacgccgagtgggacggtaaagaatccgacgacgagtcgtcggcgtcttcctcaggtgaagcgccagagcaacaggtccccgcttggaagaccgtgcgagccttctcgcgggcctaccatcaccgcatcaaccggggtttgcggggcacgcccccaccacgcaacttgccgggatacgagcacgcctccgagggctggcggttttgcaatcgacgggaacggcgagaggacgatcttcgcacgcgggctgagccggatcgcgtggtgttccagttagggggagtaccgcctcgccgtcaccgggaaacttacgtgtaagaacacggcgtgataataaacaacatagcgtaaatccccgtgtgatgtgtgtgattgacgttcaggaaacatgtccccatcatcagcgtcacaactgacgcgggttggttactgacgtgcaggatgttacgcgagtcagagaatcgcataagaacggggtggtgagcgggttcccacaggagtctctggcgcaaaagcaccatgagcctcaggttccccgagagggcgggttacgagaaactgggacaccgcccgcatgccaaacgcgtgcgggtgcatgacccgttgggattgacgcggtttatcatgaggcaactcatgatgtacccgctggtgttgccgtttacttttccgttttacgtgccgcggtcctagcacgtcagtggtgacgctgataattgcaacatggcccatgacgaacccgcttgggacgaacgtcaataccacgtcaaaccaccgtgacttggctgaacgttgaaacataaagccaaagcgccgtcggcacttggcttcagagcagcgcctcggggcgatgcgacggcgatgaacttagagcaactcatcaacgtccttggtctgctcgtctggattgccgctcgtgctgtcagccgcgttggtccgcatggctccggactcgtttatcgtgagcttcatgatttctacgggtatctgcagctggaccttctgggaccagtggtggcggggaatcgctcagtccggacctggagagagcaggcggaccgagccagagggaccttcgctcggcgttcaggccttaatactagccacatcttacctgtcggcagcatgtatcggggctccgacaccttatccgccggcttgtatcgtcccgaagaagaggtgttcctcctcttgaaccgctgccatgggccactgtcaacgccgaaaaacgcttgtctggctgaggtcggtgtcgctaatgccacttttttgtctcgcttcaatgtcggtgattttcacggagcgtcatgggaaaacggtaccgctcccgatggagagcccggggtatgctgaaattcttcttaaaattacgtaaacgacgtcgtccagtcgttgtgccgcgattcgtacggttcatcgtctacgtcgttttgttcaccgtcgctgtgcaacgtgtgaaacaagagcgtaatgcgcaccttcggcggtatgaagaacggttacggaaagaccgcgcacggcgtcggcaatcttttccgtgacttggggcgatgggtccgagctgcggtatgggtcacggcagcgtgtgtcttgctaacgaagatgccgatgtgtgactaaaaacgtcccagccccagagcgatatgtttcaataaaaaaaatatgtagtatcatatcatgcgtgtcctggtttttcatttttggatatatgtatcgcataaagggtggcgaggtgtgaggatgaaacatatgcagatacgcagttttgttatccgaacgaaacccgtgtaatgcgtacaacggtacttcagtatgaaagtcccgtggggggggggggggcaaatagtcgcgtttgccgttgggcgtacgctacgtttgtatttctggctataatatgtgcggtcatgtgtcgatgttcctattgggaagggtgtgactgtagggtgtataaagtacggtgggacgcagagggacattgatagaaacaggttgagcgctgtacgagtttcacacgctgattcggcgccaagaataaaacagtggttattcgtaaaagtatggggggggggatgttgtcgacggttgttagatgcattgcgtatctgtattagtagttttgcaagccgtggtgcgtgttattgtgacgtagcaattatcgtattgtgcatgtgtcgttcatcacagagtttagtatactaatatgaagcgtcgcgagtattaaagcaattggtgtctctgtgctagtctaacaacacctgtgtaatgcgtacaaccagaaaaaagacgcgaaagcaacgtgtatgggggggggggggataatattgctaatcatgcgtcttgcagtacagatagccgctgtatcttacgcgtattgtcgcaatagttccacatcggtgtaattggatgtctgttacttatcactggcgtcgttataacattgtaaaacataagttttcgaaacataacgacagctgcaaaagaaaaccagtttattgagcattgtaatggtagtgtgtggctatattagaaaacgtgacgcgtcgcatgtcgcggcacaatctggcagcggggtcggggtagggtacggtgggaggcatgtacacagatggaacaaaagcagaagtaacgtgagacggagcatatagtccagtatccagcggttcctgagtagcaccacccatcaactgaatgccctcatgagtaaaagtctgcgggcggcagcccttggggaccgttggcatgggacgatcaatctccaaaccacagcgtaacaccgttttcttccaacgtcgttgatacacgtcgtttttacggttactccccagaacccagaaagtctcgtccaagtcgtaccaggaatcttctccggggagacgcgacggtttccaatcctcgtcgtctcgtctcaaagcacgtcccaaactggcttgaggagtcaacggtggttctgtgggtcgggtgtagcgcgagtgttttcccttcatgagcgatccgtcctccttgcctttaggctttttggtctttttgtgtatcatctggccgccggcctccataaccaccgtggccaagtccagtcccagagcttgagcgtcggcgcggcgtcgggcgtcttgcaggtagtcttccacatttgcacagatggccgggtgtttggtggctagggtgaggacctcagcctcgccgcgacccggacgtagcaaaaaagctaactgcccgtgcggctcgcgcgcccacagcgcggcgcgcgggtgcaggtgcagcgcgtcccagcgcggccgctcccactgctcgcggtccagctcgggcagcagccgccgcgcggcctcggcggcgggcgccgactcgcgccccagcgccagcgcgcccagcacgcccgcgcgcagaaagtgcgacagctccgccgccagcgggtacacgtgtccgtccagcgggcagtacccgaacacggcgcccagctcgtccagcaccaccaccagcatggcgcgcggcacggtgtccgacgccgccggacccgccatcgccgccggacccgccatcgccgtcggacccaccatcaccgtcggcgccgccgccgcgtccgccccgaccaccgtgtgcgcctccgcgtttggcacgcacaccgcgtgcccgccggcggaggtgccgtacggctgcggaggcacaggtacagcggaccccacggctcccgccatcgcgcacggcgcgtccccgccggcggcctccgtctccgtgccgctcgcccccgccagcaacgtcgtccccgtcgccatcgccgtcgtccccgccgtcggcgacgtcgtccccgccgccgtccccgccgccgtccccgccgcgcagcccagccaccgcgcgggcagcaccgcgcccagcgccagccagccgcagcacagacgctggttcaggtgccgacgcacggccgtcagcagcgacgcggggtgcggcgccgacgcgaacggctcgtactgcgccagctcctgccacgcgcccagcagcaccatcggctgcagtcgcctgcccggcgtctgcagtgccaccgtcgtgccggcccaccgccggcgcagctctcgtccgagcgccgtcgcctcctcggcgcgcagcaacgtctgtcgaagcgccggctgaggcagcagcgtcgcgcgcggggtgcccacgcccagccggttgcagcggtacagccgcaccacctcgcccgcgccgtgccgaaaccactcgtccgcgtcgcgcgccgccaggatcagcgtgttgttcgccagctcgtacacgaacacgcggaacccggcgcccagcgccaggtacagtccgtcctgcgcgcacagaccctcgggatggccggccttgtcgcccaccgtcgggtcggccgcggggtccacttcgtgcaccacggtcgccaccagcacgatccacgcgtcccgcggcgacagctgacgcaggtccgtcgcgcccacgccgttcatctggctgcgcggcgtcacccgcgcgtagaatccgtacggccgtccgagcggcagcagcgtgcccgcgtcgcgctgcgaccacttgcgcatggcgcggcccgtgctgttggccagaaacgccgcgcgccacacggcgcccatggcctggtattccagctccgtcagcgcctgccgctccacgggaatctgagacagcaacaggcgctccgggccgtgccaaaagttgctgttgttgccgctacccggaggggcgcccggcggcccgcggggttctacccggtggacgccgtggcccggagttgccgtacccgcagtactcgtactagtccccgccgttgacggtacagaagaggaacaggaaccaaccctcgaaggcccgccggcaccgcgtccgcgaccgaggggcggggggcgcggcgacatgccgttgcgctgggccatggccgccggacacctccgacgtcgagccgatgtccactagatagcaacacaacccgcgtccgcgaccacgccgtttacacacgcggacggctccgtggcccgtgtgccacgggcgacacgcatctggcttttatagccagcgacgtgaacggcgcgtgctagcgccgccttggcgccgcgcagtctaaagggctgtggaaaaccagccggcagcccagccacccgaaggaacacgcgcgacaggcccgcagcaccggagcgcatacgcgcgtcccgagcgcgcaaccacctaagtggacgccccacatccattccgggccgtgtgctgggtccccgaggggcgggggggtgtttttagcgggggggggtgaaatttggagttgcgtgtgtggacggcgacggcgaatagttgcgtgtggtgcggtggggacggcggtcgcggacggcgaataaaagcgacgtgcggcgcgcacggcgaaaagcagacgcgcgtctgtgtctgtttgattccccggggaaaagaggaaaaagtccccaggggacggcagcgcgggtccctggggacacacgaagagacaagacgcagaaaagaggaagtccccggggaaaacgtgcgaccgcacccggcacacgcccgcgacacaccctgacacacccggcacacgcccgcgacacacccgcggcacaccctgacacacccgccacacccggcacacacccacccagccgcgcccccgacacaccccgatcgccgccggtgccgggacagggctcagggggtgttgcgggccgtcagcgctccgccgcttctgcgacgtgttgtccacggcgctttctgcgcgctgccgttgcgtgtggctccacagcacttttcgttccgccagtccggcacgggacagggttgaggaagcgttgcgggacataagtaagcacggcggcgtcctcatcgcgtttgcggcgtgctgtgtccggcgctttgtgcgcactgccggtgcgtggcgtcccgcggtgtttttttttttttttccgcggaccggcgccggggacggggtgttgcgggcgctcgggggttggcggcgggtgtttctacggtgtttgtgcggcgtttctacgcagcttttgcgcggcgcttcgcttttcggggcggcgacggcggtgttttcgggcgtgctgggcgccggcgccggtaacgggagttacgctggggacggggacgggggttgcgccggggacggggggtgtgcggggacgggggggtgtgcgtggacggccacgggggccttttgcggcggggacttgcgggcttttgcggcgggcacagtagtggggacggggagctttggcgctggggacgggggcctcctgcggcagggacggggcgttgcggggccgggggcgtttgcggcggggacgggggcctttcgcggcggacacagtggtggggacgggggactcttgcggcggggacggggacgggggtggcgccggggacgggggcctttcgcggcggggaacacacacggcacgcacacgcagctcgccttagcggtcgccctatcagaaccgccgctactctttattaacgtcttaatccccccgcttctacacgcaacgctgcatacagctatgctcacactctatctcttcacagcgacatgttgcttcgtctatgcgctgccgcgacaagcacaagtggacaccgccatctgccaccacacatggcccatgtgctccgtcgtcccgcatcctacgtcgtctgctcacaacacggcgctttcttccccgcacgccatctccatcgaacaccgtctgctgcattcgccgtcgcctccacgagagaacatacgccacagcatgcgctgtcgccgccgcgacatggcctcctcggcttccacacctgtttcgcacacccaacctctggctgccaaccacagacgttcaacaatcacgtacgcgacgaccgatcccaccaattctccaacggcctcgcccgccaagtcagacaagctggaagccgacgcagacacagcactccatcgacgcccggcctcgctgttgcgccacctcttccagccctgccacgcccaacgcggcacttccaacagagccacatcccagagggcttccttgaacgccgtgcaccacaaactctgcggcgcgatgatctcttcgtcgtgttccaccacttgcacaccgctgattatggacttgccgtcgctgtccgtggaactatctgcaggacacaagaaaaaagaaacaccaaccgagggtgggtggggcggtgaagaaggggaggacgacgttctcgccacgatccgcaacacgttgtccgccccaacctcacctgctgcggctaccacgcatcgactgtcgttccctggagaatcgaccttctgcctcaccgctgtttccgagtgctcacaacgtcgaacatcaacggctgcattaacgccgccgccgccagcggtagctgctgcgttctctttttcgtccacggtctccgagaccggcacttttccgcagagcacaacaggccgcacacgtgtcaacgacaccgccgtcgttaccgccggagacccgcgctctcctgtgacacacgtaactctcctccagatattccgtctgcgtagctcgctgctgacgagcaggtccggcggcgctctccgcggaggtgagcacgaggccatccccaaagtcgcgtcgctgttctggacgctgctcaaagcaacacagatagttgacatgactcacaaaacaccgagtgccgactctcaccgcaacccacaaaaatacaccgaccgcccacaacgcctgctgttgacagcacttgccatctggcaacgaacctacaatgacacgcgtgccgcccacgcgccgcaagtgcgcctgctcggcgacatcctcacttaccgcagaccgcaaactgccaccgcgtctaccaaagcacacacgcagcagcagccagaggaaccaaaaggccaacagatctggacgcagacagccggccaggccgcgccacacggcgacgagccgcatagcgacggcgagctacgccgcgagtcgcattctgcaccgccgacgtctcgtacactacccgatacgattttggcagtgaaacgccgttccgttgcccaacggtcacacgtccgactggacgcgaaacccggactgaatgagcgagacggctttcgccgacggttgttgctccccttatccggctatttccgcgccaacgagctccggaatcaacaatttatgggctatggaacaaagaacggccttaagaatacttggctcacccgccctctgggtgtcgcggggggtgtacgggagacgattggggagcgacaagacaggaacgtggcggactctgcgacgcaacgcattttccacacgttgtacgccgcactgcagaccgtacgggtgtggtataccgcgttaggcaccgcgtggcgtacctcggggtctcgtacgcgtgagtctctgttcgatggtccacgacgtcgcgatcggcaggcgggccggctgcggcgctcggagctgtagccgcccgggactcgtctagccgctgctgccgccgctggtctgcgcctgccgctgcgtaaagtacatcagggccaccagacagactccgatgaagatgacgatagcaacgctgatccaccatctcctgatggcgttgtcgggccaccagggccgttccttggtcttgaccagataggtagtgctggtgacacacttgggcgccgtcatgccgcgactcctccaggttgttccggcagttgcttcggcgggtccctagtcgagggaaacgatccctgcggcggaggaggaagaggagtttccctggagcagcgccgtaggcaagtgccgcggcgcgtgtccgggtggctttataacggccgtcgatgatggtttttaaaccgggacgacggtggttcatgtgaagtaccaggcgacgatgctgaccatgacgccgagcagcagagtgaagacgatgacgttgaacaggatttccagatagtgttccatgttccgcgtggttcctgcgcggttcctgcgtggtttcttttttcctgtgttaacaccggcgttttcgggacggtcggttaacgtgggtttcaggggaaggctgtaagcacggggaaggagcgctgataggcaagacaacgcacgaaggtccaagcggcagcggcgccgacttccaccatcaggccaacgaccagcatccgcagcagcagcgcccaggcgatctcgcgctcgacgacggctacggcaacgaggcagaacatctccacccagacgacaagcgccagaagatagagcacggccggaaagaccgcgggcgttagcatttggtcgcggagaaggaaacaaaaacggttgaaaacggggactgtggagttgctttgttcaggagacgacgacgggagcagacgggatggcgctggatacgctagcggggctggctatctgcgtgggtctagtcatgggggtcaccgtgatcgcgtcgtgcgcgctgctggtgttttattattgcgatgagagggaggatggccgtccgtcgaagctgttgcaacgtagcattcgacgttggcgacacggccttagcaccgaatccttaaccgctatcctgccggacggttcgtccacggagcaggagatctaccacacgcgactttaagtcacggaggaagttacgtgggtaggagggcaccgtgccccgaggcggcgacgggctagcgtataacaagccgcgcgacgacgggcgagcggcggtgagacagacgcgggcacgtcggcggcgatagccatgagttccgaaagcctcgatccctggattcccgtgtgcgtcgtggtagtcatgacctccgtagtcctgttcgcaggtctgcacgtgtacctgtggtacgttcggcggcagctggtggcgttctgcctggagaaggtatgcgtccgttgctgcggcaaagatgagacgacgccgctggtggaagatgccgaaccgccggccgagctggagatggtggaagtgtcggacgagtgttactaggagatcgccgcggccgatgggcgccggcggacgtgactcggcagccgctgtagggataaatagtgcgatggcgtttgtgggagaacgcagtagcgatgggttgcgatgtgcacgatccttcgtggcaatgccaatggggcgtccccgcgatcatcgtgatctggataacatgcgcggccttgggaatttggtgtttggcgggatcgtcggcggatgtctcttcgggacccggcatcgcagccgtagtcggctgttctgttttcatgattttcctttgcgcgtacctcatccgttaccgggaattctttaaagactctgtaatcgacctcctcacctgccgatgggttcgctactgcagctgcagctgtaagtgcagctgcaaatgcatctcgggcccctgcagccgctgctgttcagcgtgttacaaagagacgatgatttacgacatggtccaatacggtcatcggcggcgtcccggacacggcgacgatcccgacagggtgatctgcgagatagtcgaaagtcccccggtttcggcgccgacggtgtccgtccccccgccgtcggaggagtcccaccagcccgtcatcccaccgcagccgccagcaccgacatcggaacccaaaccgaagaaaggtagggcgaaagataaaccgaagggtagaccgaaggacaaacctccgtgcgaaccgacggtgagttcacaaccaccgtcgcagccgacggcgatgcccggcggtccgcccgacgctcctccccccgccatgccgcagatgccacccggcgtggccgaggcggtacaagctgccgtgcaggcggccgtggccgcggctctacaacaacaacagcagcagcatcagaccggaacgtaacccgcccccggtgtgataaggaattttccgacttggcccacatctccttcctcagtgtttggacaataaacacattccttgccaaaaaatgacgtttccagaaatccaaggcataaatgtccgtacaccggcccttcccgacacggagtttgagattccaagcaggagagaagatcatggtgtggatatggctcggcgtcgggctcctcggcggtaccggactggcttccctggtcctggccatttccttatttacccagcgccgaggccgcaagcgatccgacgagacttcgtcgcgaggccggctcccgggtgctgcttccgataagcgtggtgtctgcgcgtgctgctatcgaaatccgaaagacgacgtcgtcgagccgctggatctggaactggggctcatgcgggtggccacccacccgccgacgccgcaggtgccgcggtgtacgtcgctctacataggagaggatggtctgccgatagataaacccgagtttcctccggcgcggttcgagatccccgacgtatccacgccgggaacgccgaccagcatcggccgatctccgtcgcattgctcctcgtcgggctctttgtcgtcctcgaccagcgtcgacacggtgctgcatcagccgccgccatcctggaagccacctccgccgcccgggcgcaagaagcggccgcctacgccgccggtccgggcccccaccacgcggctgtcgtcgcacagacccccgacgccgatacccgcgccgcgtaagaacctgagcacgccgcccaccaagaaaacgccgccgcccacgaaacccaagccggtcggctggacaccgccggtgacgcccaggcccttcccgaaaacgccgacgccgcaaaagccgccgcggaatccgagactgccgcgcaccgtcgggctggagaatctctcgaaggtgggactctcgtgtccctgtccccgaccccgcacgccgacggagccgaccacgctgcctatcgtgtcggtttccgagttagccccgcctcctcgatggtcggacatcgaggaactgttggaaaaggcggtgcagagcgtcatgaaggacgccgagtcgatgcagatgacctgagaccgaaagagcgagcgcgtccgttgtacagttgtatagcagcacacgccttccctctttttcaccgcagctaagagagagaaagagagtatgtcagtcaagggcgtggagatgccagaaatgacgtgggacttggacattggaaataaatggcggcgtcgaaaggccctgagtcgcattcaccggttctgggaatgtcggctacgggtgtggtggctgagtgacgccggcgtaagagaaaccgacccaccgcgtccccgacgccgcccgacttggatgtccgcggtgtttcacgttgtctgtgccgttttgcttacgcttatgattatggccatcggcgcgctcatcgcgtacttaagatattaccaccaggacagttggcgagacatgctccacgatctattttgcggctgtcattatcccgagaagtgccgtcggcaccacgagcggcagagaaggagacggcgagccatggatgtgcccgacccggaactcggcgacccggcccgccggccgttgaacggagccatgtactacggcagcggctgtcgcttcgacacggtggaaatggtggacgagacgagacccgcgccgccggcgctgtcatcgcccgaaaccggcgacgatagcaacgacgacgcggttgccggcggaggtgctggcggggtaacatcacccgcgactcgtacgacgccgccgaacgcgctgctgccggaatggatggatgcggtgcatgtggcggtccaagccgccgttcaagcgaccgtgcaagtgagtggcccgcgggagaacgccgtatctcccgctacgtaagagggttgagggggccgttcccgcgcgagtgctgtacaaaagagactgggacgtagatccggacagaggacggtcaccatggacgatctgccgctgaacgtcgggttacccatcatcggcgtgatgctcgtgctgatcgtggccatcctctgctatctggcttaccactggcacgacaccttcaaactggtgcgcatgtttctgagctaccgctggctgatccgctgttgcgagctgtacggggagtacgagcgccggttcgcggacctgtcgtctctgggcctcggcgccgtacggcgggagtcggacagacgataccgtttctccgaacggcccgacgagatcttggtccgttgggaggaagtgtcttcccagtgcagctacgtggcgtcgcggataacagaccgccgcgtgggttcatcgtcctcgtcgtcggtccacgtcgctaaccagagaaacagcgtgcctccgccggacatggcggtgacggcgccgctgaccgacgtcgatctgttgaaacccgtaacgggatccgcgacgcagttcaccaccgtagccatggtacattatcatcaagagtacacgtgaatgaggaaaagaaaaaagagaggggagcggatcgcgataatgtcgttttgacattctctgctcgatctactcagcgtctgcacgaaacggcgcccgcacggaggcgagcccaagcgtatctgcagcaagcggttctttctctcggtgatggtggcagcatcggtggcgggagcttgttcggacgatggacggtgaggagtccctggcgatcaggcggctcccgggcgtggagttcaacgggtggtaatggtggcggtgatcggtgttaaaaaacggtggccctggcaaacatatatctactgtaaaccctctgctctgttaataaaaagcacacttttcacatgagtccgtaactttattgtgtagtggaaatttttacgtcattaacaaacgggacgatccacgatgtatattgtgtaaacaagaatcttcctgccattacactatcacacgacgtaggcaacattgcgataagtcacacgttacaaatatgcaataacacatatatcattagtatagaatttctatagccgcgataacagtaccgcatgcaacatgacggttgttgttatgttgacgatagccgtcgcggcagttgccatcgtaagcagtaataacaatacaaccaacagtacgacgtgcgtcgatggcacaaacggtacctggtggacagttcagcatgtcggaatgctggctgctggtggatggtcgtgctttatactactattgatgttcgtctgctgcttttgctgcttccagttactgcgtaaactatgcggttgctgcggaaattcacaatccgatagcaaaacaacccacgcgtacaccaatgccgcattcacttcttccgacgcgacgctacccatgggcactacagggtcgtacactcccccacaggacggctcatttccacctccgcctcggtgacgcaggctaaaccgaaaccaacgttgaatctgacgcggtttcggaaagcctgagacgtcactttcacaatgacgttcgtagacacgttgatcataaaacaccgtagaggctaaggcttcggtagggagacacctcaactgttcctgatgagcacccgcgctctcatctcttcagacttgtcatgacccccgctcagactaacgccactaccaccgtgcacccgcacgacgcaaaaaacggcagcggcggtagtgccctgccgaccctcgtcgttttcggcttcatcgttacgctacttttctttctctttatgctctacttttggaacaacgacgtgttccgtaagctgctccgctgcgcttggatccaacgctgctgcgaccgcttcgacgcgtggcaagacgaggtcatctaccgtcgcccatcacgtcgttcccagagcgacgacgagagtcgtactaacagcgtgtcatcgtacgttcttttatcacccgcgtccgatggcggttttgacaacccggcactgacagaagccgtcgacagcgtggacgactgggcgaccacctcggttttttacgccacgtccgacgaaacggcggacaccgagcgccgagattcgcagcaactgctcatcgagcttccgccagagccgctcccgcccgatgtggtagcggccatgcagaaagcggtgaaacgcgctgtacagaacgcgctgcgccacagccacgactcttggcagcttcatcagaccctgtgacgcagatgaacgttccttcttaaacatccgaggtagcaatgagacaggtcgcgtaccgccggcgacgcgagagttcctgcgcggtgctggtccaccacgtcggccgcgacggcgagggagaggcagcaaaaaagacctgcaaaaaaaccggacgctcagttgcgggcatcccgggcgagaagctgcgtcgcacggtggtcaccaccacgccggcccgacgtttgagcggccgacacacggagcaggagcaggcgggcagcgtctctgcgaaaaagggaagaaaagaatcatcatgtgccgccgggagtcgctccgaactctgccgtggctgttctgggtgctgttgagctgcccgcgactcctcgaatattcttcctcttcgttctccttcgccaccgctgacattgccgaaaagatgtgggccgagaattatgagaccacgtcgccggcgccggtgttggtcgccgaaggagagcaagttactatcccctgcacggtcatgacacactcctggcccatggtctccattcgcgcacgtttctgtcgttcccacgacggtagcgacgagctcatcctggacgccgtcaaaggccatcggctgatgaacggactccagtaccgcctgccgtacgccacttggaatttctcgcaattgcatctcggccaaatattctcgcttacttttaacgtatcgatggatacagccggcatgtacgaatgcgtgctgcgcaactacagccacggcctcatcatgcaacgcttcgtaattctcacgcagctggagacgctcagccggcccgacgaaccttgctgtacgccggcgttaggtcgctactcgcttggagaccagatctggtcgccgacgccctggcgtctacggaatcacgactgcgggatgtaccgcggttttcaacgcaactacttctatatcggccgcgccgacgccgaggattgctggaaacccgcatgtccggacgaggagcccgaccgctgttggacagtgatacagcgttaccggctccccggcgactgctaccgttcgcagccacacccgccgaaattcttaccggtgacgccagcaccgccggccgacatagacaccgggatgtctccctgggccactcggggaatcgcggcgtttttggggttttggagtatttttaccgtatgtttcctatgctacctgtgttacctgcagtgttgtggacgctggtgtcccacgccgggaaggggacgacgaggcggtgagggctatcgacgcctaccgacttacgatagttaccccggtgttagaaagatgaagaggtgagaacacgtataaaataaaaaaataatgttaaaaaatgcagtgtatgaagtgtgaatagtgtgattaaaacatgcggattgaatgggtgtggtggttattcggatactttatgtcatccgttgggagcgaacggtcattatcctatcattaccacctggaatctaactcatctgccgatgtagtttgcaacggaaacatttccgtgtttgtaaacggcaccctatgtgtccggtataacgttacgataggaacccttcctgctagtccattttcactagtaggataccttaccattggatatattcaatggtggtttagatcttggattcagaacacaacatacagcaaacacgtactaaccaacaccgaaactctttataatatagatagcgaaaacattcatcgcgtatctcaatattttcacacaagatggataaaatctctgcaagagaatcacacttgcgacctcacaaacagtacacctacctatacatatcaagtaaacgtgaacaacacgaattacctaacactaacatcctcgggatggcaagaccgtctaaattacaccgtcataaatagtacacactttaacctcacagaatcgaacataaccagcattcaaaaatatctcaacactacctgcatagaaagactccgtaactacaccttggagtccgtatacaccacaactgtgcctcaaaacataacaacatctcaacacgtaacaaccactctgcacacaacacctcaaggtacaacaattcaagatacaactcaaagacatactgtacagacgccgtcttttaacgacacacataacgtgacggaacacacgttaaacataagctacgttttatcacaaaaaacgaataatacaacatcaccgtgggtatacgccatacctatgggcgctacagccacaataggcgccagtttatatatcggaaaacactttacgccggttagattcgtatacgaagtatggcgcggtcagtaaatatgattccgattcaacacatatactccccacgatcctcgaacaccttacagcatatgagcaaaaaacaagaaagtataaccacgatcacatttgggcaaataacatgctgtcatccactagcgtctattaatctaatgtttaacgggagctgtactgtcgccgttaaaatgtccatgggaatcaacggatcaaccaacgtccatcagctatgtgattgtgctctacctgggtaatcgctgtcagccttggcgacaggtgtaatcacagctgtcacataactctcgaagcctccaatcacagcagcacacatagtcctaacgccattggcgtgtataaaagttcggaaaacttgacggttgtacggcacgacaaatcgatgtagtggtatgtgtttccagcagggaccgtgtgcggtctcttaggttcgctatactgtggctggaaactggttacctgtgaagatggctgactatcctgttctgtcttggaaaaactttcagcgttgtaggtggactttgcagtatgcgggttagtgaagttatgtcatttatttacgtttacgatctcgtattacaaaccgcggagaggatgataccgttcggccccatgagttatttttattcttccggtaggaggcatgaagcctctggtgatgctcatctgcttcggtgtgtttttactacagcttgggggaagtaaaatgtgtaagcccgatgaggtgaagctgggtaatcaatgctgcccgccatgtggatcaggacaaaaagttacaaaagtgtgtacagagaatagtggcataacgtgtacattgtgcccaaacggtacttatctcacagggctttacaactgtactaattgtactcaatgtaacgacactcagatcacggttcgtaactgcacttccaccaataacaccatatgcgcatctaagaatcatacgtcgttttccagtccaggtgtccaacatcacaagcaacgacagcaaaatcataccgcacacgtaaccgtcaaacaaagaaaaagcggtcgtcatactctagcctggttgtccctcttcatctttctcgtgggtatcatacttttaattctctatcttatagccgcctatcggagtgagagatgccaacagtgttgctcaatcggcaaaattttctaccgcaccctgtaagcttcctgttgttgtttttacatcacggtacgatgaagtcacacagataattacagatgagctgttcatattttttattattttttccaattcctgcactaaaaaaagaagcactttacggaaccgtgtctgaatatctgtggggaatttaggtactttttgccgacgtcaggaaaaataagctgtcgcctacataagagcccggtgctatcgtgctgtcactctttcttgttgccttcgatgtacggcgtcctggctcattactactcctttatcagtagccccagcgttatggttaattttaaacatcataacgccgtgcagctgttgtgtgcacggacccgagacggcactgccggatgggaacgtttaacccatcatgcgtcgtatcacgcgaactatggagcatatgccgtgttgatggctacatcgcaaagaaagtccctagtgttacatcgatacagtgccgtgacagccgtggccctgcagctcatgcctgttgagatgctccgtaagctagatcagtcggactgggtacggggtgcctggatcgtgtcagagacttttccaaccagcgaccccaaagggttttggagcgacgatgactcctcgatgggtggaagtgaagattgatgatgagaacctgacaagaaagacgagagagaaattcagagctgtcattgtagaattagtctagattcctgataataaacagtatcgattttgaaacctaattgacgtgtgatcgatttttaaacctgtgtgttgtgtgattgattggtatgtggggggatccgatttcaaaggggggtacttatcgggaattgatgtgtcatggacgcagttttgagtgattttccgggaataccggatattacgaattactgatagtgacgtagctaataaaattaaaatgcgatttattttcggcctgttagttagtcttgttatcgtgtatacgtattattatgaagtacagagcgtagaattacgttgcccgtgtactgatggtttccgcaatcctttattcggtctatttcttattggtcatgatcctccacatcctcccgtttgtgagagagatcaattttttttgaaacctccccaaggcaagaccgtatgcttgggtccagaacatcacttatcatcatggctcaaaggtcaaaatagtagtttatggcacaaagtactggtgacaaaaaaaggcgatgaaccacaagtacagaagagaggtgagtatcctaagaaccgagcacgtataattgtttagcataatatgaatatatactatagctaataaagtttttacgaaaaaatgcaatgcaatgttttcaacatgttaacatggttacaccattcgattccgaattcgtacgtcaaactcttatcggtacgatacctgtcactgaccgcatatatgttatttgccgcgtgtcctccagtccgtcttttagaactggaagattacgacaggcgctgtcgttgtaacaaccaaattctgttgaataccctgccagtcggaaccgaattgcttaagccaatcgcagcgagcgaaagctgcaatcgtcaggaagtgctggctattttaaaggacaagggcaccaagtgtctcaatcctaacgcgcaagccgtgcgtcgtcacatcaaccggctattttttcggttaatcttagacgaagaacaacgcatttacgacgtagtgtctaccaatattgagtttggtgcctggccagtccctacggcctacagagcctttctctggaaatacgccaagaaactgaactaccaccacttcagactgcgctggtgatcatgtccctattttaccgtgtggtagccctaggtacgctaagcgctctggtgtggtacagcactagtatcctggcgaagatcaacgaagaatcctgctcctcgtcttctgtggaccacgaagagtgcgaggaaccggacgagatcgttcgcgaagagcaagactatcgggctctgctggccttttccctagtgatttgcggtacgctcctcgtcacttgtgtgatctgagacgtcatgctggtagcgtttatgagtcgggcggtggccgacacgccgcatttcctaacccgcgcagcatgttgcgcttgctgttcacgctcgtactgctggctctctacggaccgtctgtcgacgctagccgcgactatgtgcatgttcggctactgagctaccgaggcgaccccctggtcttcaagcacactttctcgggtgtgcgtcgacccttcaccgagctaggctgggctgcgtgtcgcgattgggacagtatgcattgcacgcccttctggtctaccgatctggagcagatgaccgactcggtgcggcgttacagcacggtgagccccggcaaggaagtgacgcttcagcttcacgggaaccaaaccgtacagccgtcgtttctaagctttacgtgccgcctgcagctagaacccgtggtggaaaatgttggcctctatgtggcctacgtggtcaatgacggtgaacgcccacaacagttttttacaccgcaggtagacgtggtacgctttgctctatatctagaaacgctctcccggatcgtggaaccgttagaatcaggtcgcctggcagtggaatttgatacgcctgacctagctctggcgcccgatttagtaagcagcctcttcgtggccggacacggcgagaccgacttttacatgaactggacgctgcgtcgcagtcagacccactacctggaggagatggccttacaggtggagattctaaagccccgcggcgtacgtcaccgcgctattatccaccatccgaagctacagccgggtgttggcctgtggatagatttctgcgtgtaccgctacaacgcgcgcctgacccgcggctacgtacgatacaccctgtcaccgaaagcgcgcttgcccgcaaaagcagagggttggctggtgtcactagacagattcattgtgcagtacctcaacacattgctgattacaatgatggcggcgatatgggctcgcgttttgataacctacctggtgtcgcggcgtcggtagaggcttgcggaaaccacgtcctcgtcacacgtcgttcgcggacataacaagaaatccacgtcgccacgtctcaagaatgccggccccgcggggtctccttcgcgcaacattcctggtcctggtcgcgttcgggttgctgcttcacatggacttcagcgacgctacaaatatgaccagcagcacaaacgtccctactagcaccagcagcagaaataccgtcgagagcaccacgagtagcgaacctacaaccgaaaccaacatgaccaccgcccgcgaatcttccgttcacgacgcgcgcaatgacgaaatcatgaaagtgctggctatcctcttctacatcgtgacaggcacctccattttcagcttcatagcggtactcatcgcggtagtttactcctcgtgttgcaagcacccgggccgctttcgtttcgccgacgaagaagccgtcaacctgttggacgacacggacgacagtggcggtggcagcccgtttggcagcggttcccgacgaggttctcagatccccgccggattttgttcctcgagcccttatcagcggttggaaactcgggactgggacgaggaggaggaggcgtccgcggcccgcgagcgcatgaaacatgatcctgagaacgtcatctatttcagaaaggatggcaacttggacacgtcgttcgtgaatcccaattatgggagaggctcgcctttgaccatcgaatctcacctctcggacaatgaggaggaccccatcagatactacgtctcggtgtacgatgaactgaccgcctcggaaatggaagaaccttcgaacagcaccagctggcagattcccaaactaatgaaagttgccatgcaacccgtctcgctcagagatcccgagtacgactaggcttttttttttttgtctttcggttccaactctttccccgccccatcacctcgcctatactatgtgtatgatgtctcataataaagctttctttctcagtctgcaacatgcggctgtgtcgggtgtggctgtctgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagaggtgagggtacgcgctaaaggtgtatgacaacgggaaggtaagggcgaacgagtaacgggtaggtaaccgcatggggtgtgaaatgacgttcggaacctgtgcttgcagaatcaacgtgaccgaggtgtcgttgctcatcagcgactttagacgtcagaaccgtcgcggcggcaccaacaaaaggaccacgttcaacgccgccggttcgctggcgccgcacgcccggagcctcgagttcagcgtgcgactctttgccaactagcctgcgtcacgggaaataatatgctgcggcttctgcttcgtcaccactttcactgcctgcttctgtgcgcggtttggacaacgccctgtctggcgtctccgtggtcgacgctaacggcgaaccagaatccgtccccgctatggtctaaactgacgtattccaaaccgcatgacgcggcgacgttttactgtccttttatctatccctcgctcccacggtcccccttgcaattctcggggttccagcgggtattaacgggtcccgagtgtcgcaacgagaccctgtatctgctgtacaaccgggaaggccagaccttggtggagagaagctccacctgggtgaaaaaggtgatctggtacctgagcggtcgcaaccagaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgtttgagcccgtcgcgcgcgcagggaattttgaaaaccgcgcgtcatgagtcccaaaaacctgacgccgttcttgacggcgttgtggctgctattggatcacagccgcgtgccgcgggtacgcgcagaagaatgttgcgaattcataaacgtcaaccacccgccggaccgctgttacgatttcaaaatgtgcaatcgcttcaccgtcgcgtacgtattttcatgattgtctgcgttctgtggtgcgtctggatctgtctctcgacgtttctgatagccatgttccatcgacgatcctcgggaatgccagagtagattttcatgaatccacaggctgcggtgtccgaacggcgaagtctgctacagtcccgagaaaacggctgagattcgcgggatcgtcaccaccatgacccattcattgacacgccaggtcgtacacaacaaactgacgagctgcaactacaatccgtaagtctcttcctcgagggccttacagcctatgggagagtaaaacagagagggacaaaacattaaaaaaaaagtctaatttcacgttttgtaccccccttcccctccgtgttgtaggttatacctcgaagctgacgggcgaatacgctgtggcaaagtaaacgacaaggcgcagtacttgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcagtgaataataaaatgtgtgtttgtccgaaatacgcgttttgagatttctgtcgccgattaaattcatgtcgcgcgatagtggtgtttatcgccgatagatatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggcgacttgggcgattctgtgtgtcgcaaatatcgcagtttcgatataggtgacagacgatatgaggccatatcgccgatagaggcgacatcgagttggcacatggccaatgcatatcgatatatacattgaatcaatattggccattagccatattagtcattggttatatagcgtaaatcaatattggctaatggccattgcatacgttgcatctatatcataatgtgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcctattgacgtcaataatgacgtgagttcccatagtaacgccaatagggactttccattgacgtcaatgggtggagtatttacggtaaactgcccacttggcagtacatcaaatgtatcatatgccaagtacgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaattcaacgggactttccaaaatgtcgtaataactccgccccattgacgcaaatgggcggtaggcgtgtactatgggaggtctatataagcagagttcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactctctttgttggctatatgccaatactgtcattcagagactgacacggactctgtatttttacaggaaggggtcccatttattatttacaaattcacatatataacaccgtccccagtgcccgcagtttttattaaacataacgtgggatctccacgcgaatctcgggtacgtgttccggacatgggctcttctccggtagcggcggagcttccacatccgagccctgctcccatgcctccagcggctcatggtcgctcggcagctccttgctcctaacagtggaggccagacttaggcacagcacgatgcccaccaccaccagtgtgccgcacaaggccgtggcggtagggtatgtgtctgaaaatgagctcggggaatgggcttgcaccgctgacgcagatggaagacttaaggcagcagcagaagaagcaggcagctgagttgtgttctgttgagagtcagaggtaactcctgttgcggtgctgttaacggtggagggcagtgtagtctgagcagtactcgttgctgccgcgcgcgccaccagacataatagctgacagactaacagactgttcctttccatggatcctttctgcagtcaccgtccttgacacgatggagtcctctgccaagagaaagatggaccctgataatcctgacgagggcccttcctccaaggtgccacggtacgtgtcgggacttgtgttcccctttttttaataaaaagttatatctttaatgttatatacatatttcctgtatgtgatccatgtgcttatgactctttctaatgtgtttaggcccgagacacccgtgaccaaggccacgacgttcctgcagactatgttaaggaaggaggttaacagtcagctgagcctgggagacccgctgttcccagaattggccgaagaatctctcaaaacctttgaacaagtgaccgaggattgcaacgagaaccccgaaaaagatgtcctggcagaactcggtaagtctgttgacatgtatgtgatatatactaacctgcatgggacgtggatttacttgtgtatgtcagatagagtgaagattaactcttgcatgtgagcggggcatcgaggtagcgataaatgagtcaggaggacggatacttatatgtgttgttatcctcctctacagtcaaacagattaaggttcgagtggacatggtgcggcatagaatcaaggagcacatgctgaaaaaatatacccagacggaagagaaattcactggcgcctttaatatgatggggggatgtttgcagaatgccttagatatcttagataaggttcatgagcctttcgaggagatgaagtgtattgggctaactatgcagagcatgtatgagaactacattgtacccgaggataagcgggagatgtggatggcttgtattaaggagctgcatgatgtgaccaagggcgccgctaacaagttagggggtgcactgaaggctaaggcccgtgctaagaaggatgaacttaacagaaagatgatttatatgtgctacaggaatatagagttctttaccaagaactcagccttccctaagaccaccaatggctgcagtcaggccatggcggcattgcagaacttgcctcagtgctcccctgatgagattatggcttatgcccagaaaatctttaagattttggatgaggagagagacaaggtgctcacgcacattgatcacatatttatggatatcctcactacatgtgtggaaaccatgtgtaatgagtacaaggtcaccagtgacgcttgtatgatgaccatgtacgggtccatctctctcttaagtgagttttgtcgggtgctgtgctgctatatcttagaggagactagtgtgatgctggccaagcggcctctgataaccaagcctgaggttatcaatgtcatgaagcgccgcattgaggagatctgcatgaaggtctttgcccagtacattctgggggccgatcctctgagagtctgctctcctagtgtggatgacctacgggccatcgctgaggagtcagatgaggaagatgctattgcagcctacactttggccaccgctggtgctagctcctctgattctctggtgtcacccccagagtcccctgtacccgcgactatccctctgtcctcagtgattgtggctgagaacagtgatcaggaagaaagtgagcagagtgatgaggaacaggaggagggtgctcaggaggagcaggaggacactgtgtctgtcaagtctgagccagtgtctgagatagaggaagttgcctcagaggaagaggaggatggtgctgaggaacccaccacctctggaggcaagagcacccaccctatggtgaccagaagcaaggctgaccagtaaactattgtatatatatatcagttactgttatggatcccacgtcactattgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcagcccgcgtaagaaaccgcgcaaaaccacgcgtcctttcaaggtgattattaaaccgcccgtgcctcccgcgcctatcatgctgcccctcatcaaacaggaagacatcaagcccgagcccgactttaccatccagtaccgcaacaagattatcgataccgccggctgtatcgtgatctctgatagcgaggaagaacagggtgaagaagtcgagacccgcggtgctaccgcgtcttccccttccaccggcagcggcacgccgcgagtgacctctcccacgcacccgctctcccagatgaaccaccctcctcttcccgatcctttgggccggcccgatgaagatagttcctcttcgtcttcctcctcctgcagttcggcttcggactcggagagtgagtccgaggagatgaaatgcagcagtggcggaggagcatccgtgacctcgagccaccatgggcgcggcggttttggtggcgcggcctcctcctctctgctgagctgcggccatcagagcagcggcggggcgagcaccggacctcgcaagaagaagagcaaacgcatctccgagttggacaacgagaaggtgcgcaatatcatgaaagataagaacacccccttctgcacacccaacgtgcagactcggcggggtcgcgtcaagattgacgaggtgagccgcatgttccgcaacaccaatcgctctcttgagtacaagaacctgcccttcacgattcccagtatgcaccaggtgttagatgaggccatcaaagcttgcaaaaccatgcaggtgaacaacaagggcatccagatcatctacacccgcaatcatgaggtgaagagtgaggtggatgcggtgcggtgtcgcctgggcaccatgtgcaacctggccctctccactcccttcctcatggagcacaccatgcctgtgacacacccacccgaagtggcgcagcgcacggccgatgcttgtaacgaaggcgtcaaggccgcgtggagcctcaaagaattgcacacccaccaattatgcccccgttcctccgattaccgcaacatgatcatccacgctgccacccccgtggacctgttgggcgctctcaacctgtgcctgcccctgatgcaaaagttccccaaacaggtcatggtgcgcatcttctccaccaaccagggtgggttcatgctgcctatctacgagacggccgcgaaggcctacgccgtggggcagtttgagcagcccaccgagacccctcccgaagacctggacaccctgagcctggccatcgaggcagccatccaggacctgaggaacaagtctcagtaagtgaaaaactggaaagagagacatggactcttgtacatagtgattccccgtgacagtattaacgtgtggtgagaatgctgtttaataaaagtagcttttttttatacatctccgtctctggtctcgtgatgtgggggtgcgggtggtcccggatacttgtccttctccccctcatgtgtatagccctgatggcgagaggcacatacggggcttacatctgctcacccaacccagggagacttagaatctcttgcgccctctcggtgttggaccaaagactgtggtgggagatccagtattcatcgggtcgtctcacccgagtcttggtctttcatgatgacggtgaggagggtgatgacttacatctcacggatacccgtcactgcacttcctgtacacatccctatgtgatttctttggttaccccgctgaccatcaatgccacgctacggctgctgatacgagatgggatgtacgggcggggggagaaagagttgtgcatcgtccatctacccaccctgcgagacatccgcacctgccgcgtcgacgccgacctaggactcctatacgccgtctgtctgatcctgtcgttcagcatcgtcgcggcggccctgtggaaggtagattacgacagatccgttgcggttgggtccaaaagctataaatcatagctactgacgcaggcacgtcattgacagccggcgacgtcgagagggtaactatgtaccgtgcgggggtgacgctattagtggtggcggtggtaagtttggggagatgggacgtggtgacggtggcggctgcaattgggtggtatgagccccaagtgagcatggcttatatgtatgagcataatgacactaacctgactattttttgtaacactacagctcgcaattcgccctttttggcctcgggaatgatgatcagtattccacataacacacgatttctcactagcaaagtcaactatagtaatgacatgaataatatcaggaaaaactatacccaccaactgacatatatgctaacgggtgatccgggaacctacgtgaacggcagcgttacttgctggggctctaacggaattttcggcgccgggactttcctagtgcaatccatggttaacgacacgaccggtaacaccagtacatccatccactttgttcaacagaatgaactggtggagaatcccgcgtactttaggcgcagcaatcaccgagcctttatgattgtcatactgacgcaagtggtttttgtggtcttcattattaacgcttcttttatctggagctggacgtttaagcgtcacaagcggtgacgcggccccctgccacatatagctcgtccacacgccgtctcgtcacacagcaacatgtgtcccgtactggcgatcgtactcgtggttgcgcttttgggcgacacgcacccgggagtggaaagtagcaccacaagcgccgttacttcccctagtaataccaccgccacatccactacgtcaataagtacctctaacaacgtcacttctgctgtcaccaccacggtacaaacctctacctcgtccgcctccacctccgtgatagccacgacgcagaaagaggggcacctgtatactgtgaattgcgaagccagctacagctacgaccaagtgtctctaaacgccacctgcaaagttatcctgttgaataacaccaaaaatccagacattttatcagttacttgttatgcacggaccgactgcaaaggtcccttcactcaggtggggtatcttagcgcttttccccccgataacgaaggtaagtagcacctacctttctgttcaaccccttttcctccctcgtcaacctgatatcaaaataaacattaattttatccgcaggaaaactacatctctcctacaacgctactgctcaagagctgcttatctcgggactcaggccgcaggagaccactgagtacacgtgctctttcttcagctggggccgccatcacaacgccacttgggaccttttcacctatcccatctacgccgtgtacgggactcgcctgaacgccaccacgatgcgggtccgcgtgctgcttcaggaacacgaacactgcttgctcaacggtagcagcctctatcaccccaacagcaccgtgcatctgcatcagggcgaccagctcattccgccgtggaatattagtaacgtgacgtataacggacaacggttacgcgagtttgtcttctacctcaacggcacgtatactgtcgtgcgtctccacgttcagatcgcgggccgaagttttaccaccacctacgtgtttatcaagagcgacccgctgttcgaggaccggctgctggcctacggcgtgctggctttcctggtgttcatggtaattattcttttgtacgtgacctacatgctggcgcgccggcgggactggtcctataagagactggaggagcccgttgaggaaaagaaacacccggtgccctacttcaagcagtggtagggcccgaaacgagaggagcggctgctgtgttgtctttatttcgctaacttctacggggtttcccctcagcctctgtgttcccaacccgtccccccgctgagcgttggcggcgatggtcatgttctcccaggaccacgtccagatcgtctacggctccacacgcatctgcaagtccctggccccggccaacaagagaaagacccatcgcaccatcgtggtagcgccgcggcggggttttttgcgtattcccccggacgggcaggacgttaaccacgtcaagatcgtacccaccaccacctcctcctccctcgcgccgccccgtgacgacgaacggcggccgatcccgccgttgcggccgccgctcacagtctatccctatggcacgtcgctgatccgcaggtcagctagggacgcaaaactccgctccaagctaatcgtcttccatataactcggcccgcactcggtcagcacccgcagaatcccgggatctcgggccctacggccatggatcatagtgagttcctcaccagctttcgtcgcgaggtcgatcggcaaaccgtactgaccgccgagagcgcgcccgccactgtggaagtctgtctgggcgacgctctgcccggcggcgtcatgggtagcggaggactgccggcgggtgtgggctcggccagcgccgccgtggccgccgctgccgccgctgtggccggagtgcccgtcgccgcaaaccccgtcatgcccgccaccgccacggtcaccacgccgcccatgatcgaccttaccagccaccaccggccgctgacgctatttacgccggcctccgcggccgctgcgcccgccgtggccaccaacggcggtaacgccacctacattttgccggccgactgtcggtacgcgccactctttgccagcaagtataagtacgtcttcgaagaggtgtcacgtctcatgcggctgcacgactccacggccgtgcagctgcagatcagcgcctcgtgcggcaacgctttccaggccctcaagagtgccctgctcaagttgcacaacgtcaccgtgttagcgggccagcagctcatcacgcagacgatgccgcacacgccacaggccgtagccacgttcaaattctttcaccaggatcccaaccgcgttctggactgcatccgtccggtggtgccgcgctccacttcgtaccacgagacgggtgtgtaccagatgtgggtctcgggcgccaccaagaaagacctgtttgacgccgtgaccctgtgcgcttccatcgtagaaaagcagccagacgtatttaatatcaacgtcagcttgttgacgtacccttcgatcgcggcgccccacttgccgctgtacaacgaattcaccagctttcgcctgcccacctcatgaagcggcggcggcgatggcggggctggttgcttttcctggccctgtgcttttgcttactgcgtgaagcggtggaaaccaacacgaccaccgttaccagtaccaccgctgccgccgccacgacaaacactaccgtcgccaccaccggtaccactactacctcccctaacgtcacttcaaccacgagtaacaccgtcaccactcccaccacggtttcctcggtcagcaatctgacgtccagcaccacgtcgattcccatctcaacgtcaacggtttctggaacaagaaacacagggaataataataccacaaccatcggtacgaacgctacttccccctccccttctgtatccatacttaccaccgtgacaccggccgcgacttctaccacctccaacaacggagatgtaacatccgactacactccaacttttgacctggaaaacattaccaccacccgcgctcccacgcgtcctcccgcccaggacctgtgtagccataacctgtcaatcatcctgtacgaagaggaatctcagagcagcgtggacattacggtgggtgaagaagagtcggagtcggaagaggacgacgacgaagagtacgacgaactgtggttccccctctacttcgaggctgagtgcaacctaaattacacgctacaatacgtcaatcacagttgtgattacagcgtgcgccagtcgtctgtctcattccccccgtggcgcgacatcgactcagttaccttcgtacccaggaacctctccaactgtagcgcccacggtctggccgtcatcgtcgcgggtaaccaaacctggtacgtgaatccgtttagcctggctcacctgctggatgcaatatataacgttttagggatcgaagacctgagtgccaactttcggcgccaactggctccttaccgtcacactctcatcgtgccgcagacttgatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcctgttgggtgaggtgtttcagggtgacaagtatgaaagttggctgcgcccgttggtgaatgttaccggacgcgatggcccgctatcgcaacttatccgttaccgtcccgttacgccggaagccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgagcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgctaacattgctgataataaaggctctctgttaacccccgacgagcaggctcgcgtgttttgtctgagcgccgactggatccgcttcctcagcttgcccgaccacgacacggtgctgctgcgcgacacggtggcggcggtggagggcgcgcggcaactcgagatggtgtacccggcacccgagcacgtacaccgctggagctatctgtgtccgcccgagcaggtgcgcgtggtgatcgtgggccaggacccgtactgcgacggcagcgccagcggcctggcctttggcacgctggcgagccgaccgccgccgccctccctcaacaacgtgtttcgcgaactggcgcgtacggtggacgggtttcagcgtccggcctcgggttgcctggacgcctgggcgcgacgcggcgtgctgctgctcaacaccgtgttcaccgtggtgcacggacagcctggatctcaccgtcacttaggctggcagacgctgagtaaccatgtgatccggaggctgtcagagcgccgggagcatctggtgttcatgctgtggggcgccgacgcgcacacctgcgagtacctgatcgaccgacggcggcacttggtactcaagtcctgccacccgtcgccgcgcaacaccacccgcgccttcgtgggcaacgaccactttatactggccaacgcatatctggacacgcattaccgagagaccatggactggcgactctgtgtgggtgattgatgataatagacacaccggggagacaaggtggtgaactgtgatgtctatctctttattgtaaaaaaaaatcagtgaccacaatatatatagacacacaccgaaaggggtggaaacccaaatgtccaagcgcgtcctgtttcataatttttccggtctcggctctgttttttaatcgtcgaaaaacgccgcgatcgaggcggcggcgatcgcagcctcctcgctgggatcgataatttcgagtccgtcctcgaggaacgagggccctcgccggcggccgctgccggcgacttgcgacaaccggagcagaggatcgttgtcctcgtcctcatggcggttgtttctccgtcgcgatctccgagaggaggaggacgacgacgatgcggcctgccgccggctgtttctaccaccgccaccaccgccgcctcctcgggtattgttccgggcccgaccccgacgtccgcccggcggtggtggtggcggcggcagtggagccgaagaagacgaggaagagttactggcagccgcggcggtggcgacaacggggtttaccacgtagggcttgatttcacacacgggccggggaggagcagctggtgtttcgactgcggcggcaacgggcgcgacaccggcgacggaacctgagggtacaacaccggtggtgacgagtggcggacatgcggctgctggggggccaacgccggctgtggagacagctgcggcggtcctcgcgacgctgctgtggttgacgacgacagtcccgcccgacgtctctggcaagagtctgctggaaaccagggggagatcgcacaatcttttctccttacaatcattgagcattttggtcaatgactgtataatgtcatcaaaacgcggactgcgaggaggctgaggcgccgcggattcctgcgaattcggaggaacacggcagttagagactggagtggtggaatcattctcctcctccgactgcggtggtgcctccgccgcctcagccggagccctcctcatcctcatcatcattaaccccgcagccgccgccgtcgccgccgcctcggactcctgcaccgtctcgcccgcgctgtgggcgctgctgggtcgagggagcgaaagaagtgacgacggcgacgtcgacgacggcgacgaaaccaccgctccgcgctcaatgggtagaagtaacgcaccgtcggtgccggcggccacgtccgtcacggcgttatggtggtgatgatggtggtggtggttgttggaggaagaagagaccgcggaggatgaagacgagtaattgagaaaggccaccgcttcagacgtgtccagcggcagcgacatgcggccgctgccgccgccaccaccaccgccagcaccaccggactgctgctccgtctcgttcttgccgccgccgccatggccttcgtgctgtgcggtggtcttttgtctcttcgcctcccggaggggaggagagcctacagacgggacgacacatagcgcacgaaaaagcacatggttatcatccacacaaccaccagcgcaccaacaccgctcgcctgctcgctcgtgcgctacgggggggctcacgagtccactcggaaagcaccgtgacgcgaggagggccgggactcaccgtcgttctcggaggagggaggcggccgccgctccttctgccggttcatcaaccggggatcccgcagcagtccgttggcggagtccgaggagtgctgaccgccgctcccgccgccgccaccgccaccaccagcgccgccgcctccaccaccaccggcagacgaggacgattttttgcgccgttcttcgtgacgctgttcctgccttcgccgttgctgttcctccgcagaagggccgtcgcgagtcccgccgctgccacccagcgaggacacgcagacggcggaggcggtagacgcggcgccgcaaccaccgcctccgccggaggattcgccgtggtttttcaggtaatgccgcacgtaagtcacttgcaaattaccgttttcggaaatcatagtgagcagcgcgctctcattgggtccgctggagcccaccaccgaggagacggatttgttaaagacgataccgccgcgtacaaagaggtgctcctgaagttccccgtcgcccgtaatgtcaatggacatgaagccctgctgcgtcttggcgccggccgaagcctcgccgtgctgcataatggtagcgcagagccagcccttgttgaggtgcagcaccttgccatcgccgtccacgcagttgaccagacgggcgttgtcaaagacgaactggcgcacgtcgaaagtctgattaacgctctgatgcaggatgcggttaggattcgtaaaagtccagtattttcgcacgacggtagtaggcagatccatgacgcggcggcgcaaagcgcgagcgcaacgctcgtcggaggccgtggagcgagtgccgccgcagccggcagagcgccgaaccccgtcgcagactctatttatacatcatctttccagcccgcctagcaacacccacaaacaacgtcacgacgcaacgtggttaaacagtacgtttattaaagtaactgggtgaacaacaccggagcggactgcaaatcgcaacgctactttctcgagtgcagatactcttcgagacggctaaacaacgtgtccaactcgctgagacctttccgcgtgccgttatccgatttcctttccgcctcctgagacagccgactaatcacggacttatctccgcaacctaacagaggctgggagcccgacaaaagtaaaacagcgtgctatgaacacgttgttacctctgcgcggacagcgccgccacagagacacttacgcattgccgcatgtctttgtagatggattctagcgtcgagcgcatactatgcaattccgtcttaagtccgggatagacgtggtcgcctgcggggaacacgatctccagataccgcctcaacaaccagtccatgacgctgcatccccaacagcctttgaccaccgtaccgtcgagccacacggagtagtcgtcctcacgttgttacaagaggaaaactacgtcacccgacacgcggaaaataaagaccgtcgcaataaaccgtacctacgtgacctaccaacgtaggttttactcgatgaaaggtgacgcggagatcttgcaatctggtcgcgtaatcctctggacgacactgcggctttgtattctttatcgtcgtcgtcgtcgttgccggcttcgcctcctcggaagcgcctagaaaaaagacgatcaggaccagagaggaagagaccatcaccgacagcatcgccgcagcatgccgccccaatccgccgcccaactgcgcgtcccaggtaggtggtcctttatgttatgatgtttttgtcaattttttttttcaatttctttcttccgcggttagaatagtttctgtaggaaccaattatcaatctgacgggttatcgtcaccacttgatggcaaaacgaaatttttttttcattgccttgaagtctctcccgccaccaccaccaccgccgccgttgtctccggctggagatcaagacgaaattcctcctctctaaaaaaaaaaggtggtgggctcaattgatcatggcaagaagaaaaactatactgaataaactgtgtgcaaaactactagtaacaacaaaaatagcgactagatacaccacggacaatctcagcagatactctctcaaaagaaaaaaagacgccgtaacgtcggagaatctggtatctactgcctgacgaatttttttttcgtccatgtatgtgattacgagtagtagtggtatgtagaacaagaagaaaaatcgtagtccccaaaaggataataaaaataacactcatagagaatcacagattttctctagacaactctctatccaaataacgaatgtgaagcgtacaaagtaagatattcaaagaatagcaccttcatagattcatttcagctttctactccttgtaatttaaagttgcactaaacaaagctcttaaagaaggttcgagccgctctcgatcactcatcgatcacgcgagtcttattattccaccacaacgtaacattcttcactttgtagagacactctatcgtagagtaaccctcgatttcctagctgttgttttttgattattttgttcgctctaagagagatactcgaaatcctacttacaccaaggaccctacatcatcgcaggaagaataaacataccgtagaaatctcgacacgcaaacgcgaatgtacacgaaccaaaagccacagacccactatttctgtgccgtatttttttttgacaatctgtctgaatctgcggaaatagttacggagaagcaattctgttaaaaaattcagtacgttagcagcaaaagataatcatttcgtgtgatagcaagtaaatcacctcacttaggatcgatttcgtgcgaaaaaattattttttctcctaatcaacagataatatggttaccatttagagtagtgtcactttactttcacggaagatgcaacccccgagaaaaagaagaatcgatcatagataaaagaaatcaagccagacttgttaagaaaaaaaaaagatcaaaaaattactacctaaaaagaacgcctagccattgggagacgcgcacgtctgtgtggtctccgcgatcatgagaacgaaaaaaaagacacgacaatacacaggctgaccttcgaaaaccaagcctattgataataatctaccccatagaacaggatataatcaagcatccaaacaacaaacagcgccgccgtgcctcctccagaggacggtgacgacgtatgtctgtcgtctcccttctcgctctggcttctggggctctcctcctctccccatcatcttctccttcgtcccagacggacggctatcggttcgcgcgctcgtcttttcttcgatgtgcgcaggtttcgtcatcggagaagaagaccgcgaccgtatcataatgatgataataataatacatccaccgaccatctttatcctcttttgttgttccaaagagaaaagaaaaaaaaaacaagcagccactctaaccatcacactcacgagttaatatggggttaggggggaggaagagaaataccgccatgaaggcaagagcagcagcagcaacgacgtcactacgatgattgatgatgatacacgactaccactggaggagaggaaaacggagaaaactcatcgtgatgatggaaacaagaatgatgataataatgatgacgataaagccaccacacgatatatacagagaacaacaaaaccaccaccacgacgatgaaacaaaacgctcaaccaaacattgtgtaaccgctacgcgtccgtggccgcggccggcggcctcttgtcttgtttttgttgtccccttcgcgggggacatcatcgccgccgacccgcgtgtgccctgcctcacggctggtccgtgatgaactcttgctcgtaaccgccaagcgataaacaagccaccgtgatagaagacaccttataggaccatatcctagttacatagtagtgcatatatatagtaatagtagaataagtgaactttagacacgatagatgaagccatagtctgaatagtcatgatgttaggaacactatacgactaatacatacatacatacacccccttaggaggaacgatgaatcaaagaataatacatcatgtagcataagtacattaagcctttaaacgaacaaattgctaaccaaaatcgatcaccaccatagacgtactatcatcattacaacgaaaaactagacggatggatagctgtaagtctcacctagctaactaacgatcacattttttctccacgatagtcaccacaaccatgaatgatagccgcctatttgaagtttgatatctcgatgaatctctatagtcatagcccgttctttttttccaagtatcctttagtccataagcattattataaccgtattacccagaaatctttgttatgagtctcttcgctgtcaactgattagtagcaagttgctgtgattttttttccaatcccataggcatccttagttaaaacattaagaagtaagtaggttctggatagctaatcatcttttttttttacttcggtagattaaaacaaatgaaacacgtagctgttgttttttggtgaatatagtttggtaagtccttagcgggtaagttctaagaaacattagttactttttattgttctgtctcctctccccctaccttacgttgggaggtagcttcgtcatgtaggataataattaggtaagcaaacaacatagatagtgattttagtatagataactcgtgtaagtgttttagtgacttgtaactcgactcggtagacttctcagagtttcgcctcacacaggcgggtacactcgttaagaaacgcaaaatacctaaaagggtacgttacatagcagataagttgatagatgaccgatattatacttcattaactcacgaagatgactgtaagtaaggatattgttgttcatgatagtagccaggttataaggatcatatatatctcgtcagggaaatacaagttagaccataatgttgactactttagagataataagacaccataggattctgaatttaccatgatataagttaagaagattgatatctgtcctttttctgaaacgaagataggcctttttattttttcgaattcatgttcgaaaacacaagcttccataacaagaacccgtaccgaagaaaagttccatcgactaaaaagaaaaaagaaaacgaagcaagacctcgacgacaacaacacatcaaagaaagacgaccagctgattatgttcttaggaattccacacacccgcgagccgatccgcaaacgtcgtgcgaggcgcgctttctctggctcgacacaatgatcacaccgcacgctatagacacgtcgtcgtggacgacgatgacctcaggccacgaatgacaaccaacatgggcaaagtccaattagccaaaaagacgacgattctaagaattgatgaatcctcgatatacgcctatcgataggtttcaattgtgtcatatacatcaaatgaaaaacaggacgcacgataaaagcttccttacagcataactgtaacatacgatcatcgaacatctcctcacatacctttctcctctcacataggaaaacaaaactcttttttttctttcctgtcaaggaaaaaatcaatgtaccaccacatcactttctgctcggtcccggcgacggatgggcgcgcacgcggacaaagacccaccggccacttccacttattttttgttgttaatcgtcttctcccccgcacgcggagcaccaccaagcctagctgctcattcgctcaactagtcacaccgcgcacgcgagaaggggccggggtccgcgggcaccgccgccggaggcgcggttccctctctctaattccctggaaaacaagtaatgacaaacaaaaagacgacaaaaggtctctattctgctacatgagagaaattatagctgttggcaatttttcaaaatacatgttataaggcatcctctctgccacacgcgcagtcacggataggatcagtgcgtattcattataaaaaaaaacacaaacaacccatatatgtgaagcagaatgatgaccgaccgcacggagcgacgccgtcgactgacccacgcggcatgtacgccgtccgcgaacaaccaaaggacgacccgtctccccccgcacccgggttttttctcttggtcgaacccggcttgcgacgacgggttgttcctttaccggacgacggtcagccgcggggttgatacccagcgacggcgtcgctcccacccgggtttctttctcttgtagataccactcgtagactgtcagcctcgcgaagagacaccgcggaccggggaaacggataagtttacgaacagaaatctcaagagaaagacgctgacccggcaagtaccgtcacggagacacggtggtttttattgaatttccagtgtatcgagccaccgtgatgcaggtacggtggttttatgtgaagtgccgctatctataggcgatgtgttccctgacggtgtgtgttttttttggggatagacaacgtggttcttgtacgtggtttttaccctgctcaataaagtcacgttttccttacacggtgttgtgtcaaaaaataagcgtggtgcgtttgtctttgagcgcgcgacagatatagggggtgatagcggtgttcttctcatagggaagtcgcaacgggttgacgttcatcatgaggtgctcggggtccgtgactcgcgacatggccacgtagatgtggctcatcttgaggttcttgggatggtccccaaagtccacggccaccttctcgagcgacaggccctgactcttagcgatggtcatggccgtgcgcgaagtgaggccgtagtccacggtggtgcacacgtgcagactcttgccctgcgccgactcgacgaagcgcgagacgttaacgtcgagcacaaagaggaacccgagcgcatcgcgtagcaccagccgcgaaagaccgcgctgcaccacctcggggtggatgcggtggcggtcactgggcagactgagcacgttgtcgctggtgtagccctcgagcgtgtacgtctgcgccggcgacacatgcgaaagcatgcccacgaaggagccggtttgcgagctgatctgacagttggccttgaacaccacgttacggcgattgtaggtaacgagcggcaacgtggcgaagcgaccgcccgtgagacgctgcatgagctggtagcgcttgagaaaaatgtcgcggaaggtagtgtacatgtgcaccgtctcctcgaaagaaagcagtgccaggctaggtggcttgacgtatttgagaaaaaagggatccgcgtacagactggtgtgatccatgagttcggcgtccgtgatggcgtccgagtcgtcatggtggttggacaggcaggggatgtcgtgggtctcctcttggccatgttccatccgttgagataccggcacgctctggccgccctgagaagaatccgcgtcgacgtgattatttatcagattctctcccccgctccaagcgggagcggcggccgtggcggcggcagcggcgcagagcgaactcacgtcgggcagctcaacgcgcgccagctcacgcaacatctcctcggtcgtgtagggcgacacgtaaaagtagtacatggccgagaagagcaggcccgaaactaacgagtaggcgtaggccgcctgctcgcagggcgtgcgttcgataaacgtgtccttttgcaagatgtccacgaaacgttcgaccgtgccctggtatccgataacacaggcccgcaccttagagttgactcccaccgaactgcccttgatgtaggtaatgcgcaaggtgagcagcgtctcacggctatcgggcgcggtggtggtatcatcgtcctggaaaaacgccgtctcgtcgttgccgccggtgctcccgattacagatcctccccctccgtgagcctggacggaggggttgttggtggcaacgacgtcggccgcggggcgcagcgcctccttggtgatctcgctggagaggttgtggtcgacaaactgcgagtagttaatgatgcgcgccaagttctggcggaaccagagctcgacgggctgcggcgagtcgcccagcgggtcggccagctcgcagagctcctggtacgcgcggttgttgaccacgcagtagacgggcaaatcaaagagacggtggcgctcgctcaggcggatctgctcgtgcagccgcttgaagtaagcctgcacctcgacgtgcgagagaaaaagccgcgtcatctcggcggcgtacgagggattgcggatggagctgggcggccgcacgaagcggtccacgtaggccacgtgctcctccttgagcgggataccgaactccatgtacttgagcaggtcgccaaagtccaggtcggtgcaacgcttgttgtgaataaacatgacccagttgtcggcgatgtcgcagtagttgatgagcacttcgttctgaatcagcgccgagagcacgtcaacgcccttgcgcacgctcttgttttgcgtgtagtggtcgtagcggctctccagcgcctcggtctgcgtgggcgaaccgacgcagatgatgcagggcacgcggcgttcgcggtaaagtcgcgtgtcgcccagggcgttgtaaaagtagtaaaaaaacaccaccacctgcagcatgtagcgcagcataaggccgcactcgtcgatgacgatgatattgctctcgcacagctccgagaggtcctcgcaggcggcggccgcggccgcggcggaggccgaagcggccttgcgctcccacatatttaagcatttgtccacgatgtcggcgatgaccggccagtaggcgagcagatcgttgatctgcaggcgctggatggtggtctcctcgtgcggctcgcacacgcggtagcgttccagcgtctcgtggctaacggcgctgtcagccagcggcacgtgcttgctgacgaagccgaagacgcggtagatggtcttgacctgcgctgagcgagtgcggttgaggatcgcgctgaggttctgcgcggcgatcaccgtggtaccggtgatcacgcaatctagattggccgccagcacctggatgctggaagtcttgccggcgcccgccgtgccggtgacgagcagcgcgcggaagggaaagaagggccaacggtcgacgcagggcacgcgcgtgccgccggcctcggacgaagcggcagcggcggcagaagaggaggcggaggagtgaacggtcgccgttgccgcggcggtagttgcggcagaggggttgttatctgtcgttcgttcaacgcgactgatggagcgaaaccactggaacgaaaaatcctcgggcgcaaagcgctcgcgcgagagggacttgaccttgtcgacgatccgttcgatcttggcggccgacgagaggttgaggatcaaggcgtcgtcgtacttgggcgtgggccgcggcgtggatgacgaggccgtcatcgacattttccccacgggccagacgatgagcttcctgcggttgctgcacggctttctggggacgtgtcgcggccagagcatgcaccaggtgctgcgcgacccgtgcgtgctgcgcaagcagctgctctacggagtgtgcaagacgctctttgacaccatcacggtgcggcgcgtggccgaggagtggaagttacacgcggcgttgtttccctaccgcgcgctggacgaagaggacctggagcagtatctgttggtgtggagcgcctcgttgcgccagagcgtgcaaacgggcgtgctgggcgcgctccgcgacattttatatcagtacgccgataacgacgactatggtctctacgtggattggtgcgtaacggtgggactggtaccgctgctggacgtgaagaccaagccgaacgaggcggccgagcgggcgcaatttgtacgcgcggccgtgcagcgggccaccgagacacacccgctggcgcaggacctgctgcagactaacctggcgctgctgctgcaggtggccgagcgcctgggcgccgtgcgcgtagccaacgcgcccgaggtacgcgtcttcaagaaggtgcgctcggagcggctggaggcgcagctgcgcggcaagcacatccgcttgtacgtggcggccgaaccgctggcttatgagcgcgacaagctgctgttcaccacgccggtggcacacctgcacgaggagattctgcgctacgacgggctctgccgccaccaaaagatctgccagttgctcaatacctttcctgtgaaagtggtgaccgccagccgccacgagctcaactgcaagaagctggtggagatgatggagcagcacgaccggggcagcgacgccaaaaagtccattatgaagtttttgcttaacgtctcggacagcaaatcgcgcatcggcatcgaggacagcgtcgagtcctttctgcaggacctgaccccctcgctggtggaccaaaaccgtctactacccgcgcgtggtccgggtggacccggcgtggtgggacccggcggcgccgtggtgggaggacccgcgggccacgtcgggctgctgccgccgccacccggcccggcggcgcccgagcgggacatccgcgacctgtttaagaagcaggtcatcaagtgcctggaggagcagatccagtcgcaggtggacgagatccaggacctgcgcacgctcaaccagacctgggagaatcgcgtgcgcgagctgcgcgacctgctcacgcgctacgcctcgcgccgcgaggactccatgagcctgggcgcgcgcgacgccgaactgtaccacctgcccgtgttggaggccgtgcgcaaggcgcgcgacgcggcgcccttccgtccgctggcggtggaggacaaccgcctggtggccaacagcttcttctcgcagttcgtgcccggcaccgagtcgctggaacgcttcctcacgcagctgtgggaaaacgagtatttccgcacctttcgcctgcggcgtctggtcacgcatcagggggccgaagaggccatcgtatactccaattacacggtagagcgcgtgaccctgccctatctgtgtcacatcctggcgctgggcacgctggaccccgtacccgaggcctacctgcagctctccttcggcgagatcgtagccgccgcctacgacgacagcaagttttgccgatacgtggagctgatttgcagccgcgagaaggcgcgccggcgccaaatgagccgcgaagcggcgggcggagtgccagaaaggggaactgcctcgagcggcggcccaggaacgcttgaaaggtccgcgccgcgccgcttgatcacggcagacgaggagcggcgcggcccagagcgtgtcggccgatttcgaaatggaggccctgatgatccgcggcgtgctggaggtccatacggatttcactagacagaatgtgatgatcatggagccgcaagtgctcgactttacggtgcgcggcgacaagctgtggctgcatacggagcacgggctgctggtttccatggccgagtaccgcagcgagttgctgtgcacctcggcctttctgggctactccgccgtgtttttgctcgagaccgaagacgccgtcacgcaggtgaggctctcggatctgcggctcaaacaccgctgcggcatcgtcaaggccgacaacctgctgcacttcgcgctctgtaccgttatttcatgcgtggaaaattgcaacttaacgcgcaagtgcctgcacgacctgctccagtacctggacgcggtgaacgtgcgcgaaagcttcggccggctgctgcaccacagcgcccggcggctgatctgcagcgcgctctacctactctttgaggaaaaagaaccgcacattgtgcagtacgtgcccgctaccttcgtgctcttccagcagacgcggcatacctgcctgcagctggtagcacgcttctttttccgccttaccggtcaagacgaggcacactcgtttagcctcaagctgaccgagcgtaagaccgtggacggttggcccgtgggcctgggcctgctagacgtgctcaacgccaactaccccaatttgccctcaccccccaagctgccaccgcgctgggaacggggagaggaagagtgagaagcgaactagacacgcatatcatagaaaaaaaaacacgcaacacgtagtgagctttgacgtcccttttactagtatccacgtcacacgctgagaactttgacgcacttttttttactagtatccacgtcacttacccacgtagttctcctacgtgactcgttaagcgttgagccggaaaaaccgcaggccctcggaagccacccgcttagcagcgtgttgcgcgtcaaccgccagcgagcgcacccactcgtcgcgctcctcgagccaagttgccgacgaagaagaacaagacggaggagacaccgtcgccgtgcccgaagaggacgaagtgacggacggcaaggcggaggagagaacggaagaagaagaacaagtggtggtggaagcggtggaggacgacaataactctcgcgcccagacctccacgcaagccgtgagcatggcaaaggccttgtccacatagacgccgtagccgatatcggccgccaacgccgtatcgcgtgactgtacgatgatctggccctgctcggcccacacgccgtggaagggcgcgcaatcaatcaccccagcgtgcggccttacttcgttttcaccgggctggaagcgcagtaaccaaaagtccacgtcgttgcggcgagccacgaagcgaaagaggatctcgcggtacacggcttccagctcggacacgctcacgcgctcccgtaacagcgccggcagccggcccaggacatgacccacggccgagagccagtcgccaccggccgcgcagcaacagccacctaacgccgcgggcggcgtggagggagaaacccgatcactaccgccgttatgaccactcccggcagcggcatctagaccgccgccactcgcgtggtccgcgtcgcccacgccactaccaccgccgccgccgccgctagaatggcggtgagtgacgacgcagcccgcgcaacaagcgccaccgcaatgtcccgccgcgaaatcacccaccaccccgtggagcggactaccaccggcgccgccgttgccgtagaagaagttgaagggacccaccaaccgctcgtcgccccagaccaacagcacgccgggcgcgctctcttgaacacgacaggtgggacccggatcgtcgccgccaaaaagtttgcgccaataacagtcgaccacagtccgcacgcacacttcggccgagacgggtccgtgacccgaatagccgtcgtagacataaaactcgcggtggccacgcgacagaacccacaaaaggccggccgaagcgcaggctgacgtaacgtgctcggagatgtagcccagcagactctggatctgccagaaggcgcgtcgcgagcgaaaacgcagattttcaataaacttttcacaaaccgcataagtgtggagtcgatgactataacgcacgtagggattgaagtcgcgcgcgcgtacacacttggccagcacgcgctcgaccaaatccacgatgagcactcgatgtagcgtggcgtcgcgaacgtgcacggtgaaagtagcgtcgtcgctcggcgggtgcgcaccgccggtgctgctgctgacttccacgacgttgttttcaccgtcgccgtcgtcacgcggcagcggcggcaacagccagcgacgatcgccgccggccggtcgctcgcgaaaagccgtggcattgagacgcacggcgccgccgccggcctcggtgccgaagacctgccactcatcctcgggcacgccgagcgagagcgcgcagggttccacctccagcttgccggccgagcccacgatgtcaggcaggccgcaccacgagagcacctcagccgccgcgtccaacgccgtctcgcgcattaacgtgtgcagaccgtggaccgcgtagacgggcacgggcgggaaaccgggaaaaaagaaagaacgggcggcgcccgtctcaaagaggtccggccccaggtagtcgcgtagcggcggctgcccagcgaaaccacggaaaagcacgtcgtaaaggtgagtccaggccgactgcagcaataaacaacactgctcgtcggtcactgccacggccacgaaaccgacgggcgtgaccagacgcagacaggtgcgcaaaaaacacacctcgcgcacctcaaagaggcgtgccaggacggcctcgtcgtcgcgctccagcacgtacttgtgagtgccgacgcgaaacgacatggccaaatcgtaggcgtagtaaccgcgacgcaattttttgtgcgcgtgggtgccatactcttcggagacgcgttccgcggcatgcgtgaccacacgcggctcgtgcacttcgggatacgagccgatgaccactagcttggctacgtggaaaagactaagcgcgttcgacagcgctgcggtttccacgcccagtgccggtgcggcctccaaaatctccacaccgctagcgtccgtctgaatctgcaccggcgtgaaggtgcgcgccaacacgcggattaacgcgctgccttctagcaacacgcgcgccaacacggcgctacgctgctctaggccgcgccggcgctcgtcggcgtccgtagtcacggccgaggccagcgcggcgtagctggcgcgatgcacaacacgcacctcagccggcggcagacggtcaccgcgcaccacgaacgtgtgaagccgcggctcggcacggccgccacccagatccaaaaacagacattgtacgataggcaccgaggcctccagaaggccgtaccagctgagatgacagctggtcccgaacagggtgtacgggtggtggcggtggtgcaacggcggctgagcggtcatcctcggacagaagagagtcgcgaaggcccgcggggtcttttttcgtcgaccgcccggacgtgctcaaaccgcgtcgtgagccgcggcggctcccatcgtagtatttaacgacccgcgagcctgtcgtcatcggcgcgcccccatcgcctcccgagcgagcgggccgccgctatcgccatggccccctcgcacgtggataaggtgaatacacggacatggagcgcttctatcgttttcatggtgctgacttttgtcaacgtcagcgtgcatctggtgctgagcaattttccgcacctgggctacccctgcgtctactatcacgtcgtggactttgaaaggctcaacatgtcggcctacaacgtaatgcacctgcacacgcctatgcttttcttagactcggtgcagctggtgtgctacgccgtgttcatgcagctcgtctttttagccgtgaccatctactacctggtatgctggatcaagatcagcatgcgcaaggacaaaggcatgagcctaaaccagtcgacacgtgacatttcgtacatgggcgacagcctcacagccttcctcttcatcctcagcatggacacgttccaactattcacactgaccatgtcatttcggctgcccagcatgatcgccttcatggccgccgtgcactttttctgcctgaccattttcaacgtgagcatggtcacgcagtaccgcagcttcaaacgctcgctcttttttttctcgcgtcttcaccccaagctcaaaggtacggtgcagtttcgcacgctcatcgtcaacctggtggagatggcacttggtttcaacaccaccgtggtagccatggccctgtgctacggcttcggaaacaactttttcgtgcgtacaggccacatggtgttggccgtcttcgtggtctacgctatcatctccataatctactttttactgatcgaagccgtcttttttcaatacgtcaaagtgcaattcggctaccacctgggcgccttcttcggactctgcggcctcatctaccccatcgtgcagtacggcgcctttaccatcggcgacgattaccgtaccggcatcagctggtcgttcggcatgctctttttcatatgggccatgtttacgacgtgtcgcgccgtccgctactttcgcggacgcggtagcggcagtgtcaagtaccaggcgctggccacagcctccggcgaagaagtcgctgcgctcagtcaccacgacagcttggaaagccgtcgcctccgcgaagaagaggacgacgacgatgatgaagacttcgaggacgcttgaccccgccgccacccgcaccagacttggagacatggacataaaaaagagacacgcagaccgtgggtcgggagcacatactttttttttattaaaggtttatctgttcttccaccagctactttacgtgtttcaaacagcacattagacacacgggggcgcaaacacacacaaaaaaaataatatacacacggagaaacacccacgggtgtcccattcccgactcgcgaatcgtacgcgagacctgaaagtttatgagttaaaagggcaagggggcggcgggcttttttgtcccgggggtggatggacgttgtgaaatcttcttttggcgcggagtcctgggtgtgtcgggccgcggcagtcgcttagccaccacctggacgggggggaccgggggcggggacaggtaaattgaggtgtcctcttcgtctaagtcgtccgtctcctgcataatggagctttgctgatggtggtgatgttttgagggtttctttttcttttttgactgcttgctcggtttcggagccttgtcctcgcgaaacgtcgagcgcaccgcgtttttcttggggccgtcgtgggtggcctcgcggtggctgccgctactactgtcgtttcccccgcagccactaccgcacagccgcagcttctgttgccgctcctcgttatcgtcatcctccccgtcgtcatcgtcctccccttcgtccgaggaggaagtcggagggatgttgtcgtaggagcgtagagacacctggcgacccagagcatctttcaggggctcaccggacgtggtaccgaactcacaacatattcgtttgcagagttcggcacccatatcggtaggttcgtcttgcgggacaggtcgcgactccaacggtctaacacggtagagacggcatggcgcgtaaactgagggtcaaagaccacgggcgtgacgatgagcaggagcgggatgtggtcgcagtggaaaacgcgaccgccggccagcaactcgcagcccagttcgctttcctcgcgctcgcggaagatagccgagaccaggtagacggtaggcaggtcgcggaaatcgatccgctccgggtccggatgcttctttatatagtattggctgagcacgtactgctgaatgagcatctgaaagtaatactggtgacgcggattgacaaaagccggcagtgaaaagcgcgctacctcgtacacgttgagccggcccagcagctcgggcgtgttttcgtcctcgaaaggtatcggcggcggcgaatcgcccgggctgccccgcaggtggtgatcagcgccgccgccagcggcgtcgcccgcggctaggccgagactcgcgttaatagtgatcgtggcgtccccgtcgctgttgtcgtcattcaggtgcttagcgtcaaacacgatcacttccgaacactcggccttattgagatacagcagatcggccaggtactcgcgcagcggttcgggcggcttgagcgggcgcgcgcgcttgagcgtggccctgaagagcgccgcatcgtgcgaaagcagaaactcgcgtgccgacggggtttcgcgttcaccgcgaaactccacgcccggcaccgggtgtgactgcaacagcgaggccacggccgccgcgtcgtgcctccgcagcacgttctgcacaaaggggtcctcctttttgcgcaaatatttgtagcggcacttgatctcgtagacgcgcgcgcacggttccaccagcaaggtgcgaccgctgccctgcttgagcacgccgaagcacaggtccatggaagcgcccagcagccccgacgtggggtcgatgagcagaccgaggccgtcgcgcaccggctcgcgtccgtgcatcacgtaacattccaccagcgttttgactaagccctcgtgtttgataccgaactggatgcccggcgagacgccggcgcgcgagcccgtgtagtgcgagccgccgccacccgaaccgtccgccgccgcggcgccgggcagacagccgctgacgaaggcctcgtagaacttggtggccgagaccgtgtccatacgcaacagatgccacaccgagttgcgcgactgtccgcgtgattccttttccagcaactggaagagctcgacctgccgatagttgggcgccaaatccagcaaccggctgagccacacgtagtcgtccgagccgccgtgccggtcgtcgcaccgctcggccacgcgctccagggcctcggcgatctcggcgcgcgaggcttcggcggcgtgccgctgacccaaaatgtcgcgcagaccctcgtcgcgagccagcgcggccacgcgcgtcataaagtcctcggctactggcgtaccgtgggcccgcagcatcttggcgaagatgcggtaggcgtaagacagacgcagcaccgtaaagggcagattacggaagccctcctggtgcagcaaaaaggtgttcatgagaaagagactgagaggctcatcgtcccaaaccgccagcagccgggtgagctcctcatcgtcgtcgtagtccaaactcgagacgccccacatgatgatggcggcgcctcagtattttccccgccggtgggtttgtaccttctctgtcccctttcccctcggcaaccgtcacgttccgcgtcccggttactcggggaacagttgacggcagtcaccgtcaaggtcctcctcgcagattatgctggtggtgcgccgaaaggcgttatataaatacagcccgtcgctcgtggccaacagacgctccacgttctttctgacgtattcgtgcagcatggtctgcgagcattcgtggtagaagcggcgaaaggcgcgtacgcgacacgaggacatcttggcctccacaaagcgtagcgtgtgcgacaccagcgcggcgccatgctcgcccaggagacaggcgccgtagctcatttgcgccgccagaatgagcagacaggcgtcggagcagtgcgtgagcttgccgttctccaacgcgcggcaggccgcgccggcgtgcttaaagagcaacgcctccgtacccatgcgcacctcgtccagaccgcgccggtccaacagccgcatgaggcaaaagcccagcacgttacccagcgccgacaactccgacatgcaataacgccgtaggccggctacggggaaacgcgcgtgcgggtcgcagatgagcagcttctgcagcggcatgggtcggaaagcagggtggtaacattcgcgcagacggtgcgagcagttggggatgcggcgcgccgtgcccgtctcctgaaagacggccacacagcgctcgttgtaatccggatagggctcgctgaggctgtaatcgcacagcgcggcgcgcacgatctcgctggggttgtgcgggttcacgtcgatgagcacgttcatgggtgtaatatcaaagtggcatacacgacactggtgattgagaaatttgatagcgtcggccaacgtgcaaaaggcacgtcggtagctgtcgatgcacgccagcttccactggtcgtgatgaaacatgtctgtgtggaaacgtcgatgtactgtgacgttgtgcagcagacagcagcccgtggccgtgagcagaccgcggtgcacgcccgtgcccaccagcgacggcggctgctgttgctcgccagcggcgcgcgtgcggatcaggcccgacatccagaccgtgagcaccgtctcgctgtgcttacgcgccaccttgaccacgcgatagcgatcgagcggccagacctcgccgaaggagccctggcccaggcggtagctctcgtcgctcatgtccacggcataacagatcttgtggcaaaaatcgtcctctttgggcacgtagaccagcaggtaggagatagagagctcgcagagctcgggatgcgtaaggcgcaagaacatacgcgggtcgcacgtaaggccgcggatggacgtggtgatgatctggtcgttggaacaggtgcaatgcacgtcgtcgtgtgacgtggagtcggcctccaccgccgtggcggattcctccccggaactaccgctgagcggctgcggaacgcggcccgggcccgatgccacggcgctgtcctgactttccgcgcgcagctccacgtcgttttcttcgagcaccgcgtccacgccgcccacacgacgtcggcacagcggggtgcgggccagcgacaccaacggcggacgcaacgggcgtttgcgtccaccgcgaacgccgctcacgctgtccgaggggtcgctgccgccggtgaagagagcgcggcgtacgctggtcacgtcgccgtcgcgatcgtactcgaacgaccacatggccgaggtttcgcggcagcgcaagccgtggtaaccgtcgccgctggcggcgctgccgcgagacgacgtggacggcaccacgggccgacgctggttctccttgtccgaagccgcgtcctctttttctccgtcacgcatcacgtcacttcgaacgcatgcggaaaaagtcgcgtgtccaagcacggtggttgtgctgacggaactcagggtggtcaaagtggtgacgccgccgccggcctcgtcggccatcagatccacgacctcgtcttcatcgacgtgagcctgggcaacttgagcggcggcggcctgcgcggcctgtaccgcggcttgagcggcggcctgcgcagcttcgcgcatccactggcgccggcgcgccctgctgggacgacgcaatggcggcggatcccagccctgagtcgtcgttccgagcgaggccgagcgagcccgagaccgaagtgcggaggacatagtggcgacagtcttccctgttcctagggctgcactagctaccacaccgacactgtcgttatggtgtgtttttttttttaataaaatctgaacagaggcgtgacggggattgctatacctgttagacggcgtcgtcaacctccaggtccaaatcgcacgtcgccgaaaccgagtccaccaaggtggctctcacgtcgtctaccgtgtccttcagctcggttaaagagtccagcgcgtcgtccacgttaccggattgcagctgtcgggcgcgttgcaactcttgctgcacggccgcccgttgctccaacaggtgtgcggccacgcactgcgtcgttcgctgactgtatcgggtctgttcccgagcggccacacgcatcaccgtcaaagcctgctgcgtggtgagccggtgctgcggtccgtaggtacgccgcagaaactgatgctgctgtcgctcaaggtcgacgcgcatcacgtcctttaagagctgtttgttgaccgacgtcatagattcaacgtgatgagacccgcgtcgttcagcgagagagcgtccagcaacttgccgacgtggtagacggggaaaagcgagacggtgctctggccgggcaagatgtggctcaaagtgacgtcggtaacagccgcggcgcagtcttggataacgatggggctataactcacggtccgcgcctcgtcacgcgcgagatctaaacagagacggttctgactgtagagcgcgcacaacaaacaggtgcgcgacgaggccggccaggcgggcacctcgcgccccgagaagcggccgcgcaccgcctgtaacacctctctgagacggtccagcgagacgggctttaaaggcaaatgcacctcgtcgccggcgtcatcgacccggcctgctgacgcgctcgtctcgaccgcacaagcgccggccccgccgccgccaccactaccaccaccaccaccaccacccgccgtcgtcgcctgcggcgttggcgcagggaattcgtagccgcgataccaaacaaagacgtacagctcagccagattcatgtaggtcatatagtcccgcacgggttcgtaaaagagtttgggcaacaacgcggggaaaggacaaccgttcttttcgcgaccgaaacaggtgtcacgcgcgcaaaagctgcgcggtccacagtacagcagccacagcagggcctccacgtcgcacacgttgtgatgatctaacaagcccggcgtgtacacctgtcgcagcacggcttccacgtattgcaccttgttgctggagagtgacagctccacgtgagccttgcgatacaacaggtaactgccgtagattaattcgccgtcgtaggtaacacggtcagcattgcgtaacgcataatcatgcacacaaagcgacggcaaaggctcagccgcggccgcgaaacgctccagcacgtcgtgtcgacgtagaaaagacggcgtggcggcgtcgtttttcggagcgcgtcgtctacgacggcgtttggcccgagacccaccgccgttcttttcccccgcggttttattcccgacgtttttctttttgtcctccggcccgctatcgccaccgctgctactgctatccaacaccggcacctcggccgactcgcgcggaattacgttggtgaccaacaagaaattctcgtcgggcgtttcaattaggcgaaagcgatcgtaaggtgacacggcctcgcaggccaccagcgccatatttacggcctcctcgaagcgccaagcctcggagaccgagaaatcggcggccggagactgcgccgacagctcgaccatccgttccaccgagcacagggacgtcgaaaccccggcggaccccggagacctgacggcagttgagggagaggagacggggaaactgagaggagaggcggaggaagattcgtctgagcctgacgccgaggaagacgacaccactagggacgacgaagacgaacgagtgacggcgcccgtcccacaagccacgtccgcgacaacgtggttttcgggtggatcctccgtcgtcctcgcggacgccatctttttcctctcctctcgccgctgccgcctaacctccgctcgcactaccgccgccgccatcatgttgcgcggagattcggccgccaagatccaggagcgctacgcggagctgcagaagcgcaagagccaccccacctcctgcatctccacggccttcaccaatgtggcggcgctgtgccgcaagcgctaccagatgatgcaccccgaactcgggctggcccactcgtgcaacgaggccttcctgccgctcatggccttctgcggccgccaccgcgactacaactcgcccgaggaaagccagcgcgagctgctgtttcacgagcgcctcaagagtgcgctcgatgaactgacgtttcgcccgtgctccgaggagcagcgcgcctcctaccagaagctggacgcgttaaccgagctctaccgcgatccgcagtttcagcagatcaacaacttcatgaccgactttaaaaagtggctcgacggcggcttcagtaccgccgtcgagggcgacgcaaaagccatccgactcgaaccgtttcaaaagaatttattgatacacgtcatcttttttatagccgtgaccaagatccccgtgctggccaatcgcgtgctgcagtacctcatccacgccttccagatcgacttcctctcgcagacctccatcgacatctttaagcagaaagccaccgtgttcctggtgccgcgacgtcacggcaagacttggttcatcatccccattatctcgtttctgcttaagcacatgatcggcatcagcatcggctacgtggcgcaccaaaagcacgtgtcgcagtttgtgctcaaagaggtcgagttccgctgccgccacaccttcgcgcgcgactacgtggtcgagaacaaggacaacgtgatcagcatcgaccaccgcggcgccaagagcacggcgctttttgccagttgctacaacaccaacgtgagtagctccatgatgataatatacgccttgccacaaaccgtggcgaatccatgtcctcttttttttttgttgtttcttgtttcttctccccgtgaactgtcagaccccgttagtgcactaggttcttaagcaccggacaggaacacactatcatacgtgacacaggttcctctaccttgaccaggtcccacacatcggtcttgacgggcaaccatcggccctcagaatccttgacaccgatgtgataatccaggccgtctcccagtgtgacctgcgccgcggtcttagaacctacggcgcataggtacttggcgtcatcgctctcacagaaaaaagtcgcgggttcctcgttgtggatgagcgactgcgtcatgggcccacagggcacgtaacaaagacagcggcccatatcgggggtgcaacccacgtaattgccagtgggatctacatgtccctcgtgatccgtgcaaaagctgcaacccgcctgcccgcaggccgtggccgccgccatgagccgcgtcatggaagggatatcgcaccgattgccgcatgaggtaaacaggtcgtagcacagaatgtaaaagaaaagcgtgtagccttcaggacgcggcagcaaccaggcgccggcgccgcctagcgtcactgccttctgacaggtcaggtccatggcaccgtgacccttgaccaggatgcgcttggcttcatcctggggcaccaacatgcagacctcgtaaatcacgtcgggcgtaataccatcgcacgtcatactgctggtcacctggctaaagcttggcaagaaatcaatgctggctggacccaaaggacctccgaagctcagttggtacaaggtaggtaaatgacagatgcgtcgacgacgccgatgtacgtggcccacgccatagtggccttgataacggccgttgcagcaaagacagaggatccattcgccgtcgcggtagagcaacagcaattggcacaagatacacgagccgtcgtcctccggactaaagatcgtcgaacggcaagcgacggcccgatactcgcggtgtttccggctcttgccgaccagcttccacatgcattcctcttgcaagaactgcttcaaagttctggaatcggtctcgcaaagcccgctgcgccaagccatgaagagtgacgcgcgaagagacggcaaagccgcccggcagcacccagtaaaagtccaagtctggcgtgacgtagaacacgcacacctcgggctgcgagagccaacgtcgcaggcgtccgcggcgatcacggacgatccaaagcccggtgcgaggacaacgcgccgcgcgcacttccacgcccaaatccacttgcgcgcgaacgcagcgcaccacgtcagcgtaccaagtccgttcggcgggcggaccgctctcgttccgcggtccgaaaagcagctcctgcggtttgggcgccgagcgctcgcgctgacgacgagctcgctgagcggcagcggcggcaccccggctcagacgaggcgttagcgccttaataatacagctacgcacgtccgcccgatccatccagagcgccaaggcatgacggcaaagttcccaaacaacgcgccaggacatgttccgtggcacgtggcaggcgaaacgctgtggcaacgcgccgctgtcccgtcgtagtacagcgtagatctcgtcgcgcacggcgcgaatcagcacgtactcgacggcgatgcgcgcccgataagcgtccaacgcccggtatagttcgacttcgtggtcatcgtagctcagctcgcgactgcgccaaaaggaattgacgtaccacagcacacggaggcgcacgcgatgctgcacatcccagacctcgcggagacgcgagacaccggcacccttccactcgtccgtacgcgcgacctcgtcgcggtcgtgcggatcggtggcgtacatgaggtctggatttacatccaggcgcagctgcaccaactcatgaccgcgtatcttggaaggcggctccaatggacccgcgtgatagatgaattcctcgtcgccgcgcaacaaacgcgctacccgctgctccaggttactgaatctgccgccgccgttcgcggaggagattcctgctccgttcggaatttcaaaaaatggagtactgacggccgtctccagagaagccacagccgcttcgggcaaacggcgatccgacccattgtctaagttattacgcagtccgccccgccgacggtgattcgtggtcgtggccaactggtgctgccggtcgcgcttattcgcttccatttcttctcgtaacaggtcacgcgctaaaaactcccagtcacgatagctgccgtcgggccagaccagtctcaggtgtagcgtctgcgcgcctgagagccgattatcggggcagcgcagacccaacgtagtgaagacggcatagaacatgcgcacgcgctgctctttctctaacgtcacagtgagaccgctttgacgtaggtaatcgagcaactccagtgggcgcggtagtacacgaaaacaggcccgctgccaagtccgccgctcgcggtcaaaagcgcgatcgccgcccacggcgtcctcggcgtcgtcggaggccggtgcgtcgtcctcatctccgcccggagcgcggcccgcggatcggccagcgctgtctacattacgatagtagacgtagcgcagcgtctcggcctcctcgttactcagcacctcctggtcgagcaccaagtgtagaggcaattgctcatcgtcagcgaaccgcgcctcaaacgccagatccgaatacaggtgcgtttccatattcggaacgcatctgtttcagaagcgcgtcctcacgcttcttacgactaaccttgatgacacacgcgtcgtacttggtctgctttgagtagataccgatgataagctgaataaaaagttggctgatgacgggcaccgaaatacggttgacgttatgcatagaacggaaaaccttattaaaggtgaagtaaatactgtcctccacctgctttttgaggcggtcgcgctcgaccacctcttggatcacgtcggcgtaacggccggcgtgcgtcatgaggtagctgtacacgccgctgagcacggcgctgatgatgttgacgtcgtccagtgcgacctcctcgataggttccaacaggtggctacgcgccaccggatagagagtctcgtataccaggcccgtcttgacgcagacggagccctcgagcgtggagacgagcgcgcagccgctgcccagatcacacaggtgcgtgcgaaagcagcgcgtgcacgcgtagagggagtgtaactggatctcctcggtaaacgcgttctggacgtgcctcatgtcacaggcgcccgaggcgtcgcacatgacgtctgagcgtcgctgacagttttgggggcggagggaacaggagaagggcagggacgacaggtgttgcttgtctccacgacgttcacgtccgggtggctgcaggcgtccaggatgtcgttgacgcactccaccgtcaggtgctcgaacacggacgcgaccagttccaagcggcgcgggcctgactcctcggcctggaaaaggaaggaaaagtgttgaaagaggcggtcgacaaagataaaaacatcctccgtagtggcgtgcgcgacccccagtcggttgagttccgtcagcaacgagttcatggcggctgtggcgggtcgcgacgacgacactttcgtttttatgggcgcgcgtcacgcggcgccggtgtcggcggattggttccggttttcaggtcgcagcccggttggcacacggcgatcccgcctcacctggcggctcacctggctcacctgtccggccccaccccgactctgtaggcttccagccgagcgtgcgtaatcataagagtcccttttctgtctcctctctacacagagcatccgaggacaaaacttccatttgctgctggtggacgaggcgcacttcatcaagaaagaggccttcaacaccattctggggttcctggcccagaataccaccaagatcatcttcatatcgtccaccaacactaccagtgacgccacgtgtttcttgacgcgcctcaacaatgcgccctttgacatgctcaacgtggtctcttacgtgtgcgaagagcacctgcacagcttcacggagaagggcgacgccacagcgtgtccttgctaccgactgcacaagcccaccttcatcagcctcaactcgcaggtgcgcaagacggccaacatgtttatgccgggcgctttcatggacgagatcatcggcggtaccaataaaatctcgcagaacaccgtgctcatcacggaccagagccgcgaagagttcgatattttgcgttacagcacgctcaacaccaacgcctacgattatttcggcaagacgctttacgtgtatctggacccggccttcaccaccaaccgcaaggcctcgggcacgggcgtggcggccgtaggcgcctaccgacaccagtttctcatttacggcctagagcatttctttttgcgcgacctctccgagagttctgaggtagccatcgccgagtgcgcggcgcacatgatcatctcggtgctgagcctgcacccttacctggacgaactgcgtatcgccgtggagggcaacaccaaccaggcggcggccgtgcgcatcgcctgcctcatccgacagagcgtgcaaagcagcacgctcatccgcgtgctcttctaccacacgcccgaccagaaccacatcgaacagcccttctacctcatgggccgcgacaaggcgctggccgtggaacagttcatctcgcgtttcaactcgggctacatcaaagcctcgcaagagctcgtctcctacaccatcaagctgagccacgaccccatcgagtatcttctggagcagattcagaacctgcaccgcgtcacgctggccgaaggcacgacggcacgctactcggccaagcgccagaatcgtatctcggacgatcttatcatcgccgtcatcatggccacctacctgtgtgacgatatacacgccatccgtttcagggtcagctaggcacgcagcagagccaccaggtgccggcgactgacgccggcatcggcagaaacgagacgatcgtaacccaggcgcgtaaaactccccaaaggcgaaaacgtttcagcgtagtcggctaacaaagcccgggccgccgccagcgtccgcgcctgcacgccgccgtgactgcgataataacggcgcagcaccacgttgacaaggtcgttctcctcgacgcgcggcggcggaggatccaaggcctccagcgcctcctggtgcaaatgcagcgaattgagcaacaaacacagacaggcggccagcttcatcgtcttgcgatgtagcagaaaaccgccgcttgcgcccgagacggcggcatcctcgggctttccggccaacatgcccagcatctcctcgcccatctcgtcctcgtccagctcgtaaagacagacttgacaaagaaaatagttctccagacgcggcacgtcgagcaagagcagcttcttagcacccgccagccccacgcagtgctccagcagacgggcggatgaacgcggaatattactcattcgcaaacggtgataagcgctggccaccacaccatcaaacatgtccgaatcaccgcgcgtggcactctgtaacaacggcgctagacgctcctccatctcgggcggacaaagaaccagctcctcgtgcgagcgccgttccagcaaaaaaaaatattggcggaacgtgttcaccagggcgcgcgccgccgagattcgtcgctgcaccgtagtgatcacaacgtccggcgcccaaagcacgctggtacccggccaaataacgtgtctggggccggtgctgccgccgtcgttgacgcgaatcatataaatgcccggcatgtcgtacagctcgtccctgctgtcgtcgtctccccggcgctcctcaccactcgcatcaccgtcgcgccaccgtagcctactactccccaactgaccgcattccaccaccaacttggcgcaatgggtaatgcccgtaagcgcgtacaccagatcgctatgcttctgccaatagatggagaagacggacgacctgcggttaaaacgaccgctgcaataaaaacacagctcggaagcaaaaaccacgtcgtcttcggcgtcgggcggcggcggtaacacacggcgaatcagttgcgacagcggtccgttgcgaaacgcgtgctcgcgcaccgtaccgtcgtccattaacaacgccgcgtcgtgccaacccggcgtcggacgctcctccggacgaaacgccgcggcggcagcggccgcggcttccatcatcgtgatgcaaaccgcgctcgcggcgacgtgggttcagaactgccgtcaacgctgacggaggtttggacagaagggacggaggaagatgaggacacacacaatgggggaggggatggacacaggcccgatgtggctgcggccgccgagcacaatcgaaacaacgtctggtggatcacttcgcgcgtgtgcggcgtaccgctgatactctgcaacacgcccagcacctcgactaacactttgaggcgcgtgcgagggatcttgtgggcttccacgtgccgacacaccgtcagcacgttggcgttccggcccaggtgatccaatttgacttttttgttccgggccaggatcttgggcacgttgttggctagacgactgccgatgagcgcacaagtgtgcttgatcttggtgtgcgccgtgaggttcttgctgtagtcaaagagaccccgctgtgccgcctcaaatactaggcggtccaactgcagccgcttctctcgaccgtgcagcttgagcaggcaagcacgcagaaacagcactaactgcttggccaggaaggggatctggtacgaattgcgcagctctagttgcgtgaaaacgcggtgcagaccgtaatcgatgcacacgtcgcgcatgttcttgatgcacgagagttctttgagcagaatggcttccaggtcagcgcccgagacgcgcggcacaatggccgtagccgctttgaaccagcccacgttgacgttgttagtatgcgagatcatgcacggaaagttggtggtccagtacaccttgctgcgctccgagcggatcaccgcctggtcctccagcccatgcacgtccagcgaggagttgctgttgcacaccacggccggcagaaaaaagtgatcgatattaacgtgcagccggtacacgcccagcgagtacagaaactcggggtaggaaccgcgaatattgacgttgagcgagttaatgtagacggcgtcgttggaaacaaaggtgctgacggtgcaagcgggctccttaaaggtgtgcttgtacatcacaaaactgtgggtcatgttcttgggaagccgcggcgcgcgcacgccgagacccgacgcggcgatggacgagagcgcggccttcatattgataacgcggttggtgttgaaagcgttgacggcgatgcggtccagactcacgcccgtcacctcggcaaactccatcccgccgatgagcttacgacggcacggcgcgtaacgctgcacggctagatgtttacgacgtcggtgttcctgataggcccggcgcagctgctgccccgtaaagtcaaatggcggcgtggcgtcagtctcccccgattccagcgtctcttcctcctcctcttctcccgtctccgaccgccgttgacggtgtttacgccatctctccccgtaccgagcgtacatgagacgcgagatgatgcacacgtaacgtcgaacgcgatcggcggccgggtcgcgcggcagtgacagcttgtgacccgcgctcgtcgtcgggagcgcggtggaagacagcgcgtgtccgttcgccgaaaccaccgtcgattctgacggtgatagccgcgacgtcctcggagcgcaagaaacaccgtaaccgcggtttacgggtcggttccccgtcccatgggaccccagatcccgagctagttcataataaacgtagaaaaggtttctccacaccgtgtccgtgtcggcaaacgtgacgctaaggcgtcgataacacagtaggttgtggtgtccctgatttccaccgtttccccctcccccacttctgtcagcgtggccagtccggcacttgccgtagctcacctgtaacttgaagtacagtacctgtcgcttgaagcgactgagaacgaaggtgctcaggtggcacaccgtctgctcgggcaagcgaagcgccatcatgacgcgggcgcggtcgcgatgcagctgagccagcacgcgaccgaaaaactccgacgtcacttcgtggtgatattcaacgcccagccaaagcttttgcagctccagtagaaaaaagtcgcgtgtagcgtccaacgcgcacggcgcttgcggacgcacgttgagtccaaagagcagcttgtagtgaacctggatgcgcggcgccgcggcctcgcccaggtagccggagacggcggttacgtagtcgtctacctcgctgacactgagtacgcgtccgatttccaccatcaggtaaggatagtcgtccaggtgcaggctgaggtcgcgcggcaggcaggccatagcgtagcgttcctcggttcccgaggcgccaccgccgccaggacagtcgcaaaagaggctcggcaattctcgattccattccgtcagcgagagcaatccgcgtagcacatgcgtggccacgtggttttcgagaacgtggtaggacagcgcgcgcccggcggtcacggatccgcaacaacaacgtcggtgcacgtagagcagcggcccgcgacaaaactgcgtcgtaggtaccagatgttcaccgtggccctccacttcaccgtcgcaaaaacagggtacggccacgggtcccagtaacagacgacccagtaccagcttgacacgctcgggctcggtcctcacgtgtatcggacaggcacggtagagagccgcaaaaacagcgcgcacccgttcgacgttaacgggtcgcggacgacagaagcgggcgtcctcgcccgtcgatagctcttgggtgaggttgcaggcgcgaacgtgcacggggacgtgtaaaacccggcgcggcatagcggagccgccgacgactattagagcgtcacagccgaggcggcgcggcgcagcgccggccattctccgggtcgcgctgctttccccgagctccgacgcctcgcgctcacgccgccgccgcgatggagaactggtcggcgctcgagctcctgcctaaagtaggcattcccactgactttctgacgcacgtcaagaccagcgccggcgaggagatgtttgaggccttacgcatctactacggcgatgaccccgagcgttacaatattcacttcgaagccatcttcggcaccttctgcaatcgcctggaatgggtttattttttgaccagcggcttggccgcggcggcgcacgccatcaagttccacgacctcaataaactgactacgggaaaaatgctgttccacgtgcaggtgccgcgtgtggccagcggcgccggtttgcctaccagtcgtcagaccaccattatggtcaccaaatacagtgaaaaatcccccatcaccatcccctttgagctcagcgcagcctgcctcacgtatctgcgcgagacgttcgaaggcaccatcctggacaagatcctcaacgtggaagctatgcacacggtgctgcgcgcgctcaaaaacacggccgacgccatggaacgcggcttgattcacagctttttacagacactgctacgcaaggcgccgccgtactttgtggtgcagacgctggtagagaacgccacgctggcgcgacaggcgctgaaccgcatccagcgaagcaacatcttgcagagcttcaaggccaaaatgctggccacgctctttttgctgaatcgcacgcgcgatcgcgactatgtgctcaagttcctcacgcgtctggccgaagcggccaccgatagcatcctagacaaccccaccacgtacaccacgagctcgggggccaagatcagcggcgtgatggtaagcacggccaacgttatgcagatcatcatgtcgctgctctcaagccacatcaccaaagaaacggtctcggcgccggccacctacggcaattttgtactcagtcccgaaaatgccgtcactgccatatcctatcactcgatcctggccgatttcaactcgtacaaggctcatctgacttcgggccaaccgcatttgcccaacaactcgctttcgcaggccggggcgcacagcttaacgccgctgagcatggacgtgatccgactgggcgaaaaaacggtgattatggaaaacttgcggcgcgtctacaaaaacaccgataccaaagatccgctagaacgtaacgtggacctgacgtttttcttccccgtagggctgtatctgcccgaggatcgcggttacaccacggtggaaagcaaagttaagcttaacgacaccgttcgcaacgcgttgcccaccacggcctacctgctaaaccgggaccgtgccgtacaaaaaatagactttgtggacgcgctcaagacgctgtgccacccggtgctgcacgagcccgcgccctgtctacagaccttcacggaacgcggaccgccctcggaacccgccatgcaacgactgctcgagtgtcgttttcagcaggaacccatgggcggtgcggcgcgccgcataccgcatttttaccgcgtacgacgcgaggtcccgcgcacggtgaacgaaataaagcaggactttgtggtcaccgacttctacaaggtgggcaacatcacgctctacaccgagctgcaccccttcttcgactttacgcactgccaggaaaacagcgaaacggtggcgctgtgtacaccgcgtatcgtcatcggtaatttgccagatggactggcaccgggccccttccacgaactgcgcacctgggagatcatggaacacatgcgactgcggccaccacccgactacgaagagacgttgcgacttttcaaaaccaccgtgacaagccccaattaccccgagctttgctacctggtcgacgtgctggtacacggcaacgtcgacgcttttttgctaatccgcactttcgtagcacgttgtatcgtcaacatgtttcacacacgtcagctgctggtttttgcgcacagctacgcgctggtgacgttgatcgccgaacacctggctgatggcgccctaccaccgcagttgctctttcactaccgcaatctggtcgccgtgctgcgtctggtaacgcgcatctcagcgctgccgggacttaacaacggtcaactggctgaggaaccgctatcggcttacgtgaacgcgctgcacgaccaccggctgtggccccccttcgttacgcacctgccgcgtaacatggaaggcgtacaggtagtggccgaccggcaaccgttgaacccggccaacatcgaggcgcgacaccacggcgtttcggacgtaccgcgtttgggcgccatggatgccgacgagccgctgtttgtggacgattaccgtgccaccgacgacgaatggacgttacaaaaggtcttttatctctgcctcatgcccgccatgaccaacaaccgggcctgcggcctgggactcaacctcaagacgctgctagtagacctcttttaccgaccggcgtttctcctgatgccggccgccaccgcggtctccacgtcaggtacgacgtcgaaagagagcacaagcggtgtcacccccgaagactcgatagcggcgcaacgtcaagccgtaggcgagatgctgaccgagctggtggaggacgtcgccaccgacgcacatacgccgctgctgcaggcctgtcgtgaactgtttttggccgtgcaattcgtgggcgagcacgtcaaggtgctcgaagtgcgcgcgcctctggaccacgcgcagcgtcagggcctgccggactttatctcacgtcagcacgtgctttacaacggctgctgcgtcgtgacggcgcctaagacgttgatcgagtacagcctacccgtacctttccaccgtttctactcaaaccccaccatctgcgcggcgttgagcgacgacattaaacgctacgtgaccgagttcccgcactatcaccgtcacgacggtggtttcccgctacccacagccttcgcgcacgagtaccacaactggctgcgctcgcccttttcgcgttactcggccacctgtcccaacgtgttgcactcagtcatgacgctggccgccatgttatacaaaatctcaccagtttcactggtgctgcagaccaaggcgcacatccacccgggattcgcactcacggccgtacgcaccgacaccttcgaggtggacatgctgctctacagcggcaaatcatgcacgtcagttatcatcaacaaccctatcgtgaccaaggaggaacgcgacatcagcaccacgtaccacgtcacgcagaacattaacaccgtagacatgggtctgggttacacgtcaaatacctgcgtagcctacgtaaaccgcgtgcgaaccgacatgggcgtccgcgtgcaggacctctttcgcgtcttccctatgaacgtgtaccggcacgacgaggtggaccgctggatccggcacgcggccggcgtagaacggccgcaactgttagacacggagaccatctccatgctgacgttcggcagcatgtccgagcgcaatgccgccgccacggtgcacggacaaaaggccgcgtgcgaactaatccttacgccggtgacgattgacgttaattactttaagatccccaacaacccgcgcgggcgtgcctcctgcatgctggccgtcgatccgtacgacacggaggccgccaccaaggccatctacgaccatcgcgaagcggacgcacagactttcgcggccacacacaacccctgggcctcgcaagccggctgtctgagcgacgtactctacaacacccgacatcgcgaacgtctaggctacaactccaaattctacagcccttgcgcgcagtactttaacacagaagagattatcgcggccaacaaaacgctcttcaaaaccatcgacgagtacctgctacgcgccaaggactgcatccgcggcgacacggacacgcagtacgtctgcgtcgaaggcacggaacaactcatcgaaaacccgtgccgtctgacgcaggaagcgctaccgatcctcagcaccaccacgctggcgctgatggagaccaaactcaagggtggcgccggggcttttgctacgtccgaaacgcactttggtaactacgtcgtaggcgaaatcatcccgctgcagcaatccatgttatttaactcgtgaggccgtccggtgaggaggacggcgacgaccgcaggttagcggcgagtcacctagacgcaaacgcgggcccggacgcgccacgctcgctctgacgccgcgcccggtgcagacgttgttcgtctctgcttctcctccgtcgcggccaggatttcaccgccgctatggcggccatggaggccaacatcttctgcactttcgaccacaagctcagcatcgccgacgtaggcaaactgaccaagctagtagcggccgttgtgcccattccgcagcgtctacatctcatcaagcactaccagctgggcctacaccagttcgtagatcacacccgcggctacgtacgactgcgcggcctgctgcgcaatatgacgctgacgttgatgcggcgcgtagaaggcaaccagatcctcctacacgtaccgacgcacggactgctctacaccgtcctcaacacgggacccgtgacttgggagaagggcgacgcgctatgcgtgctgccgccgctcttccacggaccgctggcgcgcgagaacctgctgacgctgggccagtgggagctggtgctgccctggatcgtacccatgccactggcgctggaaatcaaccagcgactactcatcatgggcctcttctcgctcgaccgttcgtacgaggaggtaaaggctgccgtgcagcagctgcagaccattacttttcgcgacgccaccttcaccatccccgatccggtcatcgaccagcacctgctgatcgacatgaagaccgcctgcctctccatgtccatggtggccaacctagcctcggagctgaccatgacctatgtgcgcaagttggcgctagaggacagctccatgctgctcgtcaagtgccaggagctgctgatgcggctggaccgcgagcgcagcgtcggcgagccgcgcacgcccgcgcggccgcagcacgtgtcacccgacgacgagatcgcgcggctgtcggcgcttttcgtcatgctgcgacagctggatgacctcatccgcgaacaggtcgtcttcacggtgtgtgacgtttcacccgataacaaatccgcgacctgcatatttaaaggctgagccggccctctcgcgcccgcagacaccaagcatgccacgcgtcgaccccaaccttcggaatcgggcccgccggccacgagccagacgaggcggcggcggtggcgttggcagcaatagcagccgacacagcggcaaatgccgccgccaacgccgagctctgtcgacgccgccgctcactttcctcgccactactaccaccacgaccatgatgggcgtcgccagtaccgacgacgacagtctcctcctgaaaacgccggacgagctggacaagcacagcggctcaccgcagaccatcctcacactgacggataaacacgacatccgtcagcctcgggtgcaccgcggcacctaccatctgatccagttgcacctcgacctccgacccgaagaattgcgggatcccttccagattctgctctctacgccgctgcaattgggggaagcgaacggcgagtctcaaaccgcccccgcgacgtcgcaagaagaagaaacggcggcttctcacgagcccgagaaaaaaaaggaaaaagaagagaagaaagaagaagaggacgaggatgaccgcaacgacgatcgtgaacgcggcattctatgcgtggtctctaacgaggattctgacgtgcgcccggccttctctctctttcccgcacgcccaggctgccatatcctgcgctcggtaattgaccaacaactgaagcgcatggccatcgtgcgcttatcactcaatctgttcgcgctccgtatcatcacgccgctgctgaaacggctaccgctacgacgtaaagccgcgcatcacacggcgttacacgactgtctggcgctgcatctgccagaactcacgttcgagccgacgctggatataaacaacgtaacggagaacgcggcttccgccgccgatgccgcggaatcaacggacgcggatctaacgcccacgctgacggtgcgcgtacgacacgcgctgtgctggcatcgagtggaaggcggcatctcggggccgcgtggactcaccagccgtatctcggcgcgcctctcggaaaccactgccaagacattgggaccctccgtctttggacgattggagctagacccgaacgaatcaccgccggacctgacgctgtcgtcactcacgctataccaagacggcatgttacgtttcaacgtgacctgcgaccgcaccgaggcgccagccgacccagtggcgtttcgcctgcggctgcgacgcgaaacggtgcgacgacccttcttttcggacgcgccactgccttactttgtaccgccacgctccggcgcggcggacgagggactggaggtgcgcgtcccttacgaattgacgctgaagaactcgcacacgttacgtatctaccgccgcttttacgggccttatctgggtgtttttgtaccacacaaccgtcagggactcaaaatgcccgttacggtctggctaccgcgctcctggttggaattaaccgtactggtgagcgacgagaacggcgccacgttcccacgggacgcgctcctggggcgcctctattttatctcgtcaaagcatacgctgaatcgcggttgcctgtcagcaatgacgcaccaagtcaaatccacgctacactcgcggtctacgtcccattcgccgtcgcaacagcagctctcggtgctgggcgcttccatcgcgctggaggacctgctgcccatgcgtctggcgtccccggagacggaaccgcaagactgtaagcttacggaaaatacgacagggaatacgagtcctgtcactttagccatggtctgcggcgatctctaaacagaggaccctggtgatgggaaacggacactaggcgtccgcgcgatacggggttaaaacaaaaaaaaatcggtggtggtgtgtgatggggtgtggtgacggtggggcttcgcctctttttttttaataaaaaaagacactcaataatccgcggttgtctctgtgtagaacgtttttatttcgggttccgcgtctggtcgcctgcctatgtaaggcggcggccggagagggcgcgccgctcagtcgcctacacccgtacgcgcaggcagcatggagtcacgcggtcgccgttgtcccgaaatgatatccgtactgggtcccatttcggggcacgtgctgaaagccgtgtttagtcgcggcgacacgccggtgctgccgcacgagacgcgactcctgcagacgggtatccacgtgcgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccggagcatctgccccagccaggagcccatgtcgatctatgtgtacgcgctgccgctcaagatgctgaacatccccagcatcaacgtgcaccactacccgtcggcggccgagcgcaaacaccgacacctgcccgtagccgacgctgttattcacgcgtcgggcaagcagatgtggcaggcgcgtctcacggtctcgggactggcctggacgcgtcagcagaaccagtggaaagagcccgacgtctactacacgtcggcgttcgtgtttcccaccaaggacgtggcactgcggcacgtggtgtgcgcgcacgagctggtttgctccatggagaacacgcgcgcaaccaagatgcaggtgataggtgaccagtacgtcaaggtatacctggagtccttctgcgaggacgtgccctccggcaagctctttatgcacgtcacgttgggctctgacgtggaagaggacctgacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccgggcctgagcatctcaggtaacctattgatgaacgggcagcagatcttcctggaggtgcaagcgatacgcgagaccgtggaactgcgtcagtacgatcccgtggctgcgctcttctttttcgatatcgacttgctgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaggaactcgtaaccaccgagcgcaagacgccccgcgttaccggcggcggcgccatggcgggcgcctccacttccgcgggccgcaaacgcaaatcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggttgagccatccgccgcgcacgcgcttaggacgactctataaaaacccacgtccactcagacacgcaacttttggccgccacacctgtcgccgctgctatatttgcgacagttgccggaacccttcccgacctcccacgaagacccgttcacctttgcgcatcccctgacccccccccatcccgccttcgcaatgtctcaggcatcgtcctcgcccggtgagggaccctcgtcggaagcggccgcgatcagcgaggccgaagccgccagcggaagctttggtcgcctgcactgccaggtgcttcggctcatcaccaacgtggaaggcggctcgctggaagccggtcgtctgcgactcctggacctgcgtaccaacatagaggtgagccggccctcggttctctgctgttttcaggagaacaaatctccgcacgacaccgtagacctgaccgacctaaacatcaagggccgctgcgtggtgggcgaacaggaccgactgctggtggacctcaacaactttggcccacgacgcctgacgccaggctcagaaaacaacacggtctcggtactggcctttgcactgccgctggaccgcgtgcccgttagcggactgcacctctttcagagccagcggcgcggcggcgaagaaaatcggccgcgagtggaggcgcgcgccatcatccgccgcacggcccactactgggccgtgcgactgaccgtaacgccgaactggcgccgcagaaccgacagcagcttggaggccggccagatctttgtcagccagttcgcctttcgcgccggcgctatcccgctgacgctggtagacgccctggagcagctggcctgttcggaccctaacacgtacatccacaaaacggagacggacgagcgaggccaatggatcatgctgtttctgcatcacgactcaccgcacccgccgaccagcgtgtttctgcacttttcggtttacacgcatcgcgccgaggtggtggcgcgacacaatccgtacccgcacctacgacgcttgccggacaacggcttccagctgttgattcccaaaagttttacgctgacgcgcatacatcccgagtacatcgtgcagatccagaatgctttcgagaccaatcagactcacgacaccatctttttcccggaaaacatcccgggcgtctccatagaagccggcccgctacccgatcgtgtgcgaatcaccctccgcgtcacgctgaccggcgatcaggccgttcatttggaacaccgacagccgctaggccgcatccactttttccgccgtgggttttggactctcacacccggtaaaccggacaagatcaagcgtccccaggtgcagctgcgcgccggtctctttccacggagcaacgtcatgcgcggcgccgtctccgagtttctcccgcagtcccccggattaccacccaccgaggaagaggaggaagaagaggaagaggacgacgaagatgacctctcctccacaccgacgccaacccccctgtccgaagccatgtttgccggcttcgaggaggccagcggcgacgaggactcagacacccaagccggactgtcccgggcactgattctgaccggacaaagacgccgaagcggtaacaacggggctctcacactcgtcatcccctcgtggcacgtctttgcgagcttggacgacctggtaccattaacggtgagcgttcagcatggcgcactacgacctacctcttatctgcgcagcgacatggacggcgacgtgcgtaccgcggcagacatcagcagcacgttgcggtccgtgcccgcgccacgaccctcgcccatcagcaccgcttccacttccagcaccccacgcagtcgaccccgcatctagagagagacttctttgttgttcccccgcgtgtttttcccattccctgtatttatttttaaataataaaaacagagacgttgataataaccgcggtgtgctttattagggtatcatgatgtagaaaaaaaagagagggaagccctaaatatagcgtctctcttactcgagcttattgagcgcagccacaaaaatccgccgattcagatccaccatgtctttgggcgggctctgggaagctgcggcggcttgggcagcagcggcggctaacacgacactagccgggcaggaagaagaacccgccgtcgaaggccctgccgttgccgcctcagaacccgacgcggtagcgaggcggcaactggcgttcaccacgccggcctgagcgcgctcagctaccttggcacctcctgatagaagtgccgtcggtgtttctcctccgccgctcgtcagctcgccggtgggagtacacacggtagtagtagtcggggaggaagaggccgcagcagggagagccgccgaaagtaacgtagaactctgccgcgcggcaaacagatcgcgtttcagctcgtgaatggcatcccgcagttcatcgtaacgttgttgctgctgctgattggaacccgcgtgcccgccacttccaccgtcgctgttgacgtgactttttagacgctttcgcgcccggccgtgctcggcctcgccggggaaactcaagtcttcgtccgaggacgacgacgacgccgccgcggcttccttacggcgtttgttgtgtccgccgctgcccccgtgacggtgctgcttctgcgactgaccacggtgaccaccgtcgtaacgctcccatccggacggtggttcatccataccgcccggagagtcgcgccgacggtaataggccggtgatggtggcggcggcacgggataagacggatgcaaaggcggcgcgggctcgtaacgccgaccccacccgggataatggggatccacgtagtccgcaaagtgacgtgccgccaactggtcgtaacccacgacgggggcgccgtaggacgcgggataagacggcaaaggcagcggtgctggcgaagcagaaggaggggccgctacggcgccgggatacatgacgggcgctgccgagcgactggccccaagtagcgagaaaaaagcgtctttgggtaaataaactccgtcgtgaggccacgctaaagacggcacagccggcgacgcacctgccacggtagcacctggaggagccgtagcggcggtaaccgcagcactcagagggtgcgacatggacgccgcctctgccggctccaaaggagaaagcgacggcggtgattccgtggggagaacggacggcgacgctggaagcgcaggcggctggacaggagatggcggttcgactggaggcgacggggatgaagagggaacgcgcgccccagccgccggcgtggcggcctgactgcggctgtcgcccgaacgctcggcggacgccgctttaatatcgcacgccgcctcaggcgaaacgctcgccttgacgtacgactcgcgctccgtcacgccgactagttgcttgtcgtagcgcagcttgggcagtcgctcacggatgtagagcgcgtccacgctgttgcccaacaggccgtagctgtctgagcgaaagggatcgcccgacgcgtcgacagcagtgctgccgcagcgctgccactgtgcacgtagcccgtcgcggtcggccgccgtgaggtctggaaaccgctgggtaacccactcgggatcgcgcccgtacacggccaacgtaccgcgacgccgacccacgctgcacaaagccacgtgtttgaacggcgtggtttccgagcccgaaagcgacgtcgcggcctccacgtcgtcgcagcgccggctggagagcgagaggccggcgtagctgccgctgagaaactccaccaccttgtccggctgcagcggactgacgggcccacgcgaaacaagctcggacttttccgaagcgcggcgcacaatctccagaaacctgggcgaagtgacgcagcctaggcaaaaaagaccgtcgcgaacgctctgcatcgccgcaacgtgtcctacaacggccgtgtcgtcgtgattgatgttgagcgggagcgcgaccgacaacgaaggctgtccctggccctgcgcgtgcaaccagtgctccactacgtcccgcggcaacagcaattcggcctcgtccggagactggtcgtaacgggcgagaaagccgcccacgtagaccggcgctacagcctgcggctgctgttcgtccatcgtcattgtcgtcaccgtcgctacccgctcaccgagcgaacgatgatggcccgcgacgaagagaaccccgccgtcccgcgggtccgcacgggcaaattctcctttacttgcgccaatcatctaatattacagattagcgagaagatgtcgcgcggacagccgctgaactcgctgcgtttggaagaactcaaaatcgtacgcctcatctgcgtcctcctctttcaccgcggtctcgaaacgctgctactgcgcgaaaccatgaacaacctgggtgtctcggaccacgccgtgcttagccgcaagacgccgcaaccctactggcctcatctgtaccgcgaactgcgccaggccttcccgggactggactttgaggcggctgtgttcgatgaaacgcgcgccgcccgtctcagccagcgcctgtgtcacccgcgcttgagcggcggactgctgacgcgctttgtgcagcgccacaccggcctgccggtcgttttccccgaagacctggcgcgcaacggcaacatcctcttctccctaggcacgctctacggacaccgcttgtttcgtctggcggccttcttcacgcgccactggggtgccgaagcgtacgaacccttgattcgcatcatctgtcaaaaaatgtggtacttttatctcatcggcaccggcaagatgcgcattacccccgacgccttcgagatccagcggagtcgacacgagacgggcatttttacctttattatggaagattacagaacgttcgccggcacgctgtcccggcacccgcaccgtccacacccacaacagcagcagcaccaccaccccggtcccccccatcctcctctttctcaccctgcctcgtcctgtctcagcccagaggccgtactggccgcccgcgcccttcatatgccgacgctggctagcgacgtgtgaacctaacgtgatttatctgccacttttctccccgctgccgtacagcgccgccgctcataatgccgtcaccgtcgcgtccgacgcgacggtgttttcgccgtcggtgcagaggacggaggaactttcggccgaaacatcgatcgtagtcccaggacacatttcggaagccataccttccgcgtgctccaccaacgtggctttctccgacgtggttgtcgttaccacaacggccgccgatgtcgcgtcggcgtaacaacggctggaggactttttcaccgcttcggcgacgtctcggacggacgtagaaaagtaacacacggccagctccacgctatacatagcccgcttcaacgcctgcaccaaccgacgtacgaaatgaccgtggcagctttgctgacatctctcgaccagataatcaaaggagtcatccagatccttggtgggctcgcgggaaaagaacgcaatgataaagagcggcagaatgccaagacgcatggtgagaagggtacgcgtagccaattccacgtaatccataatgccgaaacctgtgccggccgcgctagcgggctgcagtacaccgcgtaggactctgaagcagtagtagggcacaaaaagcatgagacacgtcacgtagaaggtgcagacacgacccacgtaggaccagacgtggtcgcgccgatcgctgtaggccaactctaccacgttagccagtacggcgatcatgggcgcccccagcaaaaaccacatcttgatggtgaggtccaccgcggcatactgtatagggatctgacagcctagccaacggtagtccagtgaacccgtagcggcggtgggcacagcggctacgatggaaagaacccaggcaaaggcgaccgcgtagagcgccacgccggcgttttcgcgcgtctcatgatgccagagatcacggccataagagatggccgacagacgatccagtatcagaaagaggaaaaacaacgccgtcgaatataggcccacgtcgtcgacaaagagcactaagcgacagaggctgagatttagagcgccacgcagcatgatacccttggacaacatggtagccacgatggaaaaaaactgactaagtaccaggttccaagtaaaaatcatcacggacacgggcggccgcgtaacacgcaacacccagaggcaaccgatgatggtcagcaggttgactaggctaacggagccgaacatgccgatgagcaggtccgaagcggcgcgatcggccgacatagagtagccttcgaacgggcccatgtatttgaaattcacgatagcgagcatgatggaatcggtgactgaggtagtcttctccgcagaaggggacatacccaccaccgccgcccgctctctccgaacgaatataccctctccggggacgctcgccctttatgcagcaagcgacacgtggtggaaattacaacaccgccacgctcggaagaaaacccaacactaaaaagtacaacagttcgtaaatatcgttgacgttaaagagggacgagcccagagtggacacacgatgacgcggcagggtcactgacaacagccgccctagcccgtgttcgtagtgaaagagcagggcgtcgtgtacttccaagcgacgtaaatcgccgtactgtttggagctctgcgcgaacatgtagtcggccacgggattgctcttgctgagctgcatgagcacggcgccgccgccgtcgccacctccggcgctgtcctcgcgacgtgagggatcccagccgctgcgcacgctctcggtcacggccaacagagccaggccgggaaagagctgcgacagcgtgaccgcggggtcgcgcgcgtaccacggcccgatgtagtactgcaccagaaactcaaagttacgtacccgcccgtgccgtcccccatagccctcctcttcgccgcccgcgcgccccccgggcaatccaccgccggccacagcgtccgaacccagcaggtcggccaacgtgaatttgcccgtacgcggagcgaagacgctatccgcgttggtcaccttccacaacagcaacaggccagccaggcaggtcaagcccgaacgcagatattgctgttcgtgcacaaagacgggcacgtcacgacccagcttgccgaccagcagacgtcggctccagagagaaagcacatcgtctcgcacctggcccgacagacgctcctgcaccagctcctctgttatcgtcccgtagcccggcaaatgctggaggacgccgcgtttgtggaaaagccgcaccagcacgtgacgatcaaaagtgcccgggtgatagtggcgaccaccacttaggggcatgtagtaacgtagatcgggcgagtcgcgatacgcgtaatagttgttacccgcggcgacagggccttcccaagcggcaatctcacgacttacgtcatcggccagacgcggcaacagctgagggagctcacccaacaccgtcgccacggagtccggcggatcgcggccctcccaaagcgcgtgtccgtaggcggccagcagacaagcggcggcttccaaatcggatagtacgcagtcgtacgtcggatacaccgtcacgttttccaaagcgttgaccacgccgagcagcagctcctgcgaaatggaaaagttgtccatctgcgccagatggtacactcgtttccaccgtggttgcgtgtacaacccccgcttgagccgatagtaccagataccaaaggagaaagtccaagtggaggcgttctcgaacatggtgttgaccacctcgccgcgaaaatcggtgtgaaagcggataaagggatcgttctgcgtgattccaaagtagctaggtacgttcccgggcaacggccgctcggcgcactgcgccagccaggtagaagaagcaccagcggccgctgacgcggcgaccgcgtcagacgaggcggcggcgggtcccgtgatggcatcgtgccgactataaagaccgtgtgggacggcgaaagctcctgccacgccggtccctggggacgacgaacgcggacgacacggtggttgtagcagcgtccgcggcgacggtccttcgtcgagctcgcactgctggttcaacagcgcctccgcctcggacacgcgcccttcgagatcctcgcagtaagtctgcaccctgtgacccagatccctcatctcctgacgcagataccgtttgcgcacccggtccatgagcacgtcctcgcgccagcccccgccgcgcattgccaccgccgcgtcctccagcaaccgccgaagcacgcgctcggggcagcgcagcacgttttcctcgtgcggctcgaagaagacggcgacgggtagccgccaaaaggtgtgcaacagactcatcctgacgcctccctagatagtccaggacagaatcggtacacaggttaaaacggcctgagcggaaagcccgataaaaggatgggcgatcggccttttgctgaaaaaaaaccagactaggcaccacgctccagacttgaccgccaccgcgtggcagacgcagaaaatcaaagtccaccagtgcgcccttgagctggcgcaggccctcggcgtactgcaggctgtgggtggcgtgccaccgcacggactgatcgtcggcgtctgagtacgtggttttgaactcaatcacgtagcaatacacgatgccgcgcgacccagagtccggcggtaaaaacaccaacacgcaatcgggaatccgccgacttaatcgtacttcgatgaaaagacggcgacggtacttttgcaactcgggtgggaaaaggcctcccaacaggcggttgagcgccacaaacgagggaaagacccgcagcaggcgacggtagatgtccaggtgcttgcgcttaccgatccgcttacgcacgtgaggcaatctccgcagagcgttccccgtcaaatcagcgtcgtccccacgcccggacggcatggcttattcgcgtgtcccctcttctcccttcgcagcggccaatgacatcgtattaaatagacggagacgcgacttttgtaacccgtagcgccgcacccgggtgctccttcctgggatccttttttttccttctctcgggtgtaacgccaaccaccacctggatcacgccgctgaacccagcggcgcggccgcgctatgcggccaggcctcccctcctacctcatcgtcctcgccgtctgtctcctcagccacctactttcgtcacgatatggcgcagaagccgtatccgaaccgctggacaaagcgtttcacctactgctcaacacctacgggagacccatccgcttcctgcgtgaaaacaccacccagtgtacctacaacagcagcctccgtaacagcacggtcgtcagggaaaacgccatcagttttaactttttccaaagctataatcaatactatgtattccatatgcctcgatgtctttttgcgggtcctctggcggagcagtttctgaaccaagtagatctgaccgaaaccctggaaagataccaacagagacttaacacttacgcgctggtatccaaagacctggccagctaccgatcttttccgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggatttctttgtagttacggtgtccatagacgacgacacacccatgctgcttatcttcggccatcttccacgcgtactcttcaaagcgccctatcaacgcgacaactttatactacgacaaactgaaaaacacgagctcctggtgctagttaagaaagatcaacttaaccgtcactcttatctcaaagacccggactttcttgacgccgcacttgacttcaactacctagatctcagcgcactactacgtaacagctttcaccgttacgccgtggatgtactcaagagcggtcgatgtcagatgctggaccgccgcacagtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccagtgggcactacgacagatcgccgactttgccctaaaactacacaaaacgcacctggcctcttttctttcagccttcgcgcgccaagaactctacctcatgggcagcctcgtccactccatgctggtacatacgacggagagacgcgaaatcttcatcgtagaaacgggcctctgttcattggccgagctatcgcactttacgcagttgctagctcatccgcaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgtctaccgctcggcgaatccttctccgcgctgaccgtctccgaacacgtcagttatgtcgtaacaaaccagtacctgatcaaaggtatctcttaccctgtctccaccaccgtcgtaggccagagcctcatcatcacccagacggacagtcaaactaaatgcgaactgacgcgcaacatgcataccacacacagcatcacagcggcgctcaacatttccctagaaaactgcgccttttgccaaagcgccctgctagaatacgacgacacgcaaggcgtcatcaatatcatgtacatgcacgactcggacgacgtccttttcgccctggatccctacaacgaagtggtggtctcatctccgcgaactcactacctcatgcttttgaaaaacggtacggtcctagaagtaactgatgtcgtcgtggacgccaccgacagtcgtctcctcatgatgtccgtctacgcgctatcggccatcatcggcatctatctgctctaccgcatgctcaagacatgctgaccataggacctgacagtttacgagaaaagggacagagaggtcaaagacattcacacaaaaccctctaaaacggtacgggccccaatacctaggggcactcttgctcattgtaataaagtacacgccacacggtgtgatggtactatatgcgtgaagtctgtgcgtctttatttacgatgtattgttgtgggtctggttacatatcgggccctggatacaagctcggtacacagccaaggtgcgggagactaggtcgtcttggaagccgatgcaacagcggtagatgagcagcaaaacgaccagaatcagcagtgagtacacgcaggcaagccaaaccacaaggcagacggacggtgtagagtctcctcctctgtcatgtggggaaaaggagagatgagaggtgttaacttattgtttcttatatggctaactttcctgttgttctttttcataaactgtaagggtgcgcgatcacaacgagcaccatttcgtcctaggatatggcaccccacggtattaaaaaaactaaagcaattaaaattagaaattttaagacaactagaacctattccttacataaagtacccacaaatcaatacgactcgagttcaaagtcttactgttaatatgaccgagtttccttattattatattttagcaggtcctattcgcaacgaaagtgtaactcatttgtggtatgatttctatagcacacagcttaggaaaccagccaaatatgtatactctatgtataatcacacggcccgaaaaataacgttcaaacccccgtcgtgtggcgcagtgccttccatgacttgtctttctgaaatgctaaacgtttccaagcgtaatgataccggcgaagaaggctgcggtaactttaccacgttcaatcctatgtttttcaatgtaccgcgttggaacaccaaattgtacgtgggtccgactaaagttaacgtagatagtcaaacgatttattttttaggtttaaccgccctgcttctacgttacgcgcaacgcaactgcacacacagtttctacctggttaacgccatgagccggaatttatttcgcgtccccaagtatattaacggcaccaagttgaaaaacactatgcgaaaactaaaacgtaaacaagcgcccgtcaaagaacaattagaaaaaaagaccaagaaatctcagagtactactacgccatatttgtcctatacaacgtctaccgctctcaacgtcaccactaacgtgacttatagtgttaccaccaccgcaaagcgggttttcacatctacgattgcttatcgtcccgatagcagctttatgaagtccattatggccacgcagttaagggatctagcgacatgggtgtatactactctgcgctatcgagatgaacctttttgtaaaccaaaccgtaacctgaccgccgtgtcagagtttatgaagaacacgcacgtattgatccgtaacgaaacaccgtacactatttatggtactcttgacatgagttccttatattgtaacgaaaccatgtccgtggataacgcgacggctttcgatagtaacaaaacgacacccacaccgttaccggggtttcagagaacgtttatagatcccctgtgggactatctagactcgctgctgttcctagataaaatccgtaactttagcctccagttacccgggtatggaaatcttaccccgccggaacaccgccgagctgtaaatctgtccacccttaatagcctttggtggtggttgcagtaaagttctggaagcagcaatgtcgtagtacgatacaaaaagctcccatcagaatgagagcattgagcatagtccaccaggctgcaaagctggacagtgagagttcatacatatgcgatgtgcaatgtgcattgtaaaaatcatcgtgatcatgtcgtttcatcacattagggttgtgagtggtagaacccggtttagtactcgttaatgtggttgtggtcgtcgtaggtgttgtggaggttgttacgctggtagtcgattttaccgttgatacactagaactaggaggactcggtgtacttgcagaggttgacgtagatgagctgttaccataactccctgccgccaccgataaaaccaaaaaacttagtactcgtgttttccactccatcacaccaccgccacgatgcttacgatgttgaccgatcgaatcgactctcaactggtactgtcgcggctgccgcgctcccgttttcagcgattctgggagacccctacgttaataatgaaggaagagtccgcaccgtcatcaggctccatcatcctagccgagaaatccgtcaacatgcgttactgcgtacgtttcgctagcgatagcgattttcaaaccacatttacgctgccccaatcgaccgaggagaaatacgacaaagagcagcatccgggagaagatgaagcgtcgtcgccattaccgtcgccgctcaaagttccctacaagtggatgccttccagtttcatcgtcaaacaatgccacacgcagctggccttttacaataaacacatcatttggctatcacgcgagcgcaaagtgcccacctcgctgggcgtcagcctctatatccccgaaggttttttcggcattaccttttacaaatgcctggacgcgcaattcgtttgcatgcccgagctgctggaatccgggctgcaagtcccgcagttggatgttgtcaacctcaacgacacttttcagtccatctttccaggcaccatcgaaggcgatatcggcgttttcccctgttttgtgccagaaccttggcagctcatgaacttgccgccgcccaacgaacaccgtttcttttcattacgtacccgtcagacgctggtgatcggtccgggtcacacgcaaaccgtctattttgacgcggcctacgtgcacgcgcccggtatctgcgcccttatagtgggcgtgcgccagtttagtcagtcggatctcatcatccgacccactatctggctcccgggtaccgcggccggcgtgacggtggtcaacacttcgcacaccaccgtctgcatctccccacacaccaccgtagccaaagcggtttttaccacccaccgctttacctatctaccggtgggcagtcaccccctaggacagatgatcgtgccgcccacccccgacatcggtttcacccacacgcccgagcacgcgttgctgcaacggacaccctcgccggtagacgatgacgtcgacgagacagaagaagatgaaaagagctccgacgcagaaagccctgtcaacacgagtgacgttatttttgacgtcggcccgaaacctccccgtcatccctgacctaataaagtacgtctatgagaaaccccgtactcgtcgtgtccgtgatcacgtacgttttccaaaacgtgccaggctgttcacgcggaggacagcaaggccgccgccgtgggtttctttttcttcacgcccctgagttcacgcgcggaacccacaaagggtatctggggaggaggtatggtgaccatggtcggtgacatcaccgcctcccgaggcacgtcggggctgtgtcgcatgagatccaaaatctcgcgttcgtgattcgtaggcagcgtctcctgcggcgccgactccttgtagcgccgacggtgagacccgcgtccctggggctgctgctgcacgggctcgaccggcggctgctgttgcacgggctcgggtgacggcgacatcacggtcacttcatcctcctcgtcgccctcttccagcagccgctggtcgaacctcataacggtgggacaggagacggtgttaatgtgagccaaactcatcataggacgcgtgacccccgtttcctcggggatcagcgagtccgaaaccgagggacaggcaaaggccgacacggcggcgaccgtttccccgtcctcgcggacgccgctttccccctgaacgaccgccggtggcgtcggtggtgcaaccgtcgcagccacgccggcctcgagcatgtacgcgcttttctcgcagtccatgtccaccaggcccataacgcgctgcacctccaccagcgaggcctgatccgtggagaacttgtccagcaacatctccaggctgtcggcctcggacatggcaaactcgcccaccaccagtttgaggatgagaatgtccagggcctctaggatacgctgcgatttcttgcactccacctcggccgccggccgcgtgtgaggcaaacagccctccgagagatagcccttgagaaacgcgcacttgctctggcattgcctatagagcggcagcagcttcagcaggtggttcaccacgtccgtgtcgcgagaaaaggttcgtaggtcggccggggtgatctccagctgcttaaagttctcgtccagaaacgcctgcagctcgcgcagctccacgtcctcgctaggctgcagcagcacgtaatcggccacaggcgcagctttgcgacggcacatcagcagctcgcacaggcgctgggccagctgcatcgtgccggcgcgacgatgacgctcgttctgttcgcaacagagtatgattctgctcatatagtcgccaacgtactctcgcagacaccgacggaccactgcgtcttccccctgctggtcaaacaccaggtctcgcgacgtgtttatttctgcctacagacgcaaaagtgctcggactcgcgacgggtggcgcccgtcttcgccgtgaacaacgaaacgctgcagctctcgcgctacctggccgcgcgccagcccatccccctctcggcgctcatcgccagtctggacgaggccgagacgcaaccgctctaccggcatctcttccgcacgcccgtgctctcgcccgaacacggcggcgaggtgcgcgaattcaagcacctggtgtactttcaccacgcggccgtgctacgtcatctcaaccaggtcttcctctgccccacctcgccctcgtggttcatcagcgtcttcgggcacaccgagggccaggtgctgctgaccatggcctactacctattcgagggccagtacagcaccatctccaccgtggaggagtacgtgcgcagcttctgcacgcgcgacctgggcaccatcatccccacgcacgcctccatgggcgagttcgcgcgtctgctactgggctcgcccttccgtcagcgcgtgtccgctttcgtggcgtacgccgtggcgcgcaaccgccgcgactacaccgagctagagcaggtggacacgcagatcaacgcgttccgcgaacgtgcgcgtctgcccgacacggtctgcgtgcactacgtctacctggcctaccgcacggcgctggcacgcgcgcggttgctcgagtaccggcgcgtggtggcttacgacgctgacgcggcgcccgaagcgcagtgcacgcgcgaaccgggttttctgggccgccggctttccaccgagctgctggacgtcatgcaaaaatacttctcgctcgacaactttctacacgactacgtggagacgcacctactgcgtctcgacgaatccccccactcggcgaccagcccgcacggtctgggactggccggctatggcggccgcatcgacggcacgcacctggcgggcttcttcggcacctccacgcagctggcgcgccagctcgaacgcatcaacacgctttccgagtctgtcttctcgccgctggaacgctccctgtccggcttgttacgtctatgcgcctcgctgcgcacagcccagacctacaccaccggcacgctaacgcgttactcgcaacgtcgctacctgctacccgagcccgcgctggcaccgctgctggagcgaccgctgcccgtctaccgcgtacacctgcccaatgaccagcacgtcttctgcgccgtggcctccgaaacctggcatcgcagcctctttccgcgcgacctgctccgtcacgtacccgacagccgtttctcggacgaggccctgaccgagaccgtgtggctacacgacgacgacgtggccagcaccagccccgagacacagttctactacacgcgacacgaagtcttcaacgaacgtctgcccgtcttcaattttgtggccgactttgatttacggctgcgcgacggcgtctccggtctggcgcgacacaccgtctttgagttatgtcgcggactacgacgcgtttggatgaccgtatgggcgagcctctttggctacacgcaccccgaccggcacccggtctatttcttcaaaagcgcgtgcccacccaacagcgtgcccgtggacgcggccggcgcgcctttcgatgacgacgactatctcgattaccgggacgagcgcgacacagaggaagacgaagacgggaaagagaataaaaataacgttccggataacggcgtttttcaaaaaacaacgtcctccgttgacacgtcacccccttactgccgctgcaagggcaaactggggctgcgcatcatcacgccgttccccgcctgcaccgtcgccgtacatcccagcgttttacgcgccgtggcgcaggtgctcaatcacgccgtctgtctcgacgccgaactgcacacgctgctggaccccatctcgcatcccgagagcagcctagacacaggcatctaccaccatggacgctctgtacgtctgccctacatgtataaaatggaccaagacgacggctatttcatgcatcgccgtctgttgccactgttcatcgtgcccgacgcctaccgcgaacacccgctaggctttgtgcgcgcccaattggatctgcgtaacctgcttcaccaccacccgccgcacgacctgcccgcgttgcccctgtcgccaccgccacgcgtcattctcagcgtacgcgacaaaatctgcccctcgaccgaagccaactttatcgagacgcgctcgcttaacgtgacgcgttatcgacgccgcggtctcaccgaggtgctcgcctatcacctgtacggtggcgacggcgccactgccgctgcgatttccgacacggacttgcagcggctcgtcgtcacccgcgtgtggccgccgttgctcgagcacctcacgcaacactacgaaccgcacgtcagcgagcagtttactgcgccccacgtcctcctctttcagccccacggcgcctgctgcgtggccgtcaagcggcgcgacggggcgcgcacgcgggattttcgctgtctcaactacacgcaccgcaacccgcaagagaccgtgcaagtgttcatcgacctgcgcaccgagcacagctacgcgctctgggccagcctctggagccgctgtttcaccaaaaagtgtcactccaacgccaaaaacgtccacatttccatcaaaatcagaccgcccgacgcgcccgtgccgccggcgaccgccgtctgagcctcactttccacggcgccggtgacccgccccccggcagcggtctcatctatatatacatcagcgtgcccgaacgtgaccttcctagcgacggcggccatggagctgcactcacgcggccgtcacgacgctccgtcgttatcttccctgagcgagcgcgaacgccgcgcccgtcgcgcacggcgcttctgtctggattacgaacccgtgccacggaagttccgacgcgagcgaagtccaacctcgccgtcgacacggaacggagcagccgccagcgaataccatctcgcggaagatgccgtcggcgccgcctcgcatcatcaccgaccctgcgtccccgcacgacgaccccgctacagcaaagacgatgataccgaaggcgatccggaccactatcctcctccccttccaccctcctcccgccacgcactcgggggcaccggcggacacatcatcatgggcaccgcgggcttccgtggcggacatagggcgtcctcctctttcaaacgacgcgtggccgcgtccgcctcggtgccccttaaccctcactacggtaagtcttacgacaacgatgacggcgaaccgcaccatcacggcggcgattcgacgcatcttcgtcgccgagttcccagttgccctacgactttcggttcttctcacccctcctcagccaataatcatcacggatcgtccgccggaccgcaacaacaacagatgctggcgcttattgacgacgaactggacgccatggacgaggacgaactacagcaactcagccgtttgatcgaaaagaaaaaaagagcgcgtctgcagcgcggcgccgcctcgtcgggtacctcaccgagttctacctcgcccgtctacgaccttcagcgctacacggccgagagtctacgtctggcaccctaccccgccgatctcaaggtccccaccgccttcccgcaagatcatcagccgcgcggtcgcatcctgctgtcacacgacgagctcatgcacaccgactacctgttgcacatccgtcaacagttcgattggctggaggaaccgttgctgcgcaagctggtggtggaaaagatcttcgccgtatacaacgctcccaacttgcacacgttgctggccatcatcgacgaaacgctcagctacatgaagtaccaccacctgcacgggctacccgtcaacccgcacgatccctatctggagacggtgggcggcatgcgtcagctgcttttcaacaaactcaacaacctggacctgggctgcatcctggaccaccaggacggctggggcgaccattgcagcacgctcaaacggctagtcaagaagcccggtcaaatgagcgcctggctacgcgacgacgtctgcgatctgcagaagcgtccgcccgagaccttctcgcaacccatgcaccgcgccatggcctacgtgtgctccttctcgcgcgtggccgtctcgctacgccgtcgcgcgttgcaagtcaccggtacgccccaattttttgaccagttcgatactaacaacgccatgggtacctaccgctgcggcgctgtctcggacctgatcctaggcgccctgcagtgccacgagtgtcagaacgagatgtgcgaactgcgcatccaacgcgcgttggcaccctatcgtttcatgatagcgtactgtcccttcgacgagcagtcgctattggatctcaccgtctttgccggtacgacaacgacaaccgccagcaaccacgccactgccggcggacaacagcggggaggagaccaaattcatcccaccgatgagcaatgcgcaagtatggaaagcaggacggacccagcaacgctgacagcctacgataaaaaggacagagaagggagtcatcgacatccctctccaatgatcgccgccgccgctcctcccgcccagccaccgtcgcaaccacagcagcactactctgagggcgagctggaagaggacgaagacagtgacgacgctagcagtcaagatctggtacgagccacggatcgacacggggacaccgtcgtctacaagacgaccgcggtccctcccagtcccccggcgcccctcgccggtgtccggagtcaccgtggtgagcttaacttgatgacgccgtcgccttctcacggcggcagtccaccccaggttccccacaagcagcccatcatcccggtgcagtccgccaacggtaatcacagtacgacggcaacccaacagcagcagccgccgccgccaccaccggtaccgcaagaagacgactcggtggtaatgcgctgccagacgcccgattacgaggacatgctgtgttacagcgatgatatggatgactaaaaagagagtgaagggtgttgtgcgtgatgattgctgtcccttatcccgttacaaagaaaagaaaaaatggtgttacacactccttggtactactatgacccgtggtgagatatccgatgatgataatgatgtacgcgtgcctgagcttggtgtttttttctctctgtgagcttttttccccataagctgtgtactgttcgtgtccggaccccatacacggtttccgttaatgacggccccctccttttcccccaccgtaaaaaaaaaaacaaagcacaatacacatgtggttttttggttcgaatcgagcttggcgtttatttcttctcgagccccacgtcctctccctcccattctttttatatatacacatgcccaagattgggggggaacgtgtgtcgtttccaggtcgtggtgacgatgatgatgtggtttttatcggggtggtagtacaagggtttgctactgtagtcgaaaaggtgggccgagaacatagaggaactaactcctaagcgatggctcaaaggcggatgagcaaatcattaaaatccttgactgtctatggttatgcaaaaggatatataaagtataaatagcgtatataaaaacatatatctatgtacaagacgcatgggataaataacacgtatttacacatttttctgcacatgtacaacatttgaggacgaggagacgacgaccggccggtcgccgccgccgcggttgctactactttcttaagtgatgcgaattggtggctatggtgaggagtttggaggaaataatatacatcatatattctgatgacagtgtagtaaacatttcactggcttcggcccggtgcgacggagggccccgacgtcccctctcccggaggggggaagaggcacgacgagcgagggccccgtcgtacgaggaacaagaatcttcttcattctttcacagtaaagcacatttctttatgtggggacgggaatcgatgtcatttgtgtatttgcattcggtagagagctacagtctccagtttcacgatcgttgtgcatcatacaacgacactttttatcctacaaatttcacacctatctatatacacacaatataaggttatagcatcatctagtttgttcatttcatacctgttgagaacgtttatgttctagcaattgatttcgcgtcatagggctgtgacggtgattcttcagagaatcaggaaaaaaaaaaagaggctcaacgagcaccagagactaagtcggaaaactcgcgcccgcttccccggacggtttcggcttagcctctggcctgcgatggtttttttattccaagttcgttccatgaatagagcgttatacgattgtgttttcgtgtcattcagacgtggttgatcatgttactacgtgtgtgttttttgctttggtcggtacacggtccctttcagcggacccagtgttccttggagagacgaaaagcgagcgtgtttcacgagatggctgatgccgagtgtcgtcgacataagtcattttctaaagaagcaacataaaaaaaagatgatgtggttcgtcgtactcacagtctcgtttagctactatagatattatagatccagagagcgtaccgcccgagagaacaccgtcttctccgggacgtcttgccgtcgtccgtcacccgggcgtcgagatgttcgtagagaacgatggaggacgaccaacaccgacaggtggtgctcatgagggtgtggtgtcgatggtgcgtttttttgcctcggcacgaccgtatttgcccgtcttaccgcacctccggaaagatggtgtttttacgcaggtgggtgaggcagtttttttttttcagatgacaacgatggtaccgatagagcctgagatgatgatggctacgaaggacgggcggacgggcaaacgatggtgagaggtcgccaccgaggggtgcctttttttttctggtcagatggaacgtcgtcggtctcgagcgccccccgatgtagggccgctctcttacgtatcccgggtcgattcagaccgacaaaaagagcgtccagagacgcggtctctttcttctcgaacggaaagtccgaatcctacacatttctagtcgtgacggctagttttttggtggtcatggcggtggtggtcaacatatatctccagatataggagatgaggaaaaaaaaggaggacaagtctaacggaataatatccgatcatatatatggagggatatcaggtcatcattgtgtatcaaaagatgatttgtacaacagggaaggatacggttttaaaggttagtgcagagaaactatataaagagcgtataacatggagttcattctgtcattaaaaaggttctaagtagagcatattaaaaatagacgagagctagagttttattcttggttcatcatatattttgtaaaaaaaaaatatagaaaaatataggtgccggacgccggctacgtcccagtccggggcttcgcgcacccaaacgcaggtttcccccgttttcaaacacctcaagatcttttgagaaacacatatttttgttatacacagtgaaaacgtggggggacagagttccaaacacgtgtctatcaagcaaaaattcagacgatataaatatggagagttttttcttcttatacaacagcgacagttcggtgtacatagcgtataatatatatataggtcacatacagacttatgagctttttaccaaacagatgcaaatcgcctaccggaggcgggatcgggcgtgaggttctggctgcacccgcccgatccctcgtcggcttctccggcggctgtcctaaaatgactaggttcgtatatagagctataggtctttcatgatactgatgagaaatctatggtttgcgcgtcttatctgaatatatctagcacgatatagacgatacacgtcaagatcattgtatcacttcttttcgtctacgtggtaagagtcttggatactaaatatgtatataggcagcatttatagtttcaaaggatagaagatagtttttggacactgatagatatggcgttgttgagcggttgtgttggatgaacttgtcatcattctgtattttttcacataaggtgttcttttcttcgagcagtttataaaaggggtcaggcgcgatgactagagggcgcactttgggtgcggtcctccatcgcttgtcaacaaccggatgtgactcagcgagcacgagatggtttgacgtcagcgaccgttagccctcagggcgaaaacaggaagagtcgcctcgacggcgccctctaggtagcatcacggaacaggcggcgaccgcggactcgcctcggccaggggggtaccgaggcggtgcccgcgactcgcccctcctccaagatggcgccgctcggccagactcgtcgagattttcagggctatcattttttcgctctgagcagaaaaaaagctcttcaaaaacgtctcaaaaaagcacagaaaagttatcgtgctatttttttacccgcctggagcgaaaacgctcctcggctctcgacaccattttctctcgtccgccatgtcggagctcagaacggcatgacgagcgagagaaccgtcgagaaggtcaccaagatggcgccggttggggtgcagtcaaacggtgttttacagtttcggggccacttgaacagagaaaggtggggaattttgagggacacggttttgtcgggtgggggagaaaatcacgccctgccgtcgtattgccgtctcgaattttttcggccgtctgcacccgtatcggttcacgggttttccacggcaaatcggagaagggaaaaaaggtggggcctgttcccttcccgggtctcggacgagtcgacacgccgggtgggacggtcgtggtctcctcggcccgtgccgggaccctccccgtggattcacggtgttccggacccctccaggaaagggtggaaaacgcgtggagcccacggggacgtgcgttcgtaccggggaaaaacccgactgggcctgaaccaacgtcgggtgaactgccgggcccatcgtgtggggacggtgattgtggaggggcgtactgacggcaattgaggtgtcatggcggcccaccgtcgaccccgagcgcttccggccacacccaacctcgccgccgcatcggccagcacacacgccacagcctggtggggtccgaggcgccgaccccggctgggcggccgatggggggaggggagtggggagaccacgcccagggccagcaaaccgcgacggttcgggcggagtttttggggagcagcgggggaggggagcgtcacgggaccggccaacgcccagggtaaggcggaccgagagccggcggctaggccgagggacccccgaccacaaccggcgaccggaccctcgagaggggggaggggagcccaaccggagccgccgagagggagccgccgcgagacccggaagccgtcgcggtcgaccccgctcccggagctcctgaccgggcccccagcccccaaccctccggggccgactgccgtcgagccggggcgtcgcccgtccccaccaccgtccgcccggcccacctaccgtcgtcggccggccgccgcgacccccagccggaaaaaaagcccggaggggcccaaaagccagcggggcgagccgggaaggggagctgggtgggggatccccggtcgcccaccgcggaacgagcctaggaaccggggtccgcgacccagccccccgtggggggaggggaagggcgcggaccccgggtcccgtccgttccgcggcgggtggaccgggaagccggcggaggtcgccgggagcagcgagggatcccgggccggagcccggggaggagcggggtgggggtgggaagcccccgctcgggtccccccgggccgcggacgggaaccgggaccccggtgcgggggtcccagcccggccgggccgtcggatggggggtcgagcggggggaggggagggacccccggccgaggtccggagcgggccgcgcccggtgcccggcccacggccccggatggtgctccagggcggtgggacgggcccgcggacggaccggcgccgggcctcggccggggagggtggggggtagggcgggaggcaggcgggagcgggcgcagcgtgcggaccgcagcacggccggaaccctgccgcggactgcgccggggggcggcgggcacgccgggttttataggttttcagaggccccgcctaggtgggcggagcggtaattttccaccgccgcggcccatgcccggcacggggctcgcgctccctaggtgcggccgcccagtggaaaaataccggcgcatgcgcacgacgcgcatccaatggaaatttaccgacgcatgcgcactgaccgcctccagtggaaaaatactggcgcatgcgcacgacacacacccagtggaattttaccggcgcatgcgcaggacgaccctcccgcgggccaggacccgcgcatgcgcaccggggcccctggttcaccccactttatatataagctctccatacggcatccccggcgcatgcgcactcgagtccccatcccataatccgcgtggtaacgccctggtaaccgaaaattcgccccgactgcgcatgcgcacggaaacgccgtcccattggaaatcatggttgcccaaatttggtaaaaatttgccccccccggttccggaggagaagggggggggtgaggggggggggttacggtggttcccgttccgccagtccgttttcgtagaacgtttcgttagaagaattatgctatatagggtatgcatcctaggggtggaagctaggctccgcccctacggggcgtcgcctagcatccggtatacgtaaaacggactgatgacgtagctcgcttcgctcgctacgtcatcagagatgatttccgccggaggtgacgcacgcatacgtgacgtagctcgctacgctcgctacgtcaccgtatgtccggaattccacaggatgacgtatatccggagtgggtgtggctacgcgagtgtgacgtaggcttgtcaggggtcacgtgagaagcggcggcgttaagtttactaggccaaaacagaggaagggggcggataccctaggtaagggggcgtgcacgtagccctgtagacactcccccctagggtccagtagcttatgacgcgtatccgggagtagcgtctacgtcagcaggtgtatatttccggtagacggagaagcctgtacgtacaccgaggacggtggaaccctaacgggttccacctatctgaaatttccgtacaaggggtggagtctagggaggggtcattgtatatccgtttctgtgattggtagataaggtggcgtacctaggggtgtggctgtatacgtaagcggatatggctacacgtaatgggtgtggcttcactagggatcgctgtattctaccgcgcgcgtgcgcgcgtgcgtgcgcacacgcgtgacgtaacaaatcaccttgtgattatgacgttggtatctggcaccgcctcttgggcggttctacgggcctcgcttcctgcgctgatggtcacgtgaccaggaaaagtgctcaccgcctcgccggccacggggttgatgcctgttcttatgccgacaccagatggcgctcgttgaccaggaaagctgtctacgcgggttttacagtgtgtttttgcgtcattgtgacgtagagccggcgatcgccacattcgatggtgtacgctcgccgccagatgtcgtcagattgtacccaaaaccccgttatgagtacacgctggcttccgcattcttgggcacggcggtttcaggttacattacatcaagacgcgacaacgccccgaataaaaacaccgggcaccgttatgtatacacgacgtcgatactgatcgccgtagtgacgtcagtcgacacacaacaccgttccccatcacggtgtttcatggcaatgggcgaaagttactttttacaagacgaaaaatgtgttttttggtaaaaagagggggatgggaaaataaaaatacacaattttaaagttcggatcttttcctgttttattgactcgtaaactgtaaggtcttcgagtacgtgtcgggggtctgtgccgcgtacgtgttcgggaaaccacgttacgtggtttgtgtcgtgttgtgacgttgggataatacacaggtttggcgcccgtaggcgcgcgggtttttggggtgtgtagcttgtacggcgttttgtcggcggagcgcagcgaaaatcggtggtgatagcggcgattgaggttgcgagaccagattcatcgcgcttgtaccaccgtggtgcggtgtttctgcttgtaaaccgtcaggcggttctttgtgatttaaaaacaccgtgttcgtgaaacgtgacttttcacggtttgttagctgatgtgattttggaggtcacaaacaccgtacggtgttttcggggatcgggcttgggatttgcctgtgtataccggtgacggtaggacagaaaacaccgttttctagggacggtgttttcacgtgccctgtgtggggtttttatgtgctgcttgtgcgactgagtgggaaaacggattgtgatcggacggtgtgctgaggataaacgacgtgctcgactaccgacgttagttggcggtgacgcaaagccgtcccgaacatcacgctattttcgcgggcgggtgcgtcggctagcggtctggctgcgagaggctacccgaccgtagcggttagcttttcttacgaattgctgggatcgttgcggttgtcgcctttggtggtccgcaaccgcagccagaccgcagtggtggccacggtggtgtctcagacgtcgtgcgtcaaacatgacgtgctgaacttttccttggtataaaattcactcagtggcggcgtagccattgtcttccgttcatccaccatgagccacgaggaactaaccgcgctagcgccggtggggcccgcggcttttctctacttcagcaggttgaacgcagaaacgcaggagattctggccactctctcgttatgcgaccgttcctcgagcgtggtgatcgctcctctgttggcggggctcacggtggaggcggatttcggcgtctctgtgcgtacgcctgtgctttgttacgacggcggggtgctcacgaaagtcacgtccttctgtccttttgcgctctactttcatcatacgcaaggcatcgtggcttttaccgaggatcacggagacgtgcatcggctgtgcgaggacgcccgccagaagtacgcgttggaggcctacacgcccgaggcggatcgcgtgcctaccgatctggcggcgttgtgcgcggcggtgggctgtcaggcgtccgagacgactgtgcacgtggtggtgggcaacggcttgaaggagtttctctttgccggtcagctgattccatgcgtggaggaggcgaccacggtgcgactgcacggcggcgaggcggtgcgcgtgccgttgtacccgcctacgctctttaattcgctgcagcttgacgccgaagccgacgaggtctcgctggatgcgcgcagcgcttttgtggaggcgcgagggctctacgtgccggccgtaagcgagacgcttttctactacgtgtacacgtcatggtgtcaatcgctgcgcttctcggagccgcgtgtgctgatcgaggcggcgttgcggcagtttgtgcacgacagtcagcagtcggtgaagctggcgccacataagcgctacttggggtacatgagccagcgactcagcagtctggaaaaggatcatctgatgctgagtgacgcggtggtttgcgagttggccttcagttttgcctcggtatttttcgattcggcctaccaacctgccgagtctatgctcttttccgagtggcctttagtgaccaacgcaaccgatcaccgcgatctgatccgcgcgctgaccgagctcaagttgcatctctcgacgcacgtggccgccttggtcttcagcgctaattcggtgctctaccagcacaggctggtgtatctccagtcgtcggcgcggcatcccagcgccggcggtacggccagtcaggagacgttgctcaaggctattcagttcaccaacgggttgtcggcggcctgcgaagacgtctacaacgacgcgcgcaaggtgctcaagtttcaaggcgcgccgctcaaggacgaacgctatgggccgcagcatttggcgttggtgtgtggcacgtgtccgcagctagtttcgggcttcgtctggtatctaaatcgtgtctcggtgtataacacgggcttgtcgggttcgtcgacgctcacgaatcacctggtgggctgcgccgcggggttgtgcgaggcctgtgggggtacttgttgccacacgtgttatcagacggccttcgtgcgggtgcgcacccgcttgcccgtggtgcccaagcagcccaagaaggagccctgcgtgatcaccgtgcagtcgcgttttctcaacgacgtggatattttgggcagcttcggtcggcgttacaacgtcgacgccaaggacgggggtttggacggcaaaggtgacgacggggttccgggcggcggtgctggcgggggtggtggacgagacgtgagcgggggcccgagcgacggtctgggcggcggtcgtggtggtgggggtggcggggattccgggggaatgatggggcgcggcggtcgcatgctgggcgctagcgtggaccgtacctatcggctcaatcgcatcttggattactgccgcaagatgcggctcatcgaccccgtgacgggcgaggatacctttagcgcgcacggcaaaagcgactttgtggccgtcttttcggcgctcaacaagtttgtggacgacgaggccctgggtttcgtttcggaggtgcgcctcaagagcagccgcgacgaggtggcgggcgccacgcaggccttcaacctggatctgaatccctacgccgtggccttccagccgctgctggcctacgcctatttcagatccgtcttttacgtgatccagaacgtggcgcttattaccgctacctcgtacattgtggacaatccgttgaccaccaacttggtatccaaatggatgacgcagcattttcaatccattcacggcgcgttctccaccacgtcgtcgcgcaagggctttctcttcaccaagcagatcaagtcgtccaagaattcggatcacgaccgcctgctggactttaggctgtacgcgcagggcacgtacgccgtggtgcccatggagatcaagctctcgcggctgtcggtacccacgttgatcatggtgcgggtgaaaaaccgacccatctaccgcgcgggcaagggcaacgcgggtagcgtgttttttcgccgcgatcacgttccgcgtcgtaatccggctaagggctgcttgggatttctgctgtatcgacatcacgagcgactctttcctgaatgtggtctcccctgcttacagttttggcagaaggtctgttccaacgcgttgcccaagaatgtgcccataggtgacatgggcgagttcaatgctttcgtcaaatttctggtggctgtgacggctgactatcaggagcacgatctgctggatgtggcgccagactgtgtgctgagttacgtggaaagccgtttccataacaaattcctctgctactacggcttcaaagactacatcggctcgctgcacgggttaacgacgcgcttaacgacgcagaaccacgcgcagtttcctcacgtgttaggtgctagtccgcgtttctcgtcgcccgccgaatttgcgttacatgtcaagggcttgaagaccgcaggcgtgccggcgcccatggccgccactgtggcgcgtgaatcgttggtacggagcgtttttgagcatcgttccttggtgaccgtgcccgtgagcgtggaaaaatatgcgggtatcaacaacagtaaggagatctatcagtttgggcagatcggctacttttcgggcaacggtgtggagcgcagccttaacgtgagctctatgagcggccaagattatcgtttcatgcgccagcgctacctcttggctacgcgtctggccgacgtgctcatcaaacgctcgcgccgcgagaacgtgctttttgacgcggatcttataaaaaaccgcgtcatgctggcgctggacgccgagaacttggattgcgaccccgaagtaatggccgtgtacgagattctgagcgtgcgcgaggagatccccgcgtccgacgatgtgctcttcttcgtggatggctgcgaggcgctggccgcgtcgctgatggacaagtttgccgcgttgcaggagcagggcgtggaggacttttcgctggagaacttgcgacgcgtgctggacgccgacgcccagcgattgacggacgccgctgggggggaggtgcacgacctgtcggcgctcttcgcgcccagtggcgtcggcgcggcgtccggcgtcgggggtggcggtcttcttctcggcgagtccgtcacgggcaactccatttgcttcggcgtgcccggcgagacgggaggtggctgctttctcgtgaacgccggcgaagacgaggctggcggcgtcggcgggagcagcgggggcggcgggggcagcgggttattgccggccaaacgcagccggttgtaaccgccagcagacgccgcgacaacggccgccgcagccacgagcatcgcaacaacagcagcaacagtcgcagcccccgtggccgcttttcagaccgcaacaacagcagcaacaacagcagccaccgacacagcagcaccaggcgacaccgtatcagctaccgccgcaacagcggcgacagacggcgtcgcatcatcagcagcagcaacagccccgaaggttggcgccgcggcaccagagacagagaccgccgccgcgctggcaagctccgacattcgcgtcggcgcccgggccgcctgaggaaggggaggagtgtcagacacagccggtcatctccgagcccccgtcgcccgaggcggaggagccggcggcggcggtggtggaggaggttgcgccgcaggcggcggcaacagcgtcgggagcagaacccgcgtcgtcgacgacgtcgttatatattaacgtcaacgtcagtcggcatagcgagcggcccgcgagttatttgtgcaccgactccatgtctctggccggcgccagaccggacgacagcgtctcgtacgtgagcgagtcgagtcatggagatgaatttgttacagaaactatgcgtagtgtgttcgaaatgcaacgaatacgccatggagctggagtgtctaaagtactgcgatccgaacgtgttactggcggagtccacgccgttcaagagaaacgcggcggctatagtgtatctgtaccggaagatctacccggaggtggtggcgcagaatcgtacgcagagttcgctgctgacgctctatctggagatgctgctgaaggcgctgcacgaggatacggctttgctggatcgggcgctgatggcctactcgcgccagccggaccgggcggccttctaccgtaccgtcctccgtttggatcgctgcgatcgccatcacaccgtggaactccagtttacggacaacgtccgtttcagcgtcagtctggccacactcaacgacatcgagcgcttcctgtgcaaaatgaactacgtgtacgggatcctggcgccggaggccggcctggaggtctgcgcgcagctgctggagctcctccgtcgcctatgcggcatctcgccggtggcgcgtcaggaagtgtacgtcgaagggacgacatgcgcccaatgctacgaggagctgaccatcatcccgaatcagggccgctcgctgaacaagcggctgcagggcttgctgtgcaaccatatagcggtccaccgtccgtcaagccagtccgatgtgaatatccagacggtggagcaggacctgctggacctgacaacgcgcatcccccacttggctggagtcctttcggccctcaaaagcctattctcttcttcatcggcctaccacagctacatccaggaggcggaggaggcgctgagggagtacaacctgtttacggatataccggaacgaatatattccttgtcggattttacctactggtcccgtacctcggaggttatcgtcaagcgggtgggcatcaccatccagcagctaaatgtgtatcaccagctgtgccgggcgctcatgaacggcatcagtcgccatctgtacggggaggacgtggaggacatcttcgtgctcggggaaaaggcgttggacggggaggagcgcatgttcgtggggtcggtctttgccgcccccaacaggatcatcgacctcatcacatccctcagcattcaagctttcgaggacaacccggtgttcaacaagctccacgaaagcaacgagatgtacaccaaaatcaagcatattctcgaggagattcgacgtccgctgcccgatggcacggggggcgacggccccgagggcgaggctattcacctgcgtggacgggaggcgatgtcggggacgggtacgactttgatgacggccagcaacagcagcaacagcagtactcacagtcagaggaataacggtggcggcggccgggcccgtggaggaggcaagaaagcggtagggggaggggcgaatgggcaggacggcgacggcagcgagaacggcttacgggtgcgcaactgcgacgaacacgaggctctcgacttggtggacgcgcgttcccgcatccacaacgtcacccgcgaggtgaacgtgcgcaaacgcgcctacctgcagaaggtctcggaggtgggctatggcaaggtgatccgttgcatcaaaacgcaggagcgtctgactagcaagctcatcgatgtcaacctagtggggcccttgtgtctggactttatctctaagctcatgaatgggtttctgtaccgcagccaataccaccaggaccaagacgtggtggacgtgggggatcagttcacctacgatgagcacctgtatgtggtcaataacctgatccacaagagtctgcctgtggaatccctcccgctactgggtcagcagatctacgagttgtgtaacgggcccctcttcacccactgcaccgatcgttatcccctctctcacaatgtggacatggcctatgcctgcgacaacgcgggcgtactaccccacgtcaaggacgatttggtcaaatgcgcggaaggtaccgtgtatcccagtgagtggatggtggtgaagtatatgggttttttcaatttttcggactgtcaggacctaaacgtgctgcagaaggagatgtggatgcacgtgcgggagctcgtgctctccgtcgcactatataatgaaactttcgggaaacaactctcgatcgcgtgcctgcgcgacgaactgcacccggacagagatgtgattctcacgtataacaaagagtggccgctgctgcttcgtcacgaaggaagtctttataagtccaaagatctatatctcctcctctacaggcatctgtccagaccggatgagagtggcgacgtgccaacagctcccgtggccaagccctccaccctgacggccgccgcggccgtctcgggtgtcttcagggagccggaccgaccttggctgccaagtccgtatccctcctcctcgactgcgggtgtttcccggagggtccgcgcgacacgcaagagaccacgacgcgcctcatcgctgctggatttggcccgcgacgaacatggaatccaggatctggtgcctggtagtctgcgttaacctgtgtatcgtctgtctgggtgctgcggtttcctcttctagtacttcccacgcaacttcttctactcacaatggaagccatacttctcgtacgacgtctgctcaaacccggtcagtctattctcaacacgtaacgtcttctgaagccgtcagtcatagagccaacgagactatctacaacactaccctcaagtacggagatgtggtgggagtcaacactaccaagtacccctatcgcgtgtgttctatggcccagggtacggatcttattcgctttgaacgtaatatcatctgcacctcgatgaagcctatcaatgaagacttggatgagggcatcatggtggtctacaagcgcaacatcgtggcgcacacctttaaggtacgggtctaccaaaaggttttgacgtttcgtcgtagctacgcttacatctacaccacttatctgctgggcagcaatacggaatacgtggcgcctcctatgtgggagattcatcacatcaacaagtttgctcaatgctacagttcctacagccgcgttataggaggcacggttttcgtggcatatcatagggacagttatgaaaacaaaaccatgcaattaattcccgacgattattccaacacccacagtacccgttacgtgacggtcaaggatcagtggcacagccgcggcagcacctggctctatcgtgagacctgtaatctgaactgtatgctgaccatcactactgcgcgctccaagtatccttatcatttttttgcaacttccacgggtgatgtggttgacatttctcctttctacaacggaaccaatcgcaatgccagctactttggagaaaacgccgacaagtttttcattttcccgaactacaccatcgtttccgactttggaagacccaacgctgcgccagaaacccataggttggtggcttttctcgaacgtgccgactcggtgatctcttgggatatacaggacgagaagaatgtcacctgccagctcaccttctgggaagcctcggaacgtactatccgttccgaagccgaagactcgtaccacttttcttctgccaaaatgactgcaacttttctgtctaagaaacaagaagtgaacatgtccgactccgcgctggactgcgtacgtgatgaggctataaataagttacagcagattttcaatacttcatacaatcaaacatatgaaaaatacggaaacgtgtccgtcttcgaaaccagcggcggtctggtggtgttctggcaaggcatcaagcaaaaatctttggtggaattggaacgtttggccaatcgatccagtctgaatatcactcataggaccagaagaagtacgagtgacaataatacaactcatttgtccagcatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggaatcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcgggtaaagtacgtggaggacaaggtagtcgacccgctaccgccctacctcaagggtctggacgacctcatgagcggcctgggcgccgcgggaaaggccgttggcgtagccattggggccgtgggtggcgcggtggcctccgtggtcgaaggcgttgccaccttcctcaaaaaccccttcggagccttcaccatcatcctcgtggccatagccgtagtcattatcacttatttgatctatactcgacagcggcgtctgtgcacgcagccgctgcagaacctctttccctatctggtgtccgccgacgggaccaccgtgacgtcgggcagcaccaaagacacgtcgttacaggctccgccttcctacgaggaaagtgtttataattctggtcgcaaaggaccgggaccaccgtcgtctgatgcatccacggcggctccgccttacaccaacgagcaggcttaccagatgcttctggccctggcccgtctggacgcagagcagcgagcgcagcagaacggtacagattctttggacggacagactggcacgcaggacaagggacagaagcctaacctgctagaccggctgcgacatcgcaaaaacggctacagacacttgaaagactccgacgaagaagagaacgtctgaaccaggagaaaaaaaaaactagacaaaaaatattgacacagagacttgtgatatacggggttaaactggatatctaggtgctgcatgtgtattttctttgtgattttgcttcgtaagctgtcagcctctcacggtccgctatgtttttcaacccgtatctgagcggcggcgtgaccggcggtgcggtcgcgggtggccggcgtcagcgttcgcagcccggctccgcgcagggctcgggcaagcggccgccacagaaacagtttttgcagatcgtgccgcgaggtgtcatgttcgacggtcagacggggttgatcaagcataagacgggacggctgcctctcatgttctatcgagagattaaacatttgttgagtcatgacatggtttggccgtgtccttggcgcgagaccctggtgggtcgcgtggtgggacctattcgttttcacacctacgatcagacggacgccgtgctcttcttcgactcgcccgaaaacgtgtcgccgcgctatcgtcagcatctggtgccttcggggaacgtgttgcgtttcttcggggccacagaacacggctacagtatctgcgtcaacgttttcgggcagcgcagctacttttactgtgagtacagcgacaccgataggctgcgtgaggtcattgccagcgtgggcgaactagtgcccgaaccgcggacgccatacgccgtgtctgtcacgccggccaccaagacctccatctatgggtacgggacgcgacccgtgcccgatttgcagtgtgtgtctatcagcaactggaccatggccagaaaaatcggcgagtatctgctggagcagggttttcccgtgtacgaagtccgtgtggatccgctgacgcgtttggtcatcgatcggcggatcaccacgttcggctggtgctccgtgaatcgttacgactggcggcagcagggtcgcgcgtcgacttgtgatatcgaggtcgactgcgatgtctctgacctggtggccgtgcccgacgacagctcgtggccgcgctatcgatgcctgtccttcgatatcgagtgcatgagcggcgagggtggttttccctgcgccgagaagtccgatgacattgtcattcagatctcgtgcgtgtgctacgagacggggggaaacaccgccgtggatcaggggatcccaaacgggaacgatggtcggggctgcacttcggagggtgtgatctttgggcactcgggtcttcatctctttacgatcggcacctgcgggcaggtgggcccagacgtggacgtctacgagttcccttccgaatacgagctgctgctgggctttatgcttttctttcaacggtacgcgccggcctttgtgaccggttacaacatcaactcttttgacttgaagtacatcctcacgcgtctcgagtacctgtataaggtggactcgcagcgcttctgcaagttgcctacggcgcagggcggccgtttctttttacacagccccgccgtgggttttaagcggcagtacgccgccgcttttccctcggcttctcacaacaatccggccagcacggccgccaccaaggtgtatattgcgggttcggtggttatcgacatgtaccctgtatgcatggccaagactaactcgcccaactataagctcaacactatggccgagctttacctgcggcaacgcaaggatgacctgtcttacaaggacatcccgcgttgtttcgtggctaatgccgagggccgcgcccaggtaggccgttactgtctgcaggacgccgtattggtgcgcgatctgttcaacaccattaattttcactacgaggccggggccatcgcgcggctggctaaaattccgttgcggcgtgtcatctttgacggacagcagatccgtatctacacctcgctgctggacgagtgcgcctgccgcgattttatcctgcccaaccactacagcaaaggtacgacggtgcccgaaacgaatagcgttgctgtgtcacctaacgctgctatcatctctaccgccgccgtgcccggcgacgcgggttctgtggcggctatgtttcagatgtcgccgcccttgcaatctgcgccgtccagtcaggacggcgtttcacccggctccggtagtaacagtagtagcagcgtcggcgttttcagcgtcggctccggcagtagtggcggcgtcggcgtttccaacgacaatcacggcgccggcggtaccgcggcggtttcgtaccagggcgccacggtgtttgagcccgaggtgggttactacaacgaccccgtggccgtgttcgactttgccagcctctacccttccatcatcatggctcacaacctctgctactccaccctgctggtgccgggtggcgagtaccccgtggaccctgccgacgtatacagcgtcacgctagagaacggcgtgacacaccgctttgtgcgtgcttcggtgcgcgtctcggtgctttcggaactgctcaacaagtgggtttcgcagcggcgtgccgtgcgcgaatgcatgcgcgagtgtcaagaccctgtgcgccgtatgctgctcgacaaggaacagatggcgctcaaagtaacgtgcaacgctttctacggttttaccggcgtggtcaacggcatgatgccgtgtctgcccatcgccgccagcattacgcgcatcggtcgcgacatgctagagcgcacggcgcggttcatcaaagacaacttttcagagccgtgttttttgcacaatttttttaatcaggaagactatgtagtaggaacgcgggagggggattcggaggagagcagcacgttaccggaggggctcgaaacatcatcagggggcttggacgaacggcgggtggaggcgcgggtcatctacggggacacggacagcgtgtttgtccgctttcgtggcctgacgccgcaggctctggtggcgcgtgggcccagcctggcgcactacgtgacggcctgtctttttgtggagcccgtcaagctggagtttgaaaaggtcttcgtctctcttatgatgatctgcaagaaacgttacatcggcaaagtggagggcgcctcgggtctgagcatgaagggcgtggatctggtgcgcaagacggcctgcgagttcgtcaagggcgtcacgcgtgacgtcctctcgctgctctttgaggatcgcgaggtctcggaagcagccgtgcgcctgtcgcgcctctcactcgatgaagtcaagaaatacggcgtgccacgcggtttctggcgtatcttgcgccgcctggtgcaggcccgcgacgatctgtacctgcaccgtgtgcgtgtcgaggacctggtgctttcgtcggtactttctaaggacatctcgttgtaccgtcaatctaacctgccgcacattgccgtcattaagcgactggcggcccgttctgaggagctaccctcggtcggggatcgggtcttttacgtcctgacggcacccggtgtccggacggcgccgcagggttcctccgacaacggtgattctgtaaccgccggcgtggtttcccggtcggacgcgattgatggcacggacgacgacgctgacggcggcggggtagaggagagcaacaggagaggaggagagccggcaaagaagagggcgcggaaaccaccgtcggccgtgtgcaactacgaggtagccgaagatccgagctacgtgcgcgagcacggcgtgcccattcacgccgataagtactttgagcaggttctcaaggctgtaaccaacgtgctgtcgcccgtctttcccggcggcgaaaccgcgcgcaaggacaagtttttgcacatggtgctgccgcggcgcttgcacttggagccggcttttctgccgtacagtgtcaaggcgcacgaatgctgttgagaaacagcggcggcggtggtgactggggacggtgatgatgctgctgagactgagactggtggtgagagtagtggtggggctgcgtcgcctgcgacggcgggtggagatgaggcggcgtggactgggacgaggaggaggggccgcagccgttggtggaaactacgtgcaacggcgacgcggttaagggagaccgtatcgcgtaggacgacgtggcctcctcgtataggttgctgccgctggactgacacagctcctgaatgagctctttgtagcgctcaaaggactcgctcacgtcgttgggaatgtccatctcgtcaatcttgcgttgcaaaatagtcacgtcgatcttgacgctgctggccgagacggcgtgacacagcacgctgataacgacgtggtcgcgcacgatgttgagcgtgacgctgtagtcttcgcgcgccgccgtgagcatctgcgtgatgcagtcgcaggggatgtgcacgtcggggttttcgaagatgacgtgcatgtgcaaccggccgtcctcggcgtgcataaagggcacgatgtcgtggttggcggcgtgcagcaggtaataaatttggaagatgggcggctggttggtggagagcttgagtagctcgctgctcttacagaacccgtaataaaagtttctatttttcatgatgttggacgtctgattgatgaaggccaccatggcgtcggaggcggtgggcaggatgcggttgtcctcgcacgaggtgcaggcgatgcgcgagacctgctcgttgccgtacggcgagatgtcgaggcaggtgtgctgccggtgcgagtggaaattgaagggtaagcagatggactctttgcccgtgatggccatcttcatcatgttgaggtacttgagctccagttcggggtgctcgcggaagatgtcgtgcaggtcgtgcagcgtgaggcgcgggcgcgcgtcggccggcgacggcggttcgccgtggttgttggccgacgtagcgccgttcaccgtcgacgccactttgctggccagctcgcgttggcggcgcttgcggagcagggagcgcaaggccgagcgtcgttcgcgcggcgtgcgcacgccgctcacgctagacatacttgtctatcacgtacgtggggtccaccagcttgatgtcgcaactctccaacagctgcgtgaaatcgcgcataaagtccgccaggtgcactttgcctttgtaggtgcgttttgtaatctgaaaggccttgaagagtgtgatgcagagccacacacgtcgcggaagtcgacttatatagtaattgtcgtgacagatggccagtttcacctcctggacgtggtgggggtgcaggcgtccgaagagcacggcctcgttggtgacgcggatgttgccggcgcactgcgggtcgcagaaaaagtgcttgtagatgcccgtgacgcctgcctgacgcaggacgtggcaaaataccgggtcgggtcgcgccagtgcgccgtcgacgccgctcaggccgtggtagtccgagtcgcctccgggcgaggtgggtgcttcgagtccacagcgcgccacgtcctcgtgcgccgcgccgagcggcgacgtgcattcgcgcaacagatcggccaataccagctgaatgcggtccaccatcttcacattgttctgacaatacgagacgacgcggcggtacagctcgcgcaggacgacgttatcgtaataggagcaggccatgagttcgcacagcagacacacggtactggtttggttcttggtaaaaaaagcgggtacgggacataggtaaatgggacccacgtttttttttagcgtgctctcgctgaaccccccgctggtgacaccgccgttgtgacggcccggatcgtctcctcctttttctcctccttcttcatcctcctcttcttctatcatcatccttgcgtcttctctttccgaggccgtggataacgcgtctagtcgcgcgaacttagtgtgcgtgagttccgtgagtggcgtggtgctcatgacgccggtgccggcccacatatagaaaagcagctgcacgaagcggtcgcggctaggtgagctgtgttctagaaagttgtcgatcagttcttgcggcacttcgacgtgataagggttgtttttttgcttctgttgcgggtggcgccgaggcttgttgtaaggcaccgtgtcttcgcccatgaccatggcccgcaccacggccagatggttcagggtgacattctcgttatcaaccgcgtcgcccacttgtttttcaaagcaacgattgatgaaaaagtgcaggtggaaatcgaagaccgtgagaacgtggtgtcggaacaggtcgtcgatgcgcagatcggaaaagtgctgctgcagcagatgcgtaaactcggacatgatgatgagcgtgctgagcgccgcacggggcgcgtaactgcatttgaagcacagcaagctgtactcgaggagccagctctggtcgcagtcctgtttgaggcagatgctgatgatggcgcataggttacagcgcgtgtcgatggccagcggcgcgcacagtcgccgcagttgttcaaagtcggccgccgaggtttcgaggccggccagttctgcatctaggtcgcaggcggccgaagcgccggcgggtcctgcgttgctactgccggcgacggctccgccgcagctagtggtgttggtcgcattggtgagtacggtggattgcgttccgccgcacgtggtttcttccgcacagcagttgagcagttcgtctacctccgaggtgccgaggctgagcgtctggaattcgtagtgacggtaacggttagcggggtgttgaggattcacctggtatgaggcggccgccgcggcggccagcgcttcgtccataggtacttgacgcgggtgcgcgtgccatagcagctcagttgtcaagtccgagtgccactgggtgtactcggtgctccagccgctgtaacgcgaaacggcctgtcgttgcggactgcacaaggtagcggcggtgacggagctggtggacggggccgggctggtcgggggaagaaacgtggtgtggggcccgtgagggggagtcgttgggccgttactgctcacgtgggtactcggattcatggcgatcggcgccgctgattgaggacgcggaaaaagaatgtcctgggctaagcagcgggtgccgtttctggacgatgacgacggagaggaggaaaacgacgtgaaggatgacgtggattctccggtgccgacgcgaccgctggtgatcgacgaggacgcggagcccgcggctggtacgagcggtgggctcgaggggggaggtggtgacgacgaggacggtgaagacgggcacgcgctacccgatcttgacgacgatctgctattacagttcgagccgatgctgccgcgcgtctacgatctgttgctgccctctctggacgcgcgcttaaatttcgtgaacgcgggtcagaagtacgccgccttcctcaagtacgtgcacggcgactgcgcgacctgcagtcacggagagatcctccgtgagaagacgcaactattaacggcgatcgtcagcaagctcatggacattaacggaatcctggagggaaaagacgagccggcgccgggtaaataaatcggcggtggcgtcggtgcgatggagatgaacaaggttctccatcaggatctggtgcaggccacgcggcgtatcctcaagttgggtcccagcgagctgcgcgtcaccgacgccggccttatctgtaaaaatcccaattactcggtgtgcgacgccatgctcaagacagacacggtctattgtgtcgagtatctgctcagctactgggagagccgcacagaccacgtgccttgttttatctttaaaaacactggctgcgccgtctccctctgctgttttgtgcgagcgcccatcaagctcgtctcgccggcgcgccacgtaggtgagttcaatgtgcttaaggtgaacgagtcgctcatcgtcacgctcaaggacatcgaggagatcaagccctcggcctacggagtgctgacgaagtgcgtggtgcgcaaatccaattcggcgtcggtcttcaacatcgagctcatcgccttcggacccgaaaacgagggcgagtacgagaatctgctgcgcgagctgtacgccaagaaagccgcctcgacgtcgttggcggtccggaaccacgtcaccgtaagcagtcacagcggcagcggtccgtccctgtggcgcgcccgtatgtcggccgcgctcacgcgaacggcgggaaagcggtcctctcggaccgcatctccccctcctcctcctcctcgtcatccgagttgctctcccaccatggtcgccgctggcggcgccgctgccgggcctcggccgccgccgccacccatggcggcggggtcgtggcggctgtgtcgttgcgaggcctgtatgggacgatgcggatgcgcaagcgagggagacgctgatgaagaggaggaggagttgctggctctggcgggagaagggaaggcggcagcggcagcggcgggccaggacgtcggagggtccgcgcgtcggcctctggaggagcacgtgagtcgtcggcgaggggtgtcgacccatcaccgtcatccgccgtctccgccgtgcgcgccgtccttggagcggactggttatcgttgggcaccgtcatcgtggtggcgagcgcgctccgggccatcgcgaccgcagtctgggccgtggctgcccgcgcgctttgcgactctgggcccgctggtgctggctcttctgctggtgctggctctgctgtggcgcggtcatggccagtcgtcgtctccgacacgctccgcacaccgcgactgatgagttccaccaggctctgcgccgtctcttcgcgcccctctgcgttcacgaggaccatttccatgtgcagctggtgatcggccgcggtgcgctgcagccggaggaagcggcggtagaaacgtcgcagccaccggcgcagtttgcggcgcagacgtcggcggtcctccagcagcagctggtgcatcacgtgccacgttcttgcgtccttcatctcttcgtgacggataagcgctttctgaatcgcgagctgggcgaccgtctctaccaacgcttcctgcgcgaatggctggtgtgtcggcaagccgagcgggaggcggtgacggcgctctttcagcgtatggttatgaccaagccctactttgtgtttctcgcttacgtctacagcatggactgtctgcacaccgtggccgtccgcacgatggcctttctgcgtttcgaacgctacgacgccgactacctgctgcgccgtctgcggctctacccgcccgagcggctgcacgcgttgttggacggtgtcaccgcctcgctgctaggtgaccttcaccgtttccttttcggggtggaccttcggctgcccgtgcttcaccccaccagctcgccgtgcttagcactgctacgcgccaagcgtttcgacgcccgcgctgatttggccgtataccaccgtaaccagtggcgtcaccaacggcagccgcggtcgccgcagctgcggggcctcatcgcagccttgcgccggcacgccgggcaggtaccctgcggaaacccgctctacgtactggcccgacaagcggtgcagacgttttgcgacacgtgtccgcgatacctggtgccgttgcgggcactgggtctgcacgacgagacgcgcggaggaggctcgacggcggcagctgcggcggtaggacacgcgggcgccggacagcaggcgcgtcacgtagagcccaccaagatcgtcctctttgcactcagcgccgcgctgcgcggcggcctcatcggcagcgtcatcgacctgccgctctggtgtctgtgtcgactcaagtgcgagcgccatctggacgcgcgctcgctggtggccgtggtctgtcggcagtgcggacactgcctcaacctgggtaaggaaaagctacactgccagcaaaactttccgctcaactcgatgttctattatcgggaccgtcaagaaaagagcgtcatcttcaacacgcacgccgagctcgtgcactgctcgctctgcggcagtcagcgggtggtgcggcagcgcgtctacgagctcgtctccgagacgctctttggacagcgctgcgtacgcgtgggctggaaagccgtgctgggcctcaacgcggcttgtgccgtgtacgatcaccggctggctttcgacgtcattctgccctgcgcggcacgcacctgcgactccactgtggtggtacgcgacgtgacggtcccgcgtctcctgcgcctcacttcgcacgggcacggcctgctgtgcgcgcgctgtcagacgggcgagtaccgcgacagctgtttggaaagcgaggacggcgccccgctgtgtcggggctgcgcgctggttaaacagaccgcctgccacgtcggcggccacattgtgcagcaggcgcgcggcggtttagcagcggcttcctcttcgtcctccccccacggcctgccccatgtctaacaccgcgccgggacccacggtggccaacaagcgggacgaaaaacaccgtcacgtcgtcaacgtcgttttggagctgccgaccgagatatcagaggccacccacccggtgttggccaccatgctgagcaagtacacgcgcatgtccagcctgtttaatgacaagtgcgcctttaagctggacctgttgcgcatggtagccgtgtcgcgcacccggcgctgacagcccaaggggaaaaggaatagcaagaataaatcaccgtgaaagtgatacgttgttttgtaacataaaaaaacgataaaaatcctattgtttttattacccgctactgtcagtgtcggttacaaaagatagagaaaccgcatgtgttgaatagtgtcctgtacggattgcgccagttgtcgcaggtccaatcgcactagccgcagtatttctagagcactgaggacgttctgcgtgagcaccgtgataggcggcgaggcgaaactggtgctggcggcgccgggcgccacggccacaagttcatctcggcatagtggtgtttctcccaatcggttttcttgaaagacggacccgccaaaggcggtagagactaatgcagagtcggctgtccttgatgtatcgtcttgtacgtgatctatctgtccgtcgtcgtctgcggccgcggccgctcgatgacgatgtcggcgcggcggctgctgaactcgcgcgatgggtggcgggttttcacgcaggaactgaatattgactggcacgcggttgaaaggtaccggcggtgttggagcggcgccagacgcagcgacgttgtccgcggatgagttatcatcttggtcatacagcgggaaggtggggaaggcctcgtccaacaccagccgactgtggtcctgttcgaacgtggagggcggtcgcagcacgcgtacgacggtgtggtcctgtgcgttgtaaatgactaggggaataaactctaagcgggtggggaaacgcaggtaatcgcgtagccgtctgatttgggcttgtagccagcagtgctccagcggcgtttcggtccacgtgtcctggagcagttgactgagattgagatcccgggagcgttggatgcggaggaagtcgcggtctcgcgacgtgtattcgaggtggcgcgctactagtatacgttggcctttcagcaggtcggctacatgcacgccgagacacacgggtatgccgaaaagccaggagcccagcgcgtagtctagggcggtttctgtttgaataaaaacatctaaaagtcccggctccgtggtcgtgtttgtgtctgtggtggttgtgtcctgacgtcgcacgcggatcatctgaagcaccggctctccggtggggagctgcggttgcgtgtacccctcggtcaccatttcgcattgttgcgtgaaaatctgaaacaacgtctgtaccaattcggacaccgaggcgtaggtctcggcgtactggggtttcagttctagccacagacactgcagcatgtcttgtggaaagaccagcgtggccatggcgtagagccatagcttgcctaggggcggtgtgcttttttgcgggcctacctggcacagttgctgtaccagtttattttcccaaaacagtttattgagctgcatggcgggccattgggtgggggtgatacagaaagccttgacctgttcggggaggtggtcggggggcattttgtgtgtgttattgactaccgcgtgtattacatcctgatgtaggtgagctgtgagggagggtagcgacatctgcaccgggtacttgaggacggtgtagatgtactcggggtacagagctgctatgagtacacaaaactcttggagactcaggcgcagtacggtgccgcggcccggtctctgttcccctacgtcaccaccctcgccgcttcctacgcgatcggcggccgtcagctcctgctgcgtgtcgatgcgctggtgccaggcggtgctcaccagataacaaaagagcttaaggttatgcaacgtgtgagtctccgcggggtgcgtgtggctctgatgctgcgtgaggtagggtcgtaggtcgtactgcgagatctgcggccagaaagtgcgcaatgtctgacagacggccacggctaccgtgatggctttataacgtgtggtgacgacgttcttgagtcctccgccgctacagcggcgccgccatgccaggggccggccatcgtctcgcagcgccaagtacttaaaggctacgttgccgtaatcggtgaccaggtgaatgggttcgccggcctgcgtgacgatttgccgcatgccgaagacgtctaccacttcaaggaaggtgtcgtggtgacgcgcgaagcataggcgacgcaggcggtcgcgcattatcagcacgggatcggtctcgtgcgttggcggaagcacgctaggaatgtcttccagcctatagactagcgatgagccgttgagcttgttgagcagatactggtgacccagctggacgtgtcgttccagcgcgttcaacccgcgtgtaaaggcgcccagcgaagtcgtcgcctgcggtttccgggggttgggcagggctccctcgttggagagacgcgtaccgcgtcgcttggctagttccgcaaaacgagtccgcagatcgcggatcttttccaactgcgaccgaaagtccagcccgtagctgaaggtctggattccgtgtaacagcgcaaagtattccgtcgccaacgtttcctgcagttctaggtcgcctagcgtctgacccaagcgctgcaacagttcctgcactttttgatgacgcgcggcgccgccggctacgcgtccgggttccagtcgctgccagaccgcttccaccgcctggaccatgtcgacccgcggcgtggacgcgccgttggcagtcgcctcttgatgctgtgcaataaaattttcacaggccgcgttttgttcgatttgatgcgctagtgtcacggcgctctcgacggcttgctgttgcaggttccggtagtgggtcctgcttccgtgatgcgggtgcgtagggtccgcggtgatttgcgcaagggcttcctccagaaaagccagcatccagcgcaccgtgcgctccgccgacaggtacggcagttgttgcgtggctttgcccaacagctcgcgaagtgtctccagcggcttttccatcagcgccttggcgtcgggggtggtcacgtccagtccgccgctcattttgtggcgcgtgaccagatcagtccacaggttctgcgccgtgctcagctgctcgtcgcgttgtcgcaactgcgtctgtactttctgattcagcagatcggcctcgtcgctgagcgctttccgggccgcgtcggcctgctgatctagcagcgttttgaaaacgggccgctggaagtcggcgggcgggggcgtgatccgacccgccagctcctgacccttgaagggtttctcgggtacacgcgtgacggagctgctcccgggatcctggcgcagcgagcgatctagccgctcgctagtctcggtcatctgttgtctagtctcttgtaattgttcctccatcttctgttgactgctgcggtagcgtgcaaagtcgccctcgaactcgctgcccgtgatggctgtagttggatcgccctgttgacacttctcgatgaactgcgcttgatggacggcgtgttgcagggcctgctgcgtctcatggatcagaagttgcggacccaaaatttggtccaagtggtttagcgaggcttgggtttgcatagccgcttctcggtgcgggtgacagcgccgctctacatcacccgtcagcacgccgtgcagacactcgttgattcgcccgtctagttttttgctcagctgctgcagcgccgacagcaagtcctggttgaacttgtctagtagcggttgggcgcgttgatctaggcccaagagcagctcgagtgtggcctccagtggttggtgcgggatggtggagagcatctcgcccttaacggcgtccaccacgcgttgcaaatcctgctgcacctttttttggtagccgtccagtagctgccgttgctgttcttcctgtttacgtttctccttgtctaaaaagtcttgcatcttggtggttaacgtttgttgcatttgatgcatgacacgatggctcggtgcccgggccaagacacgctgcacgtcctccacagaagttaccgtgagcttgccggcctcttcttgccattcacgttccagccgttccaggtgctgttcttccatctcgtgttgatatcgctcgtagagttccgttacctgaggtccgacgcccagtcgtccgaccatatgttgaaagaaatattcatgattacggaaaaagtaaaccaactcccgtaacgcttggaagcgtttttcggatgcgccggtaccggctttctcgatctgctccagtttcttgaccatctgcgcgtacgtggcgttggcggcacgcagatcctcacgttcatgcgagtcgggtggcagttgctgcaacaacagactgacggcgtcaaaaaacgtcggtcgcggcgactcgtcgcgcgccagtcgcatcactaatgtgtggaacatgctcagtacggcgttgatgagtcgcagacgcgtctgttcgtcgcgacgtaacatctcgcgtaattgtgggtgtcgcttgatggtctgttcggtgggcggatcgtcgtacgagagtccgtcgaggaaacgctgcgtttcctcttcctcttcgtagaggcggcttagcgcgagttgcgcgttctgtaggcgctgctgcacttcgggtagctgcaggccgcctagcgcttccagctgagctagctgctcctgtaccaaggccagtgtcagcgccgagccgcggctgcccgggtcgcgcaccagcgtctcgatgacatgaagcaggtcgtgaatctgcgtgaggcgaccctcgttttgctgcgtggcttgctggtacgcgtgtcgcagctgcaggatctcttgcagtagcggtacgttgtcgcgcacagtgcccgtcatgaggtagctcagttgttcgcgtatgacgacaaatccctcttcgtagctgccgtcacacagtttcaggtcgcgcaggtcgtaaaagagtctcagtacctgctcgacgacgcgttccatctgcttcaggtcctctaccggcaaaaagccgttgaggatgtgattgtgcacgcgcgttagcagctgcgtgctcagacggtccaggtccatctgcaactctagcattttggcgttgcccaggcgaaagagttcctgcttggcgttgtcgtccaacggctgcagcgctttcagaatttcgcgtcggttcagatcgctggcgtctaggtcgtgaatgtcgatgctggtgatgaggccggccaagtgctcgtaaacgccgtggtactcctcgcgttgacgttgtaacacccgacgtcgctgttcgatgacctgcgtcagacgctgaaagtctacgggtcgcaggcagacgaagctgtcgctaacgggcatcggtcgcttggttacgaaacgttgcagtcgttgagacagttcgttagtgggcttgctttccacgtagcgtagcatctcctccacccaggcgatgagcgccgggccgtgctgacgtccgtagggatcgaagacgacttgcatcttctccagcagtgcgcgatccagcgtcgagtacgtgcctttggtggtcttgtggctcaggtagtcgtgcatgcgccgcagatccaggccgtggtgcagccagttgagcagaaaggcatccaatttcttggataggcccagataggcgcgtaccgcctgctgcgccgccgattgcggaccgcaggggcgacgcagacacgagcgctgattgacggcatggatgatgagctgctggagacgatcggtgaggaaagcttcgtcgaaggacggcgccgtggccgttgccgcgttagcgccgctttcggtacccgccgcgtgcaacgtccaggcgctggtgttggcaggcaacggcggcagcgtcagagccttcaactcctgctctacctcgtcgacgagctgttggtagcggcccagggccggcagggccccttcgccgcagctgtaggacggtggtaccgcggacgaagaagaggccgccgctatcgctgaggaggaggaggcggtggccagtgttttggacgtcgtggacgggggtttctttttgcctccgtgtttgctaccgctgaggtccttgcggcgtttctcgggtgtttttttgggtgaggacgagggatcgtagacgggaatgctgggcgccacgccaggagggcagcccgggtcgacgatggggtcgggcagcggaggtaaggaaggtgcggcggtggtcgttgtcgccgccgtgtccgcgctttctcgaacgacgccggtgaggtcgatatcgcggtcgcgataggtggagaccaaacgtgcggcgatctcagcctctggcacggtcgccacatccagcatgtagagaaaaagggcctcatagtagaaagcgggcgatagctgcacgccgaagcccgtgagcaccatcagcacctgatggagaccctcgcagtgatacacggcggcgttgtgacattccgcggagctgtgcggatcaaagaccaacatgtggtcctcggtgaagaccacggcgcgcgccaacgagttgacggtgacgagtacgtaggtgggacgcggtttggcgtgcgcgtaccgcagaaagtcgaagatgcccggacacatgtagccgtccaggtcgcacgtctcggtggtgccgttgaagggccgcgagagcgcgtgcacggtccggccgaaccgcgactccaggcggcgcggcacttcgtcgcccagtcggtagaccggcagccgcccgccggcgggcagcttcttttgcaactcgcgctctagccgcgcgtccagacgcgcgccctcttccatgatggcgtccagcgcctcggtctgcaggacggcgctcgttccacccaggtgcaaggcgtgtaggaacatgatgccgttgcagacgcattgattgcccgctcgcgctccaaagcgagcgatgtcgccctggtggcagctggcctgcgtgactttcatggcgaggccggcggcagggacaccgatgtcgagccggcgggcgggtcgatcgaagacaagatgtcctgctgcgcctggcttacggggacgatgtaccagtttaataggtcgctcgcggccaggtgtgcgggttcgtagcgcgcacccaggacctccggtacggacgtcgcgcctgccgtcgattcttcgtgatcggtgtcgggcgtcatgcggagtcgcggcggttggggcgccgattcccagggcgcctccaagaactcgcgtaaggcgcgatccgcttcggccgccgccgcaacgcccgtgcccgcgggccaggtcatcggcgctagcgcgcgatgtcggtgcagtaggctcgttgcttccgtcagacagagctgtgcgccgcggcgttccaagttctcgcgacttagtacgtcaaagacggctagcgcgcgttgcaccgcagtaacgacggcgccattggaacgttgcgcctgctcgagcgccaatgtcacgcgtgtttccaacactttgattttggaggccgtctttttgagcgccttgctcatctgggccaccgtgcggtgacccttggcgtgtcggcttacttcctctgtgtcgctgctgatctgacgtacgcgcacgcgaacactcagcaggcgctcgttcaagccgcgcagattctcggccaacagccgatcgcggcgaaccagctcgcgcaactgttctacgaaacgcgtggtaggtacgcgcagtccgtactgaccctgtacctccacgtacaccgtcacgccgtcctccgagaggcgcgcccggccacgcgccagaccgaaacagagtcgcgtgtgtcgcagatagtttctcagactgccggcgctgctgcgcatcacgtcctcgatcagcgggttgacggtggtgtacaggttatgcgctacggagcgcgccatgagctcggccagcaggtccacattgggcgtgacgggtacaccgctgaggtgctcgagggtcgtggcgatgtcgaagacgcaatcgcgtaccgtcttaaaaaccgcggcgtcgatgtgcttgacgaaggtggtcaggttgtagatggagaccaggttctggtacagcgtcacctgctcgggcaacaatacacggcacagctgaatgagtgcgaaaagacgcggcgaacccacggcttgaaacaggccctgcgggataccaaagatctccgagaactcagttaccaccaccaactgcgcgaagatgctggggaactcgggatgatggctgaaggctagcagggaggcgtagttgacgcggccttcgttcagattaacgagcgcgcattcgcgtaagatgtctgagcgtgtgacgccgtcgagcggaggcaaaggcgaggccgcgccggtcgcgccgcgggacggacgcaaggtaaacaagtgcacgccccacttgctgtgcaggtcccgatacaggtactcgcgctccgcctccgtggcacccttcgtatgtgcctcaaagtcttcttccgtgtactgaaccgcaaagtgcgtattgacgttcagcgtcacgttgctccagacgtgctgtagttcctccttggagccgatcaacgtggatcgatgctgctccaaaatcaaccgccgccggtggtcgaacaagaacgtggggctgtacacatagaggcacatgaaaaacgtgtaaaaattgtagacgatctgtatgagtttctcgcgaatctcgctgacaaagagcgagctcttctgactggccggctggatcagcgccatttgcgcgtaggctgcgcaggtatcgtgattgaaacccagttccactagtcgcgttaccatctgcgtcagatccagtagccgctgcacgcgtcgcggcgtatgcaagtggtcttccagcacgcgatcgcacacgcgcgcgtaagcgtctaggttagcgcgcggcgaaacttcctcgctcaacagacgcgagatcagacccgggtggaaaaacatacgttcgggcgacaggtaaaggtttacggtggagatacgcgtgctaatgatgggaaacatgaggccgctggcgtcacgcgcctgcagattacccacgaacagcttgtagctgacgtcacgcatgtgttcagcaccgggcttctggtcgccgtcaatatcggaactgacgaaagagctcatgtgccgcacgctgttcttgacgtagttttgaaactccacggccaaatcgccgttaaccgaacggtagtgtgtgtaaaaaaaatgcatcagaagcaccgtgtccagttcggtgtcggtgtcacgccgaaacaacacgtagggcatgagcgtgcaggcccagtagatgagccgctggtaggtcaggtccaggagttcggccacggcgcgacaattgacgtagggccgcgcctccgtggcagccgtttccagctgcgtgatcacccggcggaccagcggctgctggcccccggaactcgaaccgcccttcttgccgcggcgctcggtcgacgcgttgttactggcgatcaagtccgccgccgccgcggtgccgccgctctgttcggttattacggtctggatctcgcgcagggtctgcaacagcttctggaaagccgtcagcgtggccccgttgtggtagaacggcaaccggtcctcgtctccgccgccgtcgtgctggtgtcgcaggaagcggtccagctgttcgtgcaactgctcggcggcatacagcgggtcgcgcgccgtctgtaccgtggcgtggcttaggaggtaaaagaccacgttctgacgcacgaagccaaagtggtagcccgagctcggcaacgcacccacgaaggcgcgcacggcgctcgcggtcacgtcctgggcatccaccgcgccgatctccaattggctcacggtatttaacgcctccgctttgtccgtggcccgtgcccgcagctgctctatcaactttttgaaatctaccgtgcgcctcgccatcatggacgcgcgcgcggtggccaaacggccgcgcgacccggccgacgaggacaatgaactagtgacggcgctcaaagccaaacgcgaggtaaatactatatcggtgcgctacctctaccacgccgatcaccaggcgctcacggcgcgtttcttcgtgcccgagggcctggtagagttcgaggcgcagccgggcgcgctgctcattcgcatggagacgggttgcgactcgccgcgacacctctacatcagcctctacctgttaggcattcgcgcctccaacatctcggctagcacgcgctgcctgctcgaaagcgtgtacacggcctcggccgcgcgcgccgcgctgcagtggctggacctgggcccgcatctgctgcaccgccgcctcgagacgctgggctgcgtcaagaccgtctcgctgggcatcacctcgttgctcacttgcgtcatgcgcggctacctttacaacacgctcaaaacggaggtgttcgcgttgatgataccgaaagacatgtacctaacgtgggaagagacccggggacgactgcaatacgtgtatttaatcatcgtctatgactatgacgggcccgaaacacgtcccggcatctacgtgctcacctccagcatcgcacactggcagaccctggtcgacgttgcacgcggaaagttcgcccgcgagcgctgtagctttgtcaaccgtcgcatcacgcgcccgcgccagatccctctgtgtaccggggtcatacaaaagctgggctggtgcctggctgacgacattcacacctcgttcctggtacacaaagaactcaaactgtccgtcgtccgcttggacaactttagcgtcgaattgggagactttcgagaattcgtctgagcggcgctgacagcatacggggaggagacacagaagaaaaaaataaacacatcgcacacagactttataaaccgtagttatcggcgccatctagactcactttattgaaatctacctgatttctttgttcttttcctcgtaaacttatgaatccggctgacgcggacgaggaacagcgggtgtcctcggtgcccgcacatcggtgccggccaggtaggattccaagccgcggcgcggaaaccgagacggaggaatcgtcggcagaggccgccgctgatactaccgggggagatgacagcgagctcgaggaggggccgctgcccgggggtgacaaggaagcgtccgctggaaataccaacgtatcgagcggcgtagcgtgtgtagcgggttttacgagtggtggcggcgtcgtcagttggcgtcccgagtcgccgtctcccgacggcacgccgtctgtgctgtcgttgacgcgtgacggcggtcccgccgtgcccagtcgcggtggacgcgtgagtagcggtctgagcaccttcaatccggccggcgcgaccaggatggagctggacagtgtcgaggaggaggacgatttcggggcttcgctctgcaaagtgtcgccgccgatacaggctacgcgcatgttgatgggcaaaaagtgtcattgtcacggctattggggcaagtttcgcttttgcggcgtacaggagccggcgcgggagctgccgtccgacaggaacgcgctgtggcgcgagatggacaccgtgtcgcggcacagtgccggtttgggcagtttcaggctgtttcagcttatcatgcgccacggtccctgtctgattcgtcactcgccgcgttgcgatctgctgttgggtcgcttttatttcaaagccaactgggcgcgcgaaagccgcacgccactgtgttacgcttcggagctgtgcgatgagtcggtgcgccgttttgtgctgcgtcacatggaggatctacccaagctggccgaggagacggcgcgttttgtggaattggccggttgctggggtttgtacgcggccattttgtgtttggataaggtgtgtcgccaactgcacggacaggacgagagtccgggcggcgtgtttttgcgcatcgccgtggcgttgacggcggctatcgagaacagtaggcactcgcgcatctatcgtttccatctggatgcgcgtttcgagggcgaggtgttggaatcggtgttgaagcgctgtcgcgatgggcagctgtcgctgtccaccttcaccatgtctaccgtgggtttcgatcgcgtgccgcagtacgactttctgatctcggccgaccctttttcgcgtgacgccagttgggcggctatgtgcaaatggatgagcaccttgagttgcggcgtttctgtgtcggtgaacgtaacgcgacttaacgccgatgtgaacagcgtgattcgttgcctggggggatactgcgatttgatacgcgagaaagaggtgcatcgacccgtggtacgtgtgtttgtggacatgtgggacgtggccgctatccgcgtgatcaactttattctcaaagaaagcacgtcggagttgacgggggtttgctacgctttcaacgtgcctagcgtgttaatgaagcgctaccgtgcgcgtgagcagcgctactcgctgttcgggcggcctgtctcccggcggctctcggacctgggtcaggagtcggctttcgagaaagagtattcgcgctgcgagcaatcgtgccccaaggtggtcgtgaacacggacgattttctgaaaaagatgttgctgtgcgcgctcaagggccgtgcctcggtggtctttgtccatcacgtagtcaagtactcgattatggccgacagcgtgtgcctgccgccgtgcctgagtcccgatatggcgtcgtgccactttggcgagtgtgacatgccggtgcagcggctgacggtgaacgtggctcgctgcgtgtttgcgcgtagcgacgagcagaagctgcatctacccgacgtggttttggggaacacgcgacgttactttgatttgagcgtgctgcgcgagttggtgaccgaggcggtggtttggggtaacgcgcgcctggacgcgctaatgtcggcgtccgaatggtgggtagagagcgcgctggaaaaactgcgtccgctgcacatcggcgtggctggcttgcacacggcgctcatgcggttagggttcacgtactttgcctcttgggacttgatcgagcgcatctttgagcacatgtactttgccgcggtgcgcgctagcgtcgatttgtgcaagtcgggtttgccgcgctgcgagtggttcgaacgcaccatctatcaagagggcaaattcattttcgaattgtatcggttgccgcggctctctatcgccagcgcgcgctgggaagcgctgcgcgccgacatgctcgagttcggattgcgcaactgtcagtttctggcggtgggtcccgacgacgaggtggcgcatctgtggggcgtgacgccgtcagtatgggcttcgcgcggcaccgtgttcgaggaggagacggtgtggtcattgtgcccgcccaaccgtgagtgttacttccccaccgtggtgcggaggccgctgcgcgtgcccgtggtgaattacgcgtggttggagcagcaccaggaggagggcaaggcgacgcagtgtctgttccaggcggcgccggcgatccaaaacgacgtggaaatggcggccgtgaacctgagcgtgtttgtggaccagtgcgtggccttggttttctactatgactctgggatgacgcccgacgtgcttctggccaggatgctcaagtggtaccactggcgctttaaggtcggagtatataagtactgtgcctcttagtcgggggcccgctggctcggcgcggctgtattattagacgccgggcgtcttcgcagcgttcccggtcgtcgtgtgtgctctctataaaactttcgctcgctcgcgcccgctccttagtcgagacttgcacgctgtccgggatggatcgcaagacgcgcctctcggagccgccgacgctggcgctgcggctgaagccgtacaagacggctatccagcagctgcgatctgtgatccgtgcgctcaaggagaacaccacggttaccttcttgcccacgccgtcgcttatcttgcaaacggtacgcagtcactgcgtgtcaaaaatcacttttaacagctcatgcctctacatcactgacaagtcgtttcagcccaagaccattaacaattccacgccgctgctcggtaatttcatgtacctgacttccagcaaggacctgaccaagttctacgtgcaggacatctcggacctttcggccaagatctccatgtgcgcgcccgatttcaatatggagttcagctcggcctgcgtgcacggccaagacattgtgcgcgaaagcgagaattcggccgtgcacgtggatttagatttcggcgtggtggccgacctgcttaagtggatcgggccgcatacccgcgtcaagcgtaacgttaaaaaagcgccctgccctacgggcaccgtgcagattctggtgcacgccggtccgccggccatcaagttcatcctgacaaacggcagcgagctggaattcacggctaataaccgcgtcagttttcacggcgtgaaaaacatgcgtatcaacgtgcagctgaagaacttctaccagacgctgctcaattgcgccgtcaccaaactgccgtgcacgttgcgtatagttacggagcacgacacgctgttgtacgtggccagtcgcaacggtctgttcgccgtggagaattttctcaccgaggaacctttccagcgtggcgatcccttcgataaaaattacgtcgggaacagcggcaagtcgcgtggcggcggcggtggtggcggcagcctctcttcgctggccaatgccggcggtctgcacgacgacggcccgggtctggataacgatctcatgaacgagcccatgggtctcggcggtctgggaggaggtggcggcggtggcggcaagaagcacgaccgcggtggtggcggtggttccggtacgcggaaaatgagcagcggtggcggcggcggtgatcacgaccacggtctttcctccaaggaaaaatacgagcagcacaagatcaccagctacctgacgtccaaaggtggatcgggcggcggcggaggaggaggaggcggcggtttggatcgcaactccggcaattacttcaacgacgcgaaagaggagagcgacagcgaggattctgtaacgttcgagttcgtccctaacaccaagaagcaaaagtgcgggtagagcgtgggccgcgtgcctgggaacgcgcgcacggcgcggtcccgtgatggagaaaacgccggcggagacgacggcgatttcagctggcaacgtgccacgtgactcaattccgtgtataactaacgtgtccgcggacacccgcggccgtacccgtcccagcagaccagccaccgtccctcagcgacgtcccgcgcggatcggacactttaggcggcgcagcgccagccttagctttcttgactggccggacggcagcgtcacagagggcgttcggacgacctccgcgtcggtcgccgcctccgcggcccgtttcgacgaaatccggcggcgccgccagagcatcaacgacgagatgaaggaacgcacgctggaggacgcgctggctgtcgagctggtcaacgagaccttccgctgctctgtcacctccgacgcccgcaaggacctgcagaagctggttcgtcgcgtcagcggcacggtgctgcgtctcagctggccaaacggttggttcttcacctactgcgacctgttacgcgtcggctactttggacatctcaatattaaaggtttggagaagaccttcctgtgctgcgacaagttcctgctgccggtgggcactgtgagtcgttgcgaagccatcggccgcccaccgctacccgtactcatcggcgagggcggccgcgtctacgtctactcgcccgtggtggaatcgctgtacctggtgtcgcggtccggtttccgcggcttcgtgcaggagggcctgcgcaactacgcgccgctgcgcgaagaactgggctatgtccgcttcgagaccggcggcgacgtgggtcgcgagttcatgttggcgcgcgacctgctggccctgtggcgcctgtgcatgaagcgcgagggttccatcttcagttggcgagacggtaatgaggcgctgacgacggtcgtcttgaacgggagccagacttacgaggatccggcccacggcaactggttaaaagagacgtgctcgctgaacgtgctgcaggtatttgtggtgcgggccgtgccggtggagtcgcagcagcgcctggacatctccatactggtgaacgagagcggcgccgtcttcggcgtgcatcccgagacgcggcaggcgcactttctggcgcgcggactcctgggcttctttcgcgtcgggttcttgcggttctgcaacaactactgcttcgcccgcgactgttttacccaccctgaaagcgtggcacccgcttaccgcgccaccggctgtcccagagaactgttttgccgtcgtttgcgcaaaaagaaggggctctttgctcgaaggtgagccgcggacgccgtcggtaccgtctccaccacagttaccaccgtcgccgtcactgccaccgacatggagcccacgccgatgctccgcgaccgggatcacgacgacgcgccccccacctacgagcaggccatgggtctgtgcccgacgacggtttccacaccaccgccgccaccacccgactgcagcccaccgccctatcgacccccgtactgcctggttagttcgccgtcgccgcgacacacgttcgacatggatatgatggaaatgcccgccaccatgcatcccaccacgggggcgtactttgacaacggctggaaatggacttttgctctcttagtggtcgctatattagggatcattttcttggccgtggtgttcaccgtggtgattaaccgggacaattccactacaacgggtacatcatcggggtaacgggaaatagagcatgtgcttgactgtaccatcattgctgctacggaataataactacgctacgacctggcctgtggtgtgtgttgttttttgtgcacgcacgacatgacactcttttgccgtaccgccaacagcaccgccggctacgtcgacatgaacgtctgcatcggcatgatcggcgtggtttgtttcgttttcggggtctttattctcatcttttgctccacgttgaaagctttctacgtgcggcaaaagacttaccacctcctgggtaccgagtcggacgacgaggagaccacggtttgggaaaagcgccggatggagtcggatacagacttttaaaagaagccataaaaatatgggaattcccctgcctacgtcttcatgacgggcgcctttttcttcgcctcgggctctgtctcgtcgtcattcgggccaggactttttaatggccaacagcctgtggcaccgcctccgaacgttcgtgagcaacagtcggcagaatgaacaaattcagcaacactcgtatcggcttcacttgcgcggttatgactccgcggactttaattctgacggttggactcctgtgtatgaggatcaggagtttattgtgttctcctgccgagacgacggtaacaaccgccgccgtgacgtccgctcacggtccgttatgtccgctcgtgttccagggttgggcgtacgccgtgtaccaccaaggcgacatggccctcatgacgctcgacgtgtactgttgccgccagacctccaacaacaccgccgtcgcgttctcgcgtcatcttgccgttaacacgctgttgattgaagtgggtaacaacacacatcgccgcgcagatggagtctcctgcctggaccattttcgcgcgcaacaccaggattgcccggcccagacggtgcacgtgcgcggcgtaaacgaaagcgcttttgggctcacccacctgcagtcctgttgcctgaacgagcattcacaactctcggagcgggtggcctatcatctgaagctgcggcccgccacgttcggtctggagacctgggccatgtacactgtgggcattctggccctgggctcgttctcctccttctattcccagatcgctaggagcctgggggttctgcccaacgatcatcactacgccttgaagaaggcttgataatgataactgcacatcctcacgagtgcccttacctatcatcacactaagaataaagaaaatcgatcagtgtcgtgacgtgtggtgtgtgtttttcactgttattgggtaccagggaggaggggttaagaggtcacaggtgcgatttaccgtaaggagagtcacacttaagaaaaaggtggaaatccctcacccgttttattcccgtcagccgtcagtgacgtgaatcgcccctcacgtcagtgttgtcccctatccgcgtgagctgggtggctcaccgtcaggtgctccgagacgcgcgtactcggaaagtgcgtcaatgcggtcggtcagccgaccctttgatgtagtacatcgcgtgcgaagatgaaaaacatcttaagaaaccgggtcgcctaaggggaaaaccccacgtgtcttgggcgcgtcatgtccggcgtcttcatgtatataagacggtgtttcaagacgacgtgagacccacacgcgggtttcacttctttctttaattatgtctccagtctacgtgaatctgttaggtagcgtgggcctgctggccttttggtactttagctaccgctggatccagcgaaaacgccttgaagatcctctcccgccttggttaagaaagaaaaaagcatgtgcgctcacccggcgttctcggcaccggttacgccgccaacatggcgtaattgacggtgagaactcggagaccgagcggtccgtggacttggtggccgcgctcttggccgaggccggggaggagagcgtaacggaggacacagagcgggaggacacggaggaggaaagggaggatgaagaagaagaaaacgaggctcggacgcccgaggtgaaccccatcgacgccgagggcctctcaggacttgcgcgagaagcctgcgaggccctcaaaaaggccctgcggaggcaccggttcctgtggcaacggcggcaacgagctcggatgctgcagcacaacggcccccagcagtttcaccagtaagcaggggtaaacaaaaaaaccacagactccgggatagtataagaagggactttaccgctattgctgctattcatagagaaggatagaaaggatgactacgaccacgcatagcactgccgctatcatgagcctgctggacgaggccgagtggcgacagacgcagatggacgtggggggactgatccaggcgtcggcgttgggcaaggtggcgcttcgctacgcggtgaggaaactgatgaagcgcggagccaggctgcggcacgactcgggtctctacgtgtgcatctgcgacccttcgtacgagtttctgcagatgaacctgagcaagatcagttggctggagcgacactgccccccgttggaccaggagctcatcatgttcggggtcatcgaggcctgggaggaagcttcggtgcggcccacgcgtcagctggtgttgttcatgacacccaagtgggacgtgttcgcctacgactccggtatcctgtttttcctggcgcccagcatggcgcagttctggcacggtgccatcgtgctggagtattggaacgctttgttcccggtggaggtgcgttcccacgtccgtcagcacgcgcacactatggacgacctggtgatggtcttccaccagctggactacgaaaagcaagtgctggaagcgcgtcgcgacaagaatacggaggggccgcgcacttttgccaagtcggtgaacagctacgtgcgcgccatcctggaatctgagcggcggatccgcgaagggaaaattcctatgaccttcgtggatcgcgactcgctgcgagccaattcgttggcccacatccaagccaccggggctcagccttctcacgccccggcgcaacgggtgctgtccgcgccgccgagcctgccgtcgcccgtgtcggaagaagaccccgctgccgccgccacccctccgtcctccgccgccaccacccccccgtcctctgtcgtcccggcctccgtcgagagcgagttgtccttgtcgccgccgctgccgccggtcgtggtgaaggatgtgatgtacacggccggggagggcgacgtggtacagatggtggtcgtggtctagaaggagaactttgctgctagatgaccatgttcagcttttttttttttgtagtattttttcatagttgctatacctcagttatcccccctattagccccacatgctgcttaataaacatacttgtttcattttctttctagtgccgcggttttttgtcgcgtccacgggctgcgcgggtttcaggtaaaaaacgtgtgtgataaacgtgggtttttacctacgggaaaggggagggtagaaacgtgagtctccgtcaataaaaagtcccgtgtcgtctccacgtaggtttctgtgtggctgttgttgacgctgctttggagcacgggacacggtgtttcggtccgatgtacgtaccacggtacggacgttaatcgcacttccaacaccacgagcatgaactgccacctaaactgcacacgcaatcacacgcaaatctacaacggcccctgtctcgggaccgaagccagactgcccttgaatgtaacgtttaatcaatcacgacggaaatggcacagcgtcatgcttaaatttggttttcagtatcacctggaaggctggtttcccctgcgtgtcttgaacgagagtcgtgagataaacgtcacggaagttcacggagaagtagcatgttttaggaatgacacgaacgtgaccgtgggacaactgacgctcaacttcaccggccacagctacgtgttgcgggcaatagcgcacacgagtccgttcgaatcatacgtacgttgggaagaaacaaacgtcactgacaacactacttcttcagaaaacactaccaccgtgatgtcaacactgacgaaatacgcggaaagtgattatatctttctacaagacatgtgcccgcgatttctcaagaggaccgttaagctcacgagaaacaaaacaaaacataacgtgacagttacgggaaataacatgacaacgcttcccgtctggacaccggaatgcaaaggatggacgtactggaccacgttgtccgtcatgtggagaaaccgccgttcggctctcctccgagccaaaagtcgcgccttgggacactgggcgttgttgagcatatgtactgtggcggcgggcagcatcgcgttgctcagcctcttttgcatcctcctcatcggacttcgtcgcgatttgcttgaagatttccgctacatttgtcgggacgagggaagttccagcacaaaaaacgacgttcatcggatcgtctgacgtcaacgctgatagtgtctataaaggccgtgccgccgcgccgtagttctccgaaggcggacggaggagtctgtcgaccgcagcggtggctggagaagcgcagcgtcggcgagcgaaggtagaggagtccgtcatggacgacctacgggacacgctgatggcctacggctgcatcgccatccgagccggggactttaacggtctcaacgactttctggagcaggaatgcggcacccggctgcacgtggcctggcctgaacgctgcttcatccagctccgttcgcgcagcgccctggggcctttcgtgggcaagatgggcaccgtctgttcgcaaggtaagccccacgtcgttgaagacacctggaaagaggacgttcgctcgggcacgttctttccaggtgttttcaacgtgcgtggattttttctctctaccaggtgcttacgtctgctgtcaggagtacctgcacccctttggcttcgtcgagggtccgggctttatgcgctaccaactcatcgtgctcatcgggcagcgcggcggcatctactgctacgatgacctgcgcgactgcgtctacgagctggcggccaccatgaaggactttctgcggcatggctttcgtcactgcgaccacttccacactatgcgcgactaccagcggcccatggtgcagtacgacgactactggaacgccgtcatgctctaccgcggtgacgtggagagcctgtcggccgaggtgaccaagcggggctacgcttcctacagcatcgacgaccctttcgatgagtgtcccgacacccatttcgccttctggacctacaacacagaggttatgaagttcaaggagacatccttcagcgtcgtccgcgcgggcggcagcatccagaccatggagctcatgatccgtaccgtgccgcgcatcacctgttaccaccagctgttaggcgcgctgggccacgaggtgccagaacgcaaagagttcctcgtacgccagtacgtcttggtggacactttcggcgtcgtctacggctacgaccccgccatggacgccgtctaccgtctggccgaggacgtggttatgtttacctgcgtcatgggaaagaagggacaccgaaaccaccgtttcagcggccggcgtgaggccatcgtgcgtctggaaaagacacccacctgtcaacatcccaaaaaaacccctgaccccatgatcatgtttgacgaggatgacgacgacgagctgtcgctgcctcgaaacgtgatgacgcacgaggaagccgagagtcgcctgtacgacgccatcaccgagaacctgatgcactgcgtcaaactggtgacgacggactcgcccctggccacgcacctgtggccgcaggagcttcaggccctgtgtgacagcccagcactgtcgctgtgcaccgatgacgtagagggtgttcgccagaagctgcgagctcggacgggctcgttgcaccactttgaactctcctaccgctttcacgacgaggaccccgagacctacatgggcttcctctgggatatcccgtcctgcgaccgctgcgtgcgccgacggcgtttcaaggtgtgcgacgtcggtcgacggcacattattcccggcgccgctaacggcatgccgcccctcaccccgccacacgcctacatgaacaactgattaaggaggggacgacgagcacggtggtcctgtttgtctatgtgcatgtttttgtatataacacagcattttatataacctttccctgtcttttttactcgtaaactgtgtactccgctggtcaataaagaaaaccacgctgttagaaaaccacgtcgacggtatttttattgatatcgacgtctcgtcctgagacagacacgtagaaaaagaggaaaaaccgcgttcagagatgccgtaggttttcggccagatcgtcccgcgggtcttcgacgtcgctgccgtagctagtgctcggcatgctgtcgggtccctggaagcgtgtgtgggccggccctcggggtgcgggtggcgggctgcgtcgccttcggtgacgtcggtggtggctgtaggctaccgagtagggcgaaaagagggtcacgctgaccatgcggcgtcgttgccggggcggctgctccaggtccgcggagctaatgccgtgcgaccccgacaaagaagaagaggagagtaagagacccgtggtagaagaagtcccggccgaggtgtacgtggacgcgggcgtggtggttcgtgtggatgacgacctggcggacggcagcgaaacagaattcggagatgctgaggacgacgacgaagacgcggacgacgaagaagctgcgtcggtcacaggacggcgaaaaacatcggcaaataaatcgcgatgttctgtgatctcgggttccgactcctggcccagaggcgctctatcgaggagttccatgaagcgcttgggtgtcaggcccgtctgccgagaggcgccctcgatcatcatgctatagatgcgctggaggtgatacgtctcggtggtgatcttgccttcgtggaagttatagaagatctgcagggtttcgggccgttccacgaacatacgtcgacgcaggtagcggctgggttgctcgggcacgcggaaaacctcgccgttgccgtacaggttcttggagaagaaaaagagctcgccctcgcgcgccgtgggatcggcttcgagatcgagctgggcctcgcgcggctcgccgtcgttctcctgctcttcgtcctcgtccccgaactcgccgcgctcgcgggcgtccgagaccgattggatctttttcagcagcttgtacgcgctgaaatgtaaatatcccgggcagaggtacacgttggcctcgtgcagctgcgtcagtagttgcaacagattgtacagcatcggctggaaggccggactgctgtgttgccgcgcaagttccagcccacgcaccagcgtgacgaaagtctgccgtgtttcgggggcttgcgtgtaacaaaagtaaagcgcgtcgcaaagacggttgcagcgttccaccacccagtcctgcatcatttgtagctccagcgcgtgtcgcagctgtaagtgtcgcagcgtcaacaacagatacatgtcgtttagcgcgtcctccagggtgcgtgagcccgggcgtttgatggaggtgaggcagcgcaacggtcggttacgacgttgtgttacgtcggacaggttctcggcgcacagatccaccgcctcgaccgtggtgaagggcggtgggtggaacagcaggttataggtggtgaggcgcggatagcgcgcctcggcctcgggagacgcgcgcagccccagcgcgtcgcgtacccggtgcaaccggaccagcgctcgttttagcacgccgaatgtcacatcgtcggcgcccaggtgcacgctgatgtcctcgggcttgacgccggtttgcgcagcgcggcagagtcggatgagccctctaagcagccgcgtcttaagcggctccgagtacagcacgtcgagctgcgtgcgcaggtcccgcaacacatcgcggctgttgcggtagtgattagcgagaatgcagatacggataatctcctgggccacgggctttaccttcataaaagcgttgcgcacctggaagtccaccagggcctccagcgcgtatacagggctgggcacgccaaagttgagcagccccacaaagttggagcagccctgggtcaacatctcgagcagcaggcgccggtgctcgtctccaaacaggtcaacccgaaagttgagccagtcgtccacggggagaacgggcagtggcgggcccgatggggctcgcgatccctgggccatgatggggccccctttgaaaacgaaaccaaaaccagagcggaacttgagaaatcaacgctttattgttctccagtgacgttaaatacacaacggggttatgggggacgtgacgggggtaagggctgaggtgactgaaggtgagggggtcgcggcgactcgcacagaggtctggctggctagaggtccgtcttcttcgtcggcgcgatgccgcagggcggtcgctagcgtgtcgcagcgttcgccaccgttgccgtcgttgttggagacggagggttctgcccgcaggaatgctgcggttgccttgcaggagggaaacagctcctcttcttcctcctcgttttcttcgggcttttgctcgtgaggcggcacgcgtgtgcggggacgacgggcgttgcggggcttcttggaatcgtgaagcggcgccgggtcgctgtgacggagctcgtcgtcgtcctcctctccctcgtcgttgttctcatcggcctcgggcggcccggccgccgcgctgtgtgagagttccagggccgccgacaccgagtccgtatgaccgatctggaagagcatgcggtaggcctcgctgtggtaacagccgtcgaagacttgtgcgatatccaaacctgagttcatcaacaggtgtaggaagctgttctgcaggtagtggcgcaggtgtccgatgagacggatggagcgcgcccacatgtgcggcgtctggtgcaacaagccgatgaggacgtggcacagttcgcggtggcgctcgtgtggcagcaaggctaccagttgatgcacctctacgcccagcgccgatttttcgccgcagcgtttggtcaactcgtcgcgcgcgtagctcaccaccttgtcctggtgctcgcagtagtggcgcagctgggccgtgaaaaccagctggttgaagagcgcgcacacgcgcgacacagccgtctgcagttcgtcggccggcgtgggcggctcgcggagactgggctgcaggcggcagcggatactggccgtgacttgctggatctcgtgggggtccagttcggccggcgcgcgcttgagctgtgcgatgccctggtggaacttgcggtagtcgcgctcggtgcagaaaacgaagaggttgctgttgcggcgcgagcagccgccgggcggcacgggcaagtgcttcagcagcagcttcttcttgccttcggcgcgtaccgtgcccttgtacgctttggaaatcgagcctgccacgttgtcacgcatctcggcggctcgcaggactgaatcgtcgttggagaagtctcgggtggtgatgatgaagttcatgacgacgacggcggtggggcggtaatagtataggtccgtgcgagcaggccgccgccgtgggggccgcggagggaggagagggacgggaacgatcaccgctcggagaaaacaacgtcgacgggggacgtcgtttttatcgtaccgtgccgagacagaagttgcgccggacggcgttgtggcgcgcaggggctccgacgtggcgttataatgaagccggggcgccactcctacgccacgcgattggccgtcggcgtccgcagtcgggcgaaatctgtgtaccgtgatgacagatcagggggacgtgtaccgtatatgaggggaaatggcgacgggttctggtgctttctgaataaagtaacaggaaagctcataccccgctgaggttatgatgcgattgtgagagtcgatgggggatttttgtggatgtgtcgttggacgcggttttctggccgcctttccacgtaccgctgggaaaattgaaagacacgctgcgtttggcgtgctgattgcagtttttgctattggggtctaatgacgtagccactgattgtgaattgttgccagccgctagatttgtctccgctgtagctcgctgattctgctgcgatctcaggaaagcgcggcggtccagcaactgaccgcggaaacactgccgcatgcgttgcagaaagtcatgacccagcagcgcgtacaggatgggattaatgaggcagtgtaggtggggcaccacacgcgccagcgtgccaatggtgcgtcgcagtgtgaggtgttcacactgcatgggccaggcggttgtggcataactgttgaagatcatgagagagacgtagggagtctgtagcgccacgaaggagatgagtagcacgctaacaaaggttaaggtacgactcctttgtttctgtgacgtgcgctgtacggttgagtaaaagaatgcgtagaaccacgtcatcattatcacgggtgcggcaccccataccagcgtcagcagcactttccacgaaagcagcactgtgtgcacttcttcagctacgaagtacagtacacaggtggcgtgcccattagtattattggtatcgttggcatcgtgatgcatcaccaccgtggtgtaaacagctgcgggcacggaaaaaattagtccagcgagccatgtcaatagcaaaatcatataggttgaacggtatgattggcgtgcgtatgttcgtttatgaaggacgcgataacgatcggcggcgatcagagctacggtggcaaagcccactgtgcagcttgagtagtagatcaccgatagaaatttacacgaggccacgccggccggcaacagccactggttgctgagtacgataaagggtagcacagtaagcgtgagaaaattagtagagtagaggttggtcatgtaaatggtgggcgtcgaatagccaagcacgcggttcgtgagcagctgcgtgatcaacactatggcgttaagtggaccgcccacgaagatgatgaatgtgttgagtacggcttcggtggttcgaatggcgaatagcggccctgtcatgttgcaagtgtcattgatgtgcggaggagtgttgttgcgggtctgggcggaacagcacacggggcgaaaaaacagaagaaacaagtcagcggcgcttaaaagaaaaccgcgtatccgcctccgctattaaactaccccccctccctctaggtggggcgctcaccgagttgtggatgatggtgtccatcgtgggcgaatagcagaccgcgggcgcagtccggggcgacgacgcttccgggttctggagaaaagccagcatgagtttgcagtttatcggtctacagcggcgcgatgtggtggccctggtcaactttctgcgccatctcacgcaaaagcccgacgtggatctcgaggcacaccccaagatcctgaaaaaatgtggcgaaaaacgcctgcaccggcgtacggtgctgttcaacgagctcatgctttggttgggatactaccgcgagctgcgtttccacaaccccgacctttcctcggtgctcgaggagttcgaggtgcgttgcgcggccgtggcgcgtcgcggctacacttacccgttcggtgatcgtggtaaggcgcgtgaccacctggctgtgctagaccgtaccgaattcgatacggacgtgcgccacgatgctgagattgtggagcgcgcgctcgtaagcgcggtcattctggccaagatgtcggtgcgcgagacgctggtcacagccattggccagacggaacccatcgcctttgtgcacctcaaggatacggaggtgcagcgcattgaagaaaacctggagggtgtgcgccgtaacatgttctgtgtgaaaccgctcgaccttaacctggaccggcacgccaacacggcgctggtcaacgccgtcaacaagctcgtgtacacgggccgtctcatcatgaacgtgcgaaggtcttgggaggagctggagcgcaaatgtctggcgcgcattcaagagcgctgcaagctgctggtcaaggagctgcgcatgtgcctttcctttgattccaactactgtcgcaatatcctcaagcacgccgtggaaaacggcgactcggccgacacgctgctggagctgctcatcgaggactttgacatctacgtggacagcttcccgcagtcggcgcacacctttttgggcgcgcgctcgccgtcgttggagtttgatgatgacgccaatctcctctcgctcggcggcggttcagccttctcgtcggtacccaagaaacatgtccccacgcagccgctggacggctggagctggatcgccagtccctggaagggacacaaaccgttccgcttcgaggcccatggttctctggcaccggccgccgaagcccacgctgcccgttcggcggccgtcggctattacgacgaagaggaaaagcgtcgcgagcggcagaaacgggtggacgacgaggtggtgcagcgtgagaaacagcagctgaaggcttgggaggagaggcagcagaacctgcagcaacgtcagcagcaaccgccgcccccgacacgtaaaccgggcgcctcccggaggctctttggctccagtgccgatgaggacgacgacgacgatgatgatgacgagaaaaacatctttacgcccatcaagaaaccgggaactagcggcaagggcgccgctagtggtggcggtgtttccagcattttcagcggcctgttatcctcgggcagtcagaaaccgaccagcggtcccttgaacatcccgcagcaacaacagcgtcacgcggctttcagtctcgtttccccgcaggtgaccaaggccagcccgggaagggtccgtcgggacagcgcgtgggacgtgaggccgctcacggagaccagaggggatcttttctcgggcgacgaggattccgacagctcggatggctatccccccaaccgtcaagatccgcgtttcaccgacacgctggtggacatcacggataccgagacgagcgccaaaccgcccgtcaccaccgcgtacaagttcgagcaaccgacgttgacgttcggcgccggagttaacgttcctgctggcgccggcgctgccatcctcacgccgacgcctgtcaatccttccacggcccccgctccggccccgacacctaccttcgcgggtacccaaaccccggtcaacggtaactcgccctgggctccgacggcgccgttgcccggggatatgaaccccgccaactggccgcgcgaacgcgcgtgggccctcaagaatcctcacctggcttacaatcccttcaggatgcctacgacttccacggcttctcaaaacaccgtgtccaccacccctcggaggccgtcgactccacgcgccgcggtgacacaaacagcgtctcgggacgccgctgatgaggtttgggctttaagggaccaaactgcagagtcaccggtcgaagacagcgaggaggaagacgacgactcctcggacaccggctccgtcgtcagcctgggacacacaacaccgtcgtccgattacaacaacgacgtcatttcgcctcccagtcagacgcccgagcagtcgacgccgtccagaatacgtaaagctaagttatcgtctccaatgacgacgacatccacgagccagaaaccggtgctgggcaagcgagtcgcgacgccgcacgcgtccgcccgagcgcagacggtgacgtcgacgccggttcagggaaggctagagaaacaggtgtcgggcacgccgtcgacggtacccgccacgctgttgcaacctcaaccggcttcgtctaaaacgacgtcatcaaggaacgtgacttctggcgcgggaacctcttccgcttcttcggctcgacagccgtcagcctcggcgtccgttttgtcgcccacggaggatgatgtcgtgtcccctgccacatcgccgctgtccatgctttcgtcagcctctccgtccccggccaagagtgcccccccgtctccggtgaaaggccggggcagccgcgtcggtgttccttccttgaaacctactttgggcggcaaggcggtggtaggtcgaccgccctcggtccccgtgagcggtagcgcgccgggtcgcctgtccggcagcagccgggccgcctcgaccacgccgacgtatcccgcggtaaccaccgtttacccaccgtcgtctacggccaaaagcagcgtatcgaatgcgccacctgtggcctccccctccatcctgaaaccgggggcgagcgcggctttgcaatcacgccgctcgacggggaccgccgccgtaggttcccccgtcaagagcacgacgggcatgaaaacggtggctttcgacctatcgtcgccccagaagagcggtacggggccgcaaccgggttctgccggcatggggggcgccaaaacgccgtcggacgccgtgcagaacatccttcaaaagatcgagaagattaagaacacggaggaatagttaagaaacacacacgcagacgtactttttaatgaaatcatcggatagtgacgtgtcgggaaaggaggacggacggagggtcagggatggggagatgtgagaaagttgtccgcgggcaattgcatgtcgcccagaaagaacgtggttgctccggcggcgtgcatctgccgaaacaccgtgtggtgattgtacgagtacacgttaccgtcgccctcggtgatttgatacaacgtggcgatgggggtgccctgcgggatcacgatggaacgcgtgcgcgtccacagcgtgactttgagcggctcgccgccgcgccacacgctgagccccgtgtaaaaggcgtcctcgtgtggcaagttggccaccaagaaacaccggtctgtgatctgcacgtagcgcaagtccaactccaccgtctgccgcggttgcactccgaagtggatatcgtaaggcgcgtgcaccgtgagcgaaaacacgttgggctcgttgagaagcggacagttgagcgcgtcgccgctaaaaaagagtgacgggttgcggctaaatcgcaggtcgtacccgcgctgcgcgctcgtcagcaggtagaaggaaaaggcgcgcggcatgttgcgcgccgtgatcttgtccgagacgcggtgacagaaggaggtggccacggtgcccagcagttggcgctgttccgcgtccacgcatagtgaatccacgttgacggtgaaaatgagacccatgaattcgtactgtacgtttttggacgcgatccacgcctcgtcctcgccgggtagcgccgcctcgtcgtcgtccatcgtgccgcggaactgcgcgaggtagcgcgtaatttttttgtgtccgtacgtggttacgcgtttactgatccaggtcagatggtccacgcgacacagcagcgtcgcgccatgccgcgtgacgctgacccgtccaaagggcgccgtctcctccaaccccgcaacgccgctcggagcaccgccgcagcccggctttcccggcgtcgtgaaaggcacggcgtaatgcgggcaggcgtgcggcacgaagggcaccatgaccagttgtgtgtgcagaaaaccgatctgcaccgcctgcgactgccgcatggtttcctcgtcgtaaaccgccatggacgagcagagcccgcccttggtgatgagcggttgcagcaccacggagctctcgctggtggagcagagcagaaagaagagctcggcgtacgccgccttgggcgtcaccacgttggaccagtcgtacttgtagccgcagccctgcgtgttgttgtaaatgacgggaaacgagagaaagatgcagccctgcacgtacgaagctttctccgtcacgttcgaggccgtgttgtactgctcggtgatggacaccaagtacgactcgtaggccgtcaggtgcgaggccgaacggtgaatcttggcgtggcgcacgcagcggccgtagttgtcgcggtccgcgtcgcgtagcgcttcgatccacgaggtcaccacgtcctgcgccggcagacgatagtcctgctcggggtccatgtggcggcacagccgcaggcgctctgccagttggcgagggataccgtcgtgcgaccttttgaccgcggtggtgcccgtcgtcctcgtctcccctccttcgtcctccctgttttctcttctctcattcccggtctccggacccgcagccgctacctcttgctccgcggttttctcgcccacctcgctcgtcgctgttgccgccaccgcagcggcggcgacggacggcggcggtaacagcagctccgtgaagctgacgagcggcagcggcgacgacggtggcggcgacgacacggcgacggtcaacagggtcacaagcgtgggcttgtcccccataatctggtcgccgccaccgccgtcgttgccggtccccgtttcctccggcgccgcggtttccgccgtctccggatgagcggccgcggcgcgggctcggcgtcccgccgtccgagacggtgtatataaaccgcgtcggcctcgccggcccgagcgcgccggggagaagaatctcttcccgggccctgcgttcaagacggcgtgccgtgacgctcgatgggtccgcttcatcagactgcgtacgctttggagcgtcagacccagggcgcatgtagccgacttggaggactttgccgccttttatcgcaccctctcggacagtgagcagcaggagttcgagcaagaagccgaactcgcctcccgctcacaacgcgtgcgagacctgcgcgaggcccggcgccagctcaagatggacctgatgtgtcacggcggttgaaaacgcgcatgatctcgcggagccatctacgcgcctgtcagggcgatgacgacatcggcgatgacggctcctgatacgcgccggcagctgcagcacgtggagacgctgcgtcggtttctacgcggcgacagctgctttgtgcacgatctccggggcatgatggactatcacgacgggctctcgcgccgtcaacagcgtgccttttgccgcgcgggtcgcgtgttgacggacccggagcccatccagagcgagacggagggggagaataaacagtttacggagcacacacacaaagtagtctcgttttttattaaaagtgtctttgtatttccctgtcttgtgttgcccaactgctgtcaggtctccgtagatcgctcccgggtgcccgagacggggggcagatggctataaaaacccaagtagcggcgcgccccggcgctcagtcgcggctgagcgtgtggaggacggggtggagcgggtcgccgagactactactgcttctgcttttttgtctcctgtggatcgtcgcggactgccggcatgtccggccgtcgcaagggctgctcggcggccacggcgtcttcctcctcgtcgtcgccgccgtcgcgccttcctcctctgcccgggcacgcgcgtcggccgcgtcgcaaacgctgcttggtacccgaggtcttttgcacgcgcgacttggccgatctgtgcgtgcgacgcgactatgagggcctacggcgttatttgcggcgcttcgagggctcgtgcgtatcgctgggctggccctcgcagtgcatctacgtggtcgggggcgagcattcgccgcactcgctaactgagatcgatctggagcactgccagaacgactttttcggcgaattccgagctctgcatctcattggcacggtctcgcacgccacctgccggtaccaggtgttcgtggacgcgtacggcgctgtgttcgcctacgacgcgcaagaggactgcctgtacgagttggcctcggatctggccggattttttgccaagggcatgatccgctgcgacccggtgcacgaatccatctgcgcgcgtctgcaacccaacgtgcccttggtgcatcccgatcatcgggccgagctgtgccgccgctcgcgcgcctccgctcgcggccgctacctacgttcgctgctggctttccgcgagttgctggcctgcgaggacaccgccgctcgctgcgcctacgtagaggcgcaccgcgaggcgcagctgaccctcatctggcccgagaagcattccctggtgctgcgcacggcgcgcgatctagggctctcggcctcgatgctgcgccgctttcaacgttcgttgtacacgcgcgagcccgtcatgccgctgggcgagatcgagggcgccgaggacaagaccttctttcaccgcgtgcggattctctgcggcgacacgggcaccgtgtacgcggcgctggtggggcaggataagttggtgcggctggcgcgcgacctcaggggcttcgtgcgcgtggggctagcgctgctcatcgacgactttcgctacgagagcatcggccccgtggaccgcagctcgctgtacgaggccaatcccgagctgagactgccgttcaaaaagcgtaggtgagtcatcagtgtacacgcccagaaatagggcgacggtgtttttataaccgaaagtagcgtgtttgagacacgcgcttctggtcggttttttcaccgtcgtcgctctaggtttgattttcgcgctcttgtgtctcccgacaggctcgtcgtgggctactttgactcgctctcgtcgctctatctgcgcgggcagcccaagttcagcagcatctggcgcggtctgcgtgatgcctggacccacaagcgcccgaagccgcgcgagcgtgcgagcggggttcacctgcagcgctacgtgcgcgccacggcgggtcgttggctcccgctgtgctggccgccgctgcacggcatcatgctgggcgacactcagtactttggggtggtgcgcgatcacaagacctaccggcgcttctcgtgcctacgccaggctggccgcttgtactttatcggcctcgtcagtgtgtacgaatgcgtgccggacgcaaacacggcgcccgagatctgggtctccgggcacgggcacgcctttgcgtacctgcccggcgaggacaaggtgtacgtgctggggctctcgttcggcgagttttttgagaacggcctctttgccgtgtatagcttctttgagcgcgactacgtggatgaaatcgtagagggcgcgtggtttaagcacaccttcgcgggcatgtacgaactctcccagatactgcacgaccgcgccaatctgctgcgcgtatgtcagctccacgccggtagcaagatccgcctgggcggctcgcccgcttgtactttcactttcggctcgtggaacgtggccgaggccgacgaggccaacaattttgtgatcggcgtactagaacaggcccactttgtagtcatcggatggatggaacccgtgaacaaagccgtatttatggacgcgcacggcggcattcacgtactgctgtacggtacgatgctggttaagttggccgagacgctgcgcggttttatccgtcagggttccttctggtttcgttgcccacggcgtttttgcttctcgccgttggactcgagcgcaaccgtcgccgcgaaaccggtgagcagccatacatcgcccgcgtacgacgtcagcgagtacgtgttttcgggccgtagcgtgctggatagcgtgagcggcacgggggcgtcgtgaaggaggagactgtgatgactagctatatagccgctgtctggctttaccgccgtcgctccgcgtcgcttcgccgccaccttcttcttcctctcagtcatgaaccccgtggatcagccgccgcctccactgccaacccagcagccggaggagcaggctaaagaagaccatgacgacggtgacgagcgcctatttcgcgatccgctcaccacgtacgagtatctcgacgactgtcgtgatgatgaggagttttgtcaccagttcctacgcgcctacctgacgccgattcgtaatcgacaggaggctgtgcgcgccggcctgttgtgtcgcacgcccgaggatctggcggccgccggcggtcagaaaaagaaaacgccggctcccaaacaccccaagcacgccatggtgtacattcgccgcagctgtctggtccattcggcctgcgctacggcgcacggcaagtacgacatccgcggtctgacgctcgagtcggacctcgctgtctgggccgcgcttcgaggcgtgcccttgccgcccgatccgcagcattttcgctggctcaacgccggcgctttccgccgtctggtgcacgaggcgcagtacttgccagagatcagtcgcgccgccaaacgcatcgctttggccgtggccacggggcaatacgtggtgtgcacgttgctcgattacaagacctttgggacgcgcacccattacttgcggcagctatgctcgatgaccgaggagctgtacctgcgcctggacggcaccctgtgtctgtttctggagcccgaggagcgcgaactcatcggccgttgcctgccggcggccctgtgccgtgggttgcccgtcaagtaccggacgcaccgcgccgccgtttttttccacgccacgtttatggcgcgggccgaagcggcgttgaaggacctctacgcagccttttgcgagtgcggcgacgggcgcgacgacggcggtaaccacgacggtaaccacggcggcggcgaccactcctctttgtcgctttccgcggcggcgtcttaccattcccgtttggagcacgccgagctgaggctggagcgcaaccgacacctgggtgcgtttcacctgccggcgattcgccacctcacggccggtgacgtggcccgcgtccagaacagcgtatcgcgtgacctgggcttcgccgactggtcgcagacgctggtcgacgattactttctgctccccgcgggctgggcctgtgccaacccgcgtcgcggctacgccatgtacctggcctccaacgccgtgctggccctgcgtatcattcggctgctgcgcgccagtatacgtcacgagtacacggcgtgtatacgtatgttgagcggggacgtgcagcggctcatcaggctgtttaaaggcgaggctgcgctgctgcgcaagggactcgctcagaaccccgtgcaacgtcgagaactgtcgcggttccgcaaacacgtccacgatctgaagcgcattcgcttcaccgaggacacgttcgtggagaccttctgcgactttctcgagctggtgcagcggattcccgactaccgcagcgtgtcgctgcgcatcaagcgcgagctgctgtgcctgcacgttttcaagctgcgccggggctgtcgcgcgccgccgacgcccgagacggcgcgcgtccagcgcctgctctggcactcgctgcgacacggggacgcgccgcaggatcgcacgcggctgccgcagttcagctcggcgctctcggacgccgagctgagcaaccacgccaaccgctgccgccgcaagaccccgctggaactcggacccgccgtcgtcgccgccccggggccctcggtgcgctaccgggcccacattcaaaagtttgagcgtcttcatgtacgccgttttcggcctcacgaggtcggaggtcacgccacatgaagccgcggcggcgcgttataagcaccgtggggtcatcgaccgacgaggcgcggcgatgacgagcaggcgcgcacccgacggcggtttgaatttagacgattttatgcgccgccagcgcggtcgccacctggatctgccctatccgcgcggctacacgctgtttgtctgcgacgtggaggagaccatcctcaccccgcgcgacgtagaatactggaagctgctggtggtgacccagggtcagttgcgcgtcatcggcaccatcggactcgccaaccttttcagttgggaccgcagcgtggccggcgtggcggctgacggcagcgtgctgtgttacgagatcagccgtgagaactttgtggtgcgcgccgccgactcgctgccgcagctgctggagcgcggcctgctacacagctactttgaagacgtggagcgcgctgcgcagggcagactgcgtcacggcaaccgctcgggcctgcgacgcgacgccgacggccaagtcatccgcgagtcggcctgctacgtgagccgcgcgctgctacgtcaccgtgtgacgccgggcaagcaagaaatcaccgacgcgatgttcgaagccggcaacgtgccatcagcgctgttgccgtaacaaaacaggaaggaaaaaaaacacacacatgaaaaacccggagaagacagagaggacgagcgtccacacaccgctttggtcgtagacgtactttttattcttggtacattaaaaaacaaacacatactttcttgtgacttttttaccataaactgttccgccctgctgcttcgtcccaccatcagcaacagtactccccgctgtcgcggcggtcgcgacggtgacggtcccgctcgtcgcgttgaggatagtcgcgcggtggcagcgggggtggtggggatcggcagatttgttcggggtgattaccgttcgcttccataaacgctttaagagccatctcgcgtaacgtgtcttcttcgcgttcgtcgggggggacctggctaaagattttgagcagggtgacggaggagacacccgtgtgttcgaccggaatgtgtcgactcgagggctgcgcttgcaaccgcgccacgcatatgtcgcgggtgatgagtttctggcgcaggtgggtggcgcgcgggtcgcgcaacagcggatcgcgcaccataaactcgcctacgaggcgttgggagctactgctgccgccggtgtcaccgataataggtctgtcgggacaggccagcagacgcagggcgcagtacacgtagtcggtgcaaatgaaggcgtcctgctgacgcacgacgcgtaaaaagtcaaacaacgccggcgtgctcgcgtagagcgcgtagtcgtagttttgactgacggcccagtagatcacgtcactaagctgcgcgtagtcttcgcgcaacgacggcagttgtacatagatgaggtaacacagctccgagatgctctgcagctggtgctggagatagcagcgcagcacgcgaatggtgcgttgaaagtgcgtgatcataagctcgacgcctactaggaacgccagatcgttgagcgtgtgctcttcgcatatctcttcgaccgaaagcagccggagcatgccccggtggttctcgttgagccgctgcaggttttgccgatagaggtagagcgcgccgcgcgaggtgtagtgggcggtatagaagagcacgttgtaatcgcgtagcgtctggtagacctcggtgagccgcggcgattcgggcgtgccgcgatgccgcagctcttcgtccagccgccgcagagacgtggcgtactgaccgtccgtcactccttttcgtgacgtgagaaagtgaagcgctagcgcggccgcacgccccgaacggctctggttgttgacctgcgcggctacccggcgtaccgtgtcgccccgcacggtggtccgtatggcctccaccatgtggcgcgctttcttttgcgccacgtagtaatagttgatgatcaccgcgtgcgtgattatccgacgcgtgagatcgcgctcgccaggcgctacgttgtttaagacggggtcgacgaggctggtgagcgcgaaggccggcatgggtatgcattcgttgaggcggcggaggtgctgcacgtcaaagtcttgcagcacgaatttgagatactcgacgtgctgcggcgcgaccacgctgggctcgaagcccagattgtcggccacgctgacccggtaacattcgcgctcaaagtcttcgatgtcgctgtcgcagaaggaaaactcatcgccttcggcagcggacggctcacctggcgccacgggactggtgcttctgctactgttactggtggtgcgactgctgctaccgccgctgctgctgttatcgtcgccaccgccgccggcgccgttctcgggcagcgagggcacactaggcggtcgcgagactttaggcgacttgccggccttgggtgtcgccggcgagccccgaggcgcgcccgctgcgatctgcggttgccgacgcgacgacgatcgtttcttttcgctcggtttcttggcggcaccggcgccgccggtctcgcgcacgagctcgaaggacgacggagcgtccgaggagacgctgtagggcgacaaaccggcctccatgcgatccagatcttccgtggcgctgcgcgcccgcgtgctcgtgaaaacgctgtcctccgcctcctcatccgccggcgtgtcctcgttgctcgaggggatataaatcaccgtcgagggttcgccagagcgacgtgacgagctgcgacgccgcgacgacatcctctcgtctgctgaggtgcgttcggctcagttgcttacctgcatacatggaggagacccgggcgggacgttatatagtgagggccggctccggcgggcaaaccgaagatacagcctcgggcgcggaaagtgtcctcgccacgctggccgcggtgaggacaagaagacggagcgtggtgtgcgacgggcccccgggctcgcccaccgactcggcgcgtcacatgagcgatctggctagcctggcgctcacggccgagttcggcctgggctgtctggaagcttacgtgcgcatcaacgcaggccaggtgttgcccgtggtctggccgccgggctggaacctagtgctgcaggagatcgagacggacgaggacttcaaaccggaggacgtgaaagcttggagtcactacctgtgctgcgagacgcgcctggccttcgtgggtcgcttcgtgaacgagggcgtgttgtcgccggatcagcagaagaagaccgccgtgtgcctcatctcggacgagggctatgtcttttgctatgtacgcgaggacaccgccgtctactacctggcccgcaacctcatggaatttgcgcgcgttgggctacgcgccgtcgagaccctgcactgcatgcgctacctgacctcgtcgttggttaagcgctactttcgcccgctgttgcgcgcctggaccctcggtttggataccatggcgcgattcatcatccgccaccacgggcagttcatgccgctgacgtacccgccgggaacggaactgcgtctatgcaacctcaggtgtttcgaaaacagcgtggaaggcggtcacttgctgcgcaacatcaaagccgctttcggaatgcgcgttctcggcctgggaaccgtcagcctcaagggcgagaacgcgccctttcctcacttgcgctggcccgtcgaccttatccccatcgttgtcgcctataccggggccgtctacgcctgcgacgtgcgcgacgaccgctacatccgggtgggagataatctcaacacgttcatgtgtttgggacttaacctgctgtttgaaaaccgacgtttcagcggccacaacggcatctacgatcgcgtgcccgactgccccaaaggacgtcagcaccgttgactgtgacgccacgagtgacgacgacgctgcttggggcataaaacaccgacgctacttcccgtttgactcgcgtgccaattttttcgctgccaacgccgtcaaggccgcctcttctggccctccgccacccttcgctcgagcacggcggtgtttcgccgtcgttttttttttctggatcggcccgatttctttttgtccaccgacgcgcgaccgcgatgtcggtaatcaaggactgttttctcaatctgctcgaccgctggaggcctcctaagacgtcgcggccatggaaacccgggcaacgcgtggccttggtttggcccaaagaccgctgcctcgttatccggcgtcgctggcgcttggtgcgcgacgaaggacgggatgcacagcgtctggccagctacctctgctgccccgagccgctgcgtttcgtcggcagcatctgcacctacaactttctcaaacacaagggcgatcacaacgtgccgtctgaactgtacctgggcgcctcgggcgccatgtacctgtggaccgaccacatctactctgactcgttaacctttgtggccgagagcatcactgaatttctcaacatcggtttgcgacgctgcaacttcatcaccgtcccagaggagctgccgcacaccgcctcgcttagagcgctggccggctgcatgcacatccacgcgttcgcgcagtggcgtgctacgtatcgcggccgaatcatggtcgtgggtgattacaccgtcattcgcgtctccacgattcggctgtacgactggagcgagattaacgactggagggtcatggtcggcagtaaccacgtggaacctttaggctggttggtgagcccctacgacgtgatcaacctcttcgtggacgactgtatgcgcgtctttgctgccaacaatcagcacgtttgcatcgtggccgacagtttgatggagtttgtgactcgcggcatgacacgctgccacgaaaacggcatttattacggaaccaggagcatgcggaagctaaatcagcctacctgtccttacggagtggaccaccaactttttgacgacgcgtgaacccgcgtctcccacggaccgtgtgcctttttttttccccgttcctgtaaataaaaagctgttttttatttttcatacgaaccgctcgagtcgcgtgtgttttgacggggctgggtggggagggaaggtcgcgccgccgcagcatcccgcatagcctctacaaactagcattctggtgagatacatgttcataaactctcacgggaaggctagttagacaggctatgggaagaaaccgtgtttcgcgtgccgaatacgaaagaaaaaagaccggaggcggggtgtttttagagcagaaccttacagctttttaataaaaaacaagatagtcaacatggtctttaacccttgggatctgccgctgttactgggtcttttcattttctttggtgtgttcttccttgtgttcgttagtcttctcttgtggttgctgatggttacctccatctgtgtccgtaatcaaaacgtcatagtctcccccggagtaatcttcatctccgtcggtggtggaccccccctgactgagagttacgtctttgttgcgagtggtattaccatcggagttagtgctggtactgggttgttccaccgtcacgctgcaaaaacacaataaccgcgttcacaatcacgttatttttttgtatttcttacctgtgttgagttccccagattccgtttacctgcgcttcgatttctgagaaggtgccgccaaagccaccgtcaaggtcacggctagtaagctcaggatccatagcctccgagccatgctgaggtcttgtcggcgtcgctgatgacgaacgcgtctggctgtgtgccgttaaataccttgggtgacgacatctcgaggtcatgtggccgcttctgaaaaacaacgtagtccggacgaaccgcagatacgcggtttttcaacctcgacggtttacgcctcgcccccaacatgacgcgttcgggacgaaagacgacgtcaggggattcacggtatttagccatgcagcgtgcggcgcctctctcatggatccactgtcaccgtcgcgatgggaggtagccctgttccccagctcaccaccgtcactcaaggactcatgccatctgtgcgcatggactttcgggctcgccggcccttgcgccgcttggctttctacgcgccgcgagctcgtcggaggcttttccagaatcatatacatccagaacagcgccgagtgctggtcggtgagggagacgaagagatgttgccggatctgccgatggagatcgacatcgtcatcgaccgacctccgcagcaacccctacccaatccgctggtgctactgctggacgatgttcccccccatgtacccggttttgctccctaccgcgtcccccgtccccaccccatgattcccgaagaacattgggaccagttttaaataaaagcattttatttacatctgtacagggattatataaaagtctgtatatccagtccattgtcagtatttttgtgcttaagttcagtatagatttatggaaaatatgtagtccgtaccgcttggggctcagagtccaaagtccgtcatgctggcatgcagaccaccatgtgcatgggtccaggcgatggcggaggagacggcgggaattctattaagtggggaggtcgtggaggcagcgggggtggtagtacccacattttgctctcccggatccaagggacgagcagtcgccgcgtgcggataggcacctggactttaatgtcctcgtgcgttaacaatttttctttttcctcctcttcctcagtgaattctggcaagagttcaaagccgcgtgggcatatcagaagccggccacagcgatagtaacagatgaggatgagcagcgatagggagacgagtataatagatacggtacctgtgattcccgcgcaggacacggagaacagatacatgtatctacgacccttgtcgactatataagcttcctgaagtccacatgtaagcactgccaagggggtcaggataacatagtccataaattcttttggtacgttaccttcagatttgttgtaccattctaccgtagcgttcagagtatactgtttaggaagcagcatgcagcgtgtttcatttcccagcaactcgactttgatagtgttattaaaagtaatattgatccaatttttccatagctggcacatgccggaaaagagatatttcgaaacttgattttcacaggtgctattggtatggttgtaagcatttccagaataccaataagtattgttttgagtgcagttcagaagccagagggtagtcagataggactcaccgcggttgatgcagctctctgtcagattagccacgctccaattaccctcagtggaagagttggttattgatgcgtttgttaaagtgaagccaaatgttccagttaagttagtgtagtttgaatacaaacccccgatggccgtgcgggtaactccgttgggaccggtaaggagagacacaaagatggtatcggtattgttggttcgggtgccattgagcgttgtcaactgtatccagtagtaatccagcatcaccagcatagcccgtatcccgagcatcttgccggacactgaacataacggcgtttgtatatataaagaccgttccaacgcaacattgaggtgtcattgacgtctttattgacgtggttttaccgcaacttcctcttttcgtagattgaatgaggaaccagcgtggattccaacgctggtttcatcataaaccaccgtgaaaaccagacgcgggtttcgacacgaaatcgcgtcactcacgtacgtagattatttcgaaaacctacgttaatcctgaacgcgtttcgtgtcacgcgtccttacgactcacatctagctcgtcttctgacgctacccacgaatttcgtaaccgaatccgcttcagcgtttccattaaactggcgcaatccacttctgactgactcggtcgctcgatgcgcacggacccgtgatctaacacgaacatagtgtagtgggaattcgtggcaatggacgtcaaccgaccgcagaacccatcacgagtgcgtcgcgtgagaaacatgaccgtgttgacgggggcacgcggtaaccgacgtcgaaacagctcatacagggcgttgctggtcatgacgaccggaccttgcgatagcgccacgcaaaggccaggttacgtaggtattgtttcaaggtggtaaagtagtgcaggaacgcgaatagcaaagcgcataaaagcagggctaggaggacactgctgatggtcatggtgttatagcgtttgttagctgtcggatgatcagggacctcccccgaggaactgtcgtcaggtgaggtaacgctgatggggatttccaccgtccaattaccgtgtgtaacgcggcaggtgtagttttgattgcaaaagatggctacgtaacatccctgatggaaagtcccatcgaaggtgggaagtagcggattgcattgaggctcgctatcatcgggcgccttattaccgtaatggataaaagtaatattaatttcccctggaaagaacccgtaagatgtacagaacgcttcagctctgttgtcattgtggtttcggacaccgcctttcaccactgggtgggtgacgggggtctgaaacccgctatagatgacggaccactcggtgcagttgcccataagatagttcctttgtattgcagtatccccctcgctgatgtttttaattttaccgtcgatgtacgttttgttttgcttcaaccaactaatttcgtaattggggcccgtccatagtgtcaggttatccttgagctccattaaagtttccccgtcccacccaaatccctcgtaaccggctacaaaactaccgttttccgtggtattacactcgtgtgtccacgtcagcacgctctgtgaccggtaacccaacgcaatttccagctctaacaggttttgctcggtttggttaaaaataaggtcacctttggctttttccccgtccaggtaggtggggtaggccgccgagacgttggccatccaagaaatggtaccgttggcccgacttgacgttctatcgctggaattaacgtgataggtaaaaaagtgttgcccgtcaaaaatccccacgacggtcaacgtcatatgcgactcaccgaaaattcccgtgtacccgtaacgcaacacgtgcattcccaccactctcaacatccacagcacaaataacgtcagacaccacgttgtcatcatggcgttttattaacagttcctcggacatgatcggcgttatatactttcagtccacgttttgacccctcctatcttctttgatgatgtatcctcttagccgtgtgttgtttactcctcctcttcgggagaccgtgccggatccgacatcagtggctccgagtcctcccgaggaaagaaaagtcgtcgaaacagccagcacaaatcgtgccaaaacagaaggacggccgccttttttcttcttttgggaatctcggcgggcctctgggggccgcacggagcgcgacgtcgaggtagatgtttgcggcgcctgtggtaaaccgtggtgtcccaggatctcttagacacctgttcgtccagaatcaacatttccaaccgacagtgacggggccggccgacgaagtgtgtgaagagcgcgtgatccatgctcgtggcaacggcgtgccgcgctcgtgtcaaagagacccgtccacgggggacatggccttcttatagcagcgtgaacgttgcacgtggcctttgcggttatccgttcagtcctcggtgcgtaaccgctggtatcgatgcggcaggcgaatgcgcagccgctgccacagtcgctgggggatccgtagggccaataagaagaagaacagagtgatggccgagaccaacacgatgtctctcgccaaggtcgcggacagttcctcgtcggcgcttacggaggggtgtttggcgagcccggatccgggcggtctcggatatagcgagcccaatcggacgtggaggcgctcgattattttcgtcgtaccgttctcgcagcgtaaacagtcataacggcccacggtaaggttagtgaccatgcggctggtgtacagtttagtcacagggacggttcgcattttcagtccgtcttgcaagatgttggtggtgatgtcgctgaaattgcggatcaccgtatcgttctggtacaaccacaggtcaaccacagactcgttatgctgccaagtaaaagccacgccgatgatctcgtcctcggtcacattctcgtagtagcagatagagatacacatcccgtgtaacgtccacgtttccccaggacggatcgaggccaactccgtcacattcaagcggcaggtagagtttgaggacttgctacccaggtcaacagcacacggggaagaggcagataagcaaagaataaaaaacacccatcccagcggtaccgtacctcggcgacgctccatgccggcgcctgacggtcctttgtgcgcgctccccataagtacccaggcttttgaccccagtcggtacctacgtcagcatgaagcccggtgtccgaggaagaagggggagaggacaacgaggtccccggtaagattaagggtaaacatccgaaaccggtttatccccgccaatattcccaataaaatacaaaacacgcgttccttgatatggattcaaaatttattgtgcgcgataccgcatcgccaaccacgaacacagtccaaaaaacagaaacatgaaccacagcccaatgtccgccttctggtgatcggtccgcgtacaggcggacgtttcatttgccgaaccgcgtctggtaccgctactgtgggcgatgggaccgacgtcggagtcgcggcgttcgttggcgccgctgccgcgtcgggtaccgctgtcgcagatgagcgcaccgacggcggagccgcgtcgctcgccggcgcccgtcatctgacactccgttttccttccgtgactgcgaatcatccgcttcatggctttcctcgtttactcccgccgctgctcttcctcagagacggccgccgccgctaccgcagaggcttctcccgcggcagtttcctccgccgcctcgctttcctcctcggtgtttagacgccggtacgattcggaacaccagtagcacagcaggtggcagagggaggtcagggccaccgatcccgcggccagcagcccgatcttcggatccgtcagccagtaatccctccgcagatgatagcgccgcctagcgccgtctacccgatggcggcggctgcagttgttgtccgcgatgctctggctgatgaagggcacgcacagttcgcgctcgtcctcctcgcacgagggcagcagacccgaggtgccggggatgtagtggactacgcggtgccgttcaccctcccaaccgcagtttatactgcgcaacctggagggatcgggcgtccacaggtaccgcgtctgtgagcgcgatccgaaagccaggtcgcaggagcggtccgagtggcgcaggtcgtgcacgtcggccaccagcgccgtggtctcggtcgccaggctgtgggtctcgttgcccagcacgcaggtgtaggtgcccgcggtctcggtgatgagacgaaacgagaggctcagccgctgcgccgcgccgccgtcctcgaaacgccagcgcccgccggcgatgtaacagctggcgtcgttgtgtaacacctgaccgctgcgtgcgtccaccaccagcgaacgcacgatctcgggccagtagcagaggtggactcggatagagacctctggccagtcgtgcgcggggaagatgcaggccacctccagacggtcgccgtaaggcagcaactgcggtgagcccgggttccgctcgcggttgcggtcgcgcaccggctgcagacagggcgaacgcaccaccggaggcgcatcgagacagcagttgccccactcgctccaggcgatcagcagcggcagccacagcggcggcagccggccaccgcccatacctgtctgtgtttcagagctccttaaaaagaccacacgcgaccacatattatatataaggtgcgattggcagattatctttattggtagtgtttgacacgcataagcgaccggggatggagggaaataaaggaatggctcggtgtattctaaatcgtcatgggccgtcgaaccaggtagctcgagacccacagtcctaagcatagacgaaacagggcacgatgcgggggttcgcggggcggacaggccacggtcagcgtatttgtcgtcattggcggcgattcacacggtccaccttcctcgttctcctcctgtgacctcctattcagttctccttgtcccgctggataagtgacctgcggctcttgaacctcatgatcatcatcatatcttcccgcattattccttctctcgtcgtttccacttgctcggctcccatcattcccttctctcgcgccctctctcgaaacgtcctccacttcttcacgttgagtgtgcgttgaatttcttgtctcctctcccgtaagctgttgacgtggttcctcgttctgccggagcaccgtgggtgccggcggtatgacggccagttcttgcgcttcggccgccgggttctgtcccggaacccacgtgcgacgccaaaacgtggttctttccacgaaccacgtacgtactcgcgtggccgtctggctcacgacgttgctttcctcccagcgggttctgatttggctagagacctgctgtgtccaaccgtggcaccgtaggcggaacagctgccagcggaccgtcagttgttggcgtagttgacggagtcccgcaccgccgggtcgcggttcgccggtgttgggaccgcttcccgcgggatgtctcagacgcccgcgtccgaaacaccgttggttggagaagcgtattcgcgtcaagagcagcgagtcccggctgcggaccgtcagagcgttatagcgccgtctttcgtgccgtcgccgcactgcgttctcactcgcgtcgtgcctgacggtgctttctgcactatgtggtgattcggcacgttctgcgtccgcgtctcgtgcatcctctgccggctgtgatggtggatccggaggggggaacgagggtctcggaatcgcattgcgcgactgatttcgccgccgttgttcttccaccagatattgcagctcttggtactgccaacgtatcccgtctcgcgacggcagttcgggtgatacggcgtgatgctgtgatgacggcggtctcaacggccgcggggaacgcacatcgtagacgggcaaatgcgggagcgatcccgaccaaagcggcggtcggtccaggtcaacggcgtttcgccgcgtcatgaccgacgctgctctgacttggaatccggcgtgctgcatggcttggcgcactatggacagctggtacgtcgctccttgtatctcccgtagccactcgtcctcctcgacaatgtctaagccgtgggcccactgcggccgctggaaaaggagcaagaatggcagtctacacagcagcagcgggagcagatgataacgcaagaagcgaccgcagtgggcccacagcatgctcttggtctttctagggccggtcaacagctttatgaaggaaatcagggacgtcggctttggaaagccccctcggatcctttcggtatcgagagcgcgcctggcttcaaatacgtcaaaggcctgtccgccgcgccagctggcacggagttggcgtttcacagtgatttcatgcaatcatttcctacgcgacttgctcacagatcggtttgggggatgagcacgatgccgtgcttgtcatgctgccagagcaaccacagcttttgtggtattcgaaagtagaaaatgataatgatgataataacgattacgaccgctaaaacccagagggcgtgtgtagccacgtgttggtgctgtgggcttggttgtaacggtgtttccgctactgtggcttcaaaaccaacgtgatgttctacgtgactgttaggggtggtggattttttgggactggggtgtttatgatgggtagtgcttatcgtcgtcttcttggcggtggcggttgttctcgtggtggttgttctttgtgttgtggtagttgtcgttctcgcagtcgtagtgggctttttggtggtggtagtggggaatgtaccgttttcgttcactgtcagattgtaacatgtgtctaaagtccatcgagaaccatggttatgtcgttggtgaagccaatggtctagtgatgtcatagtacgataggtggtgctatactgcgtggtaacgttaatgaggagaaggctgtaattgcttagacatgaaaagttaaagcgcgtattgttaaatgttgttgttgatgtgccagtgaaaatgcataacatgtagccttgcccacctggaccgtatgaccaacgaacttgatcgcgagggggaagaacatctaccgcgtttaacgtaacgttggtacctattttgccgaccaccggtatgcaggcatcgtggaggctgatgtagacaccaaagatgcatgcagccgttaggtaaagtaccttttcgcgatgaaaggtaatgtacctgaacagcattctaccacaggtgatttccacatgttctcaggttccgtagggactgtccctatattcaaacagtgagtttgaaaccgaacatatccgtccgctcacgataattagtccgtagtgggcaggccatcggttcctttgtaaaggtatcccttggtgtcccatttctctcggagtctttgaggaatcttgaagaagaatagaatgacgactatgataatgatgatgataatgagaatccatgcgctgtgtgcggcatctttggttcgatgtgcctctacgttaccggtaaacgagtccgcaaagccttttggaaaacccgttacattgtaatctttaggtgacgttctccgcgtggatcttttgtgctgcgtatgtttatttggcgtggtttttaatcgcaacaacgtagttttttgttcgggttttctggtcgtagttctagaaatcagcgataatgtaaaacatgtgggaaactcacagttaccctttggtggacattttcgcctgcaatagtttctgggatctgagacgtttacatgaagaatgcttaatgtggaattgtgacactcgtacaacaatggtgatggcaacggagtagttttcattgtcttttgtctaccaggtttaggagggtcgtaggtgcagataggatgcgtattttcgccgttgccgatgccgacgcatgactggttataccagtgtactttttgtcctggatgataaccatgtccactaccgagggtaactggatcacctactctgacagtgacctccatacaggtttcggaatatctgtaaaatatcattgcggtcacgacggaccatcggaaaagatcatggttcacgatatggttaatcagttgccgcataacacaaacacctgttgtataaccacgtatatgtacgtcattatgtttacggtattcaaacagtgagctgaaaaataaacgtacatatctattctttttacgttttgatttccttggcgttgattctttaagcggcggcgagcataccgctgtatcggtattgtgtgaatttattccaagctttttgggggaacttgaaacaaattaaaacgatgattgttataacgataactaggggtatgatccacattgtatgtgaagtggcagtgtcgtgttgtgcttcaacgttaccggcggcgtagtggaccgcggtatgtgtgaagttggttgaggtgaatgactgtgatatttataatgaatcgtgtacagatgtaggtggatacagggatgatgtagttgtatggcaatgtgtttggtgggtaaagtgtacactaacgttataacacaagttattcggttttggtactccttgtccgagatatttaaaagattgaaaataatagtttctactgtatgttgtggttaagttcatgagaattagtgtacgattatctgtgcactgccacataatatttggagagtctagattggattttatgcgttcattactttgataaagacataacttgttagtaaccattggtttgtctatgtaccattcaaaaacatcgtcttgaaataatgagttattaagcggatgcaagctaatattatgactgccgtatccaactgtaggggtacatggtattgtcatatagttccaatactgggattttgatgtgtaaaataaaattgttatccatggaaatacctgcaaacgcttagacatcactgtcacagttccgtgtctgtcataaacacttgtccgtactgtttactgtctttccagtgatggtagatttttcgaggtgctcgtagacagatgataataaaaatgatgagaatgatgacaatgattagcatccaagaataatgcgttgccgctctttgatattgtacttccccagccgggtattctacaggttgtgggatgaccgtagtcgcgttgctgaggttgactgcagtctccgtgcttttcaacagcgatgcactgcttcctaacgttatccagtcactggtatttgtacgcgttgtattggcagtttccgtgagttcataatttccgtcataattttccgacgcagatagtctcgagctagtcattgtgggaacaaaaccttctccctgataaaaaggacattactataactctgatttactacacaacaacttccaccaccccataatacaaacaactatcagaattaaaaacacgacaacacctaccaaggccaggtgcgtgttgttttccaaaggtgtctgattggagaatccagcgacggcacgtagttgtggtgcgaaactggcgttccacgtaacgttactttttgtgccggtcaccgtcggtatcgtcgtgacgatggttgttacgttactaactggggtagtttccaaagggttgggtttcacggttaagttataccacaggaacgtttcattttcgtcgcttctcacaaaaccttctgctccgtaacgaccggagtcgtttaacgtgaggttgaaaatggtgatctggctagccgcacaacttaggcttaaacccacatagggcgtagagagaccctctccacgtttgtagaagcaaatgaggtggctacagttgccgttccagcgaaaccaccgtacgctgatgttcgaagtgaagttagacaccagggtaacgttccctccctctggtgcatacacgtagatgacggattccaaaatcacgggggcaaacaacgtcaaaatcaatagtttattgtacatatgatgcactgtccaacggaatcgtggaaccgtcagaagatgggaacccgcgccggaaaccatgatttatttaccacgttacggtttggaaacagtcacgctcaaacagtgccttttatttcctacgttaacaaaccacgttcttcatcgtccacgtggcttcgccagcgtcgccaagccgattgaggcaaacccaaatcaacgagcaccatcacggcggcgaacagcagcatcgcaacaccccagctgccgtaggtgaatgccaagttagttatgttcttggataacgtcccgttttcgacacgccgttgtcgttgataactaacgtgttcaaacgcgttcgaatttaccgttagagtcgacgtaatgggtgatacatttgccgtggcgtttgtaactaccgtgggtgttactacggtggttgtgctctgagccgccttaggatgaactgtcaggtcgaaacaagatagtgttatatgtttgtcggtacagttgtcaccttttcgataataagtgccgctatgattttgggaaacgttgtatataaaaaacgttgtcaaagaacagccgaatgctacacggtgtcttaatgagactcgggtatacggtccccatagggtacaccacggccccaacgtgctcccattttcgtaacgtccccactgggtcacgttacaacctggtgacaatgtgccgcacaactcagcgttttgtcctgctgttctagtcaccgtgctgcagttgagtggcctgtgaattatcacagagctcgtggagcctttaaaagcacaaactatcaaaatcaaaaccagcacgtatctggaaacccagactttattaaaaaggcagcttgtcatgccccggggcgttcgggcaaaagctaacatgttgagtgctacatatgtgcgtgagcgcgtattcaaacagtgagttactaagcataccccagcccgcccgttcatcttagcatgcattacccgaaaaggtccctcccaccccgtttcagactctccgactgaaaacaaatacgcaaaagcgaaaaacaaactatacacagctagctaattagctacacggtggcgacgagacgttgatagcggtatttcagaggacgggcgatgtcccgtagacggtctatgcagaaacgacagatggattgcggcacgcgaaacaggctggcgaaaagcgtcaagagtcctagcaagacgaagccggtgacccaggtggtgtggaaaatcaggcctccgtagaactgcttagtgatgatgagacgactccacggaacgagctcttcttcccgtgacaacagcatcgaccggtcaggaggcggcgcgatcgccagggacggtgtgcgagtgctcatgccggaggtgaatgctgcttcgtcccttgatatagccttgttactctccgcctcggtgatgtcgtaacagcaggactcgaacgtggcacaatcatggagacgcaaaccgaccaaccatacaacaaacacgagcgtcaagcgtgatctagatacacaatacacagcaaagccgggatctacacagtcagagtagcctagaaacatgttagcgccgtaaggacgcttaacatttcaaaagcaacgtaaacacaatagctacagccacgcggctctgtggaactttacatgcgtttaggtcacggtcaggttgtaacaagagtaataaaaggtggaattcacatcttctcgtttgaaataatactttccgctgttttccgtcgtcagattcagcaacgtcaggcggtcataggtacagttatacgtgagattcgttattccatacatataatgttgttctttattgccttggagtttcggaaaaaatgaacaaatggacttatgaccccaccctaacagccagtgcaaaaaatcttccgttttgttctgaagacctcgaaatgtaacgttgccgttgacggtccctgagtaattagcgcaagtaatattcataggaatctgacggtcgggagacttccattccacgggagcagtcgtcgtgctgattgaacaactcacaaaaatacaaaaacagtacgcgtcaagcagtaccatcggtaataatatccacgttctaagcatcataacgatactctttcagtctcacaatcaaaatattgcactgatagtggcgataagtgatgcaaaaacaaaaaaaaaaggaacgtgctataatccgggtcaccttcaccgtatccggacaacggtgttttatggacttatcgcttaaggcgggatgtatttgcaaatcagtagagacgacagtttcttcgccgagagaaccagcggctgcatcacgaaggcggcatctgattccctttatctatttcactcctcatttatacatatccagacctcatgtgataccaggatcatcttacggggaaaaacccttctcatatccagtcattgggtcccgtattgtcccttgagaattcctcactatcccccgagccggaacagaacaattccaaaccggatacgctacataccagccacacagggtagcgtttagcatggccgaagactcggtcacgatccttatagtcgaagatgacgacgcatatccgtcgttcggcagcctacccgcctcgcacgctcagtacggctttcgactgctacgcggcatatttttgatcatgcttgtcatttggaccgcagtgtggctcaagctgcttcgagacgctcttttgtaaaaacacgtagaaaaatctatgttttatgataacatgtcactaagaacctgtactttatttcaattacgttatcatagactgtaccgtcctggggtacggtatgtgtcacgcgtctttctatgcagcgcactgtacgccgatacacgggagtaacgaaggaaattctactcggaaatccgccttgtccggagacggagtaggaacacaatgacgtttaaagtaaatacaaatgaggcacatgatgcaaataaagatgatacatagaagtattttattgcgatccttcatgacggagtggaaaagcgggaccttacagtttttgagaactacacaaagtagtaaaaatgtaccctaaataaattagcgttggtactttgtgatcacattgtgtggttgacgttgtttctagttcgtagtctgtgcttcagggttgttgtaacgttaacgtaagttaaaacgcagataattatcaccacggtggctgtccaaccaacgtgagtggctacgtgggaattggtgcggttagaataacgtgaagacgagacagtaataatatagtgagttctatttatagtggtgttacagttgtcaaagtcctctacgttatgtttatgatcatcgctgatgttgcatggaatgtcacagtaataaacgtttcgggtataaattcctgaatcatttgtagttacgttgtgtagtttcagacctttagtatcgtgaagacaggtaaatcgtgggtgacacgacttgttttcggaatattcagcatattccgagtaaaatggtgtccaaccgcaaagttcgcagttattgtgattccagtaactagaaaagttgcaggggttatcactaacgttaaagcaaattgtatctccttcggctactgtgatgggtatttgtacatgtccactttgcagcaagagctgctggtaggatgttttttgtttatgtggaattgcctgtaccagaatgctagataggataattgttattagtacggctagtagcagcagtttactgttacatcgtacactcatgtttttaaatgtctatggatatcccgacttataagtggttaactcagaataaacacacccaaacattaatgactaaagataaaaaagtttattgatgtgcatattaggttttagtccaagactcatctggatcgtatttaggaagtctggtataacgcggtttcctgggtctgcgacggttgcccatatatagcgctatgagtgccaccgatactactatacccgcccatacagcgtgaattcccagaggaatgttggctttcttaatagtttcaataatatgtttcccgatttcatggttagtagtgtctgtattttctgttcgttttctatcacacgttctgttggtaactatggatgtcgtgttggcaaaaatcaccgtgaggctgtagcatgcttcttcgtattgtcatggcgcgttctcttgacaacgtactttccagaatcgtttaacgtcagatcgtaaattagaagttttgtcatgtcacaatcaaagcaaagagcaccacgagggaaagtatgatgataattgctggtaacggtgcatattggttccgaggaataaagccagcctggagaaccgtaccggaaccattgaatgtaattccatgatccagtgaagtttagagtcacttcttggccaacatatcccgtgatattatattcaaatcgcgttttcggggttgtgatagcattactcgtatgactgcggttggtttgagatattatggttgacgacgctgcagtagaaacgactttgccagtcgttactaacgagggtgtagtggtagcaatacttgacgttgtttttttggaatttgtcgtggtagttggagtgatgtttttagacgttgtttcactggtggatatgctaactgttgtagaattgacacaaatgcaggggcacggacaagtttggttgtaacattccgaaaacgttaatatgattaccgtccatgtaatcgcaagatgccagtgcatggtaccgctattggatggatagacattagtatatctttgctgtatttcatggtagatatgttacttaatttcatgtgttgcgtgtccggaaacgtcagtcttcatgttcaggatgatatcgtacaacaaagctagattcactaatatcgtcccgtaatggacggtatcttttattgagggctcgtcgaacaaaaaacagaagtatgcaggctatgcagattagtgtaagagcccatgtagtgcgcgtgccatgtgagatgtcacggtgacttgttttgcgcatgttattatttgtgatagtgcttagtgtataatcgtcgtcttcgtcttcttctgattgtgttcctacgtatctgggacatagtggggtggtatgattgtcagtgtcgtttctgggatttacagttagtccgaaattttcatcctcgtgtggtccatcgtggttgtactctttgtaacaccgtcgactatatctgcctgaatttgtagtgtttaaatcgtatatacgtagttctgtcttattacacgaacggcatagatcgtggtacgccgcaggtgatgagacgtcaggatgacatatgggatgtgatgttaagatcttgtgtcgatacgttggcgtttggtaacgtctattgggataaatgtggtgtccatgtgtagaccaattgtaatgtcggtaccaaactacattggggcagttccatgttgaattgccctgtatcgtaatgttttttccttcttctgccgttaatgtagttgatttaacacgtattgttccaatatcttgttggcaattttttgaacttgaattgtttgtttcattagctgcgacagtacaattaacagcaatcgatgttacaggactgtacgtagtgttatgaatggttgacgcgttgatcgaactttcgctggacgttatgtctgtagtcgtattatccaacgatgtggtgtataatgttgcgttgttggagagtattggggaatttgtgtgggtactggagagagcagtaagagttgaagctgtataagacgtagtgttagtcgaggtgtttaacgtagttatagaagatgcggccaatgtatttgtagtgctggatatggtgtttgaggcggttgatatctgtgagccagtagatgtatcaagagttgtaaaaaatgtactgggaagatttggagtagagtacacactagtatcagagacggtgctatctgaagtagacgtagaattattggtatcagtgctgttacatttgcccctatatacaatgtagaaggtcaggattatatataccgtttgtcgatacgtgaagttgttgcgtttttgacggtcaacacgcatcttttattccaaatctccgtccaccgtcaacaacagaggttccgtatccaggtccgtccgcagctgttcagcgtcctgttccccgattcgttgcgaccgcagaaagcagatgaccagtgcaccaacaaagatcatcagtcccgaaacccaggcgcaatggagtgagaggccggaccactggcgttttaaatccgagataattgctcggtctgcctcttgggaatccgtaaccacaactctccctggtcccggataaaagcatcgacgcgtttccaaagctcggcagaagctgcgtgggtggatgatgaggtagaaagcctcgacatcgccggtatactgatcctgcaggaggtagactcccgtatctttaaccgtaagattgtacagcgtgagattttggcgcgtgcacgtgaaagttgcgccaccctgatgcgtggtttctttataggcgtctgtaatgatgcaaagtggcggcatacgacgcatgtatctgctgtagatatcataacgttgccagactacgctgtgatggctagtgttaagcctggtaaccagagtacgtgtacggtcctcgcaggtggcgcggtagttggcgagctttaggggttttttggttggttcgacggcgttcgatgaacttccctgagttgtgaacaaaaacagcgacgtgactatgacaagcgtgaggggggtgctgtaggtctgcatggtgcaaaacacgttctcgccttccttgtcagacgtcgtcgtcctcgtcctcttcgtcgtctgtgcccgtcggttcgatcaacggggagttgtcgttctgtctggagggtcggtatggaatccgttcgtagatgttctgctttttagccgcgtgttgttccagctttttgcgtgtcaggctccgataggccagacattgatctacctcggtgcccgtgttgtttttctcctcctcgcgcgcgtaaattacgaagaagaccaccagcaggactatcagcgtggccacgaacgagcccgcgccccaggccgagtatgcgcctagcatggtaatgggttctgtgacccggcatttgcacaccgcgtggcacttgctgccattgttggtattagatgtggtattcggattgcacttacatgtcaggtgggtattttctgctttcacgagacagttggtggtaaccgtgttttcggcgcaaacggccacgtagcttatcaagccgagtgctaaaaagcacaccgcgtgcattacacgcggatacatattaaaacaccgtgttccacaagcaccgcacacgtcgatcctccccgcacggtcttcagcccgcccatgacatgatctccctcacgttacccttcaacaccctgtagtactctgtctcggcttccggtccccatgtcctaatcataacaaaacaccgtgacactgtccatctccctgtcttttcgcgccgccggtcccccccaaatcatgtctctagatgccgccggccaccaaccggaggcacggcggctattggattcggcattggtgcgccgcgtcttggcctgcatgatcatcgtcatcatgattgccattagcatctggatcctgacctacgtgctgtttctctaataagaaccccggcccctgacggtaattttcctttcttctccgtttctcctcagctgccgtacgtgatgcctcacggccatctccgacaggtcctctccccgacctcctggacatgtgagggcttgttgctcctcctgggattgctggtgctcttctttcaccaccacaaccagtcggccgtggagaggcgtcgccgcgtctcgttcgtcgaggccgatcgactgccgcatgagagcgggtggtattcttccgatgacgacggagaccgggacggcgatgaggaaactggagagagccacaacagaaacagcgtgggactgtccgctgtttttagctgagactggcgtgcgacctgtaaaccgttactcgggtctcaagatggtttggaagttgtgactcatcttcctgtgggtgatacccaaccggacgcgagtgttccataaaagccgggcgctccggcgagaccatgccatcctcgccttcggacgccccgctcctcttctttctcctctcctccccgctgccgcggccactgccgccgccgcccataccatcggcatgtcggccgacaaatcgcagctgtcgtcgccgccgcagctgtagcagttaacgccgccggcctccaggaggagatggcgctctgcgtcgtctcttcgtcccgtctccccctgtggtcgtgggtggtgcgagagtacacgatgggtggctctcgcctcggggggaccacagggggagggggtaatttattattcgtattactgtaattttgtatcgcttaatttgtttagagccgcacgcttgacaacgccttgtatagccttatttatcccgatgacttttttctccgtacaagaaatggacgtcacttgagcagacacagtttcatcgaccacgacagtctcataatctgactacctctgacccgccaacgagaaaaccgaaaagtaaaagatgaccgcgccctcggagtccttttttccttttcaatcatgaaagcaagaggcagccgagagaatgccagtaagagacgaccatcgcagacacagtacgatactcatcttagaacgaaccagcgaataaccatcacacgtacagcagaatctcatgaactagtcaaccaacgtcataaaatcttcacacaatcgtttttgcgaacttttaggaaccagcaagtcaacaaaagactaacaaagaaaaaccatcttggaattaaaaaaagtagcatcgttaccttatgaaccagcagcattcagtatatacaccagatataatatatttgttaatgtatcctctctttctcctgatgtaattttgtttttgtaaattcaattgttgaaagtctctccctgggggaattgcatatcttattgatgaagaagaaatccctgccatatgtgttgtcaaactatcattatttctctatatgggtattttttttctaagaagcaaaagactagcagcagccaaaataaacctgatgaaatctttaactgagcccccggtggtctgtgtgtatgtttctgttggtggttggttgtctggacccgggtgggttgttcggaaacggcgggatgggaaacggttgtaaacagcgtcgcagtatacgtgacttttgatctaaacggacgtcgctaggctgacagtttacgagttgtgaaacaagatggtcaggaacaaaagcggggttttccctggtaggatttcctgtggaaacaataaccggatgttattgtggctggtacataagctggttctgggtgcaagcgcagtttactgcactaggttcggcgttagcttttgcttgggaacgctatggctataacgggaaagaaccagtttggcagcattccattgtggggggggggtacttatagcgtgtataattttgacgttgaattacagagtcgagggaatggctaatgttcatgtaaagaccggtgatgataaaaccgttagtgctaacctgaaaacggtttggtcgttttttgatggtaaaaatgataccgacgtgtgtagtgtggaggggacgaagaattacacgctagcaacgccgccgattcacggtgtgtgtaattgtagtcatacaggattgacgttttgcaacgtaacgcaaggcaacgaaggatcttatgatttaaagcggagagttgataacggtcctgaacaagtggatacttggtttcttattgtaactaagtaacgttgataattcaataaataaacgtcagtgcttttgtgttgcgcatatggtggattgacagtttggttttgtccgttgacctagttagatttcctgtgtggaacaatgaccggacgtacctggactggtacatacgcagggttgcacgtggttatcggtcactggactcggttttgctgtagctgtggttcatcttgaagatggctcccaaagctgctaagaaccggtccagtcacattccttggtggggggggggtactaataacgtgcttaatattggggtttaatgatggaatccagggtatggatatgaagaaactgaataccacgcagggtggaaatcttactatagttgatgatagcggccggttttccactgaatggaaaagatgggataacgatggagggtctctatgcaatgtgactagtaatggtacaacggtcgttaataccacagtctgtgtttcaagttgttcgcatacgtcgcttgtgctttgcaatatgacgcagcagactgattcgttgtacggagtgggtcatcggttgaatgacgaagaagatggtgaaatgtggagagtttcggtttcttaataatcccatacgacatgtgttcatttatatctgaattttaggatgatgactatagtataactctggggaacaaatatcatacgttaatcactttaagttacgccgttaggaaaagaaaatcagtccgaatgaagcatagtcagccgaatgatacagcaatagcttgtttacaacgtgttcttttttacattatgaacgtgccttgctttttatacacacatggagacagaggtccttcagcccttgtcacgacaactccctttttctaaaccgtatgtgctccaaaccgcatctcctcatcgtcacgtgaaataccatgggaccccttttcgtcacacacgtctttccgcttactcaacgcgtcagcccgcgctcggcagagctaccatataaaaacgcaggggtttagcggctttcccagatcgctgctgccccggcgttctccagaagccccggcgggcgaatcggccggctggtcggtcggcgctcggacggatggggagaacggcggtgacttagccgcccgtggccgggagaagacggaggagccgagatgacaacagcagtcgtggaagggtcgccaagccccggtccttctcttctgtctggtcgaatctcgttttcttttttcaaccgctctttttgtcacctttttatgtgagtttctcttccgcgtctcccggccgtaccatccacccatgcagcatgcacgcgtgtatgtatgcatgcatcgtctctcctccgtcccgactaccatcagcagcaccactaccgccacccccagcgccaccaccgctgccgtcgccaccgcgttatccgttcctcgtaggctggtcctggggaacgggtcggcggccggtcggcttctgttttattattttttttttattttttatcttctcctttccttaatctcggattatcatttccctctcctacctaccacgaatcgcagatgataaacaagagggtaaaaagaaaaaagctacagacatttgggtacctcagctttccgataactcgaagaattcaaagtcgacgattcccaacaagagaaaacagaacaaaaacaaggtcatttttatttatcctcatcgtcaacaacaactaccgacaacaacgaaacaccaccaagaatgtcaatccgcaagggtgttcctgccccctcgacgcgcctgtcgcgatcctcatggcgaggaccgcgatctccgtataggtagatgaaattatcccgtgtccggtcctgattccccgcatgccctgcacatcctgacgcgtcggtcagcagccaaacaatcataggaaatgaaccagaagaacaaaaagatcatctctctcggtgtatagcaacaccaacaacaaccgcatcgcaacatcttcatccgcaagacggaaagaaaacaacaataatgagaatgaaatcaccacaaccaagccagatttcacgtccatgagtttttattatattattatcaaaacgaaaaacagaaaaactgtcatagataaatataaaaaaaaatagaaaccacaaacgactactagtactccaatcttagatgtatatgctcctagataagatttagtattaccataatcatcgaagaatgaaagacgacgatgattccttaccgctcctgccacccggtctgtatgtagagagagaagagagaaaacggtgaatccaagatccccgggtcggcgtcggcatgccgctgatcgcagtggccccacctcggcatgccggcgccgggcgaggaattgctcatgaaaaaagtatctttctgtaaaaaaagaaaacaatacatgattaaccgaaaagaaaccaacaaaaagaacccgagatcagtcgatttcgatcattacgataaacacatggaagatttcttgaaaaaagaaaagagaaagagaccaccttcccggcggcggacacgctcctctccgtcgccgttctgcaccatgattcgatcaataacaacatcatcatcggagaccatcttttaatcaatcagcgttgcagtagtcgactccctggacacgaaggagtcatccatttttatcctcgcacttcttcgctctcaaagccgcctttaaagttgaaatgaaaggatggaaacatggaatacagttttaattgcacgtatcaccattttactacaaaaagaaaaaaaaacaacttacacatagtattaccttaggtttacggataagtagagtgtaggcgtttttgaaacagttcagccaatgcaatcttgtctcggcataatcactctttctgcatataatagtagtagtagatttattcacatcaacacagcgaaaaactccagcatcaaagtacacctagagacagcccttaaaatatagtttgcagcttttagatgtacttacaccaaagaagattaccgtccttacgagaaaacagatactcggatataggaatcaagacagctctgcactgaaaacacactctcctgtcacgacaccgcgccacaccagaggcgtacgcgtgacttcatcgcaacgatccatcgtgatgtccctcgcagaacctaaaaagaccaaaaaaaaatcttggaccacagttgtcgattcttgaagacaatattctcgtgagaactttgagattcgcacttgaaacctcttaggatccacaaaaacaacaacctctgtatggaaaatgcgctattttatctcagcttttctcccaaacctcggtttcttcctattatgttttccctagtatatttgcctccttataagaaaagaagcacaagctcggtcgcacggattattccttctgctaatctattattttgttccttttttttttctttgccttcacccctttcactccctgtagcaacacagagtagtagacacaataaatgagaagtttgcatgcattttttgccgtgtccgtggtctgtgatagcgtgtggagtgctcgggatgggtggacgtggggacgtattcctgaggttacaaagatacgcggagacgtcgtggcgaggggatgggtttattggatatcggtgaagcagcgtggcggcgaaagacgcgatccctgggctggtagatccccctaccccgtctaccagggacgtttatccttgggacatgtaaatgtctcggccggcatccacgcgccacgttcaccgcgtcgtgcccagcgccatgtgcgggtcgtttcggcgtgaagttggacggcgtagtttcggggattgtgaaccgtggctgagggtgtagaagggacaggaaagagcgtgtgatctggccgagccgtggcatgtgggtgcgatgcggtggatgtggtgggctggggtggttttgggcgtggagatgtggagatgggggtgatccggatgcgtggcaataggcctcgagcttgggcttctcccgcggatggtcgttctaactgtacacggcggccgtggcctccgagtaaaaaaaccaggtgctgacgccagacagagacgccgtcctcggaatcgtgtgcgcgaaagcctgttccgcggcagcgtacgacgttccaatcagcgaggccgtcgcgttggcgcgccaacagtaaggttacgacaggttggcggcccatggttccgaaccgtccccacatgcaccagcagtcggcgtcgaagtcgcttgcgctgtcggcccagtcgccaccgccgcggcggatttctgcgcgggggacggggtagccgagcgctgcgccctcgcctatgttgtgaagtagattggtgagttgatgttgattctctgtgcaaaaatgagcgctttcctgtgggttggcgttggggtatgcgtgtagttggggttgtgtttgagcgtagaggtgttggcgggcctgtgcgcaagcagcgtagtccgcggcgtcgagctccatctgcgtgcggtgttgtttgtcggcgtgtttgtccgaaggttggacatgcggttgtgtggtgctgtggtgtaagggtaacgtgtgttggtgctctgggtgaagcggcgtggtgtgggtgctgtttgtgtctgtggctggcatgattgtgcggcatgtgtgtgttgtagtgggtggaggttaaataggcgagctgcgtgtgcgtgccgtctgtgtttcccgtgtccgccgcgaaaggcccccgtccccgccgcaaacgcccccggccccgcaacgccccgtccctgccgcaggaggcccccgtccccagcgccaaagctccccgtccccactactgtgcccgccgcaaaagcccgcaagtccccgccgcaaaaggcccccgtggccgtccacgcacacccccccgtccccgcacaccccccgtccccggcgcaacccccgtccccgtccccagcgtaactcccgttaccggcgccggcgcccagcacgcccgaaaacaccgccgtcgccgccccgaaaagcgaagcgccgcgcaaaagctgcgtagaaacgccgcacaaacaccgtagaaacacccgccgccaacccccgagcgcccgcaacaccccgtccccggcgccggtccgcggaaaaaaaaaaaaaaacaccgcgggacgccacgcaccggcagtgcgcacaaagcgccggacacagcacgccgcaaacgcgatgaggacgccgccgtgcttacttatgtcccgcaacgcttcctcaaccctgtcccgtgccggactggcggaacgaaaagtgctgtggagccacacgcaacggcagcgcgcagaaagcgccgtggacaacacgtcgcagaagcggcggagcgctgacggcccgcaacaccccctgagccctgtcccggcaccggcggcgatcggggtgtgtcgggggcgcggctgggtgggtgtgtgccgggtgtggcgggtgtgtcagggtgtgccgcgggtgtgtcgcgggcgtgtgccgggtgtgtcagggtgtgtcgcgggcgtgtgccgggtgcggtcgcacgttttccccggggacttcctcttttctgcgtcttgtctcttcgtgtgtccccagggacccgcgctgccgtcccctggggactttttcctcttttccccggggaatcaaacagacacagacgcgcgtctgcttttcgccgtgcgcgccgcacgtcgcttttattcgccgtccgcgaccgccgtccccaccgcaccacacgcaactattcgccgtcgccgtccacacacgcaactccaaatttcacccccccccgctaaaaacacccccccgcccctcggggacccagcacacggcccgccgtcgctgtcattaagcagccaggtcacctcctccgctccgcggtccgccggtctcgacggaccgcgccgccgtcggcaacacggaaaacagcacgccagcccgagccgctaaggccgcatgcccctgccgcccaactgaacacgcataccccgctcaactgcgttttgccacccctgtcagtgctctcgctcgagcaccaccccgcatctcccaacctttttccaataaacgaaaccgacatgacacacgtaatgggtactcgtggctagatttattgaaataaaccgcgatcccgggcgtctcagcacacgaaaaaccgcatccacatcatagacaagttacagtccacagtcacatacacgataaacaataccaacagggtaatgtttatggagtaaaacactattgtccaggccacatgcgtgtatgacttccgcaccatcccgtactgcatgttccacatgtacgcgctagacgtgtaatccactcgcagttcggggacgcaacgcagccagatcacatccccttgcagtaccagacgcagggctagttctagagcggccgccacggcgatatcggatccagacatgataagatacattgatgagtttggacaaaccacaactagaatgcagtgaaaaaaatgctttatttgtgaaatttgtgatgctattgctttatttgtaaccattataagctgcaataaacaagttaaagcggggtttgaacagggtttcgctcaggtttgcctgtgtcatggatgcagcctccagaatacttactggaaactattgtaacccgcctgaagttaaaaagaacaacgcccggcagtgccaggcgttgaaaagattagcgaccggagattggcgggacgaatacgacgcccatatcccacggctgttcaatccaggtatcttgcgggatatcaacaacatagtcatcaaccagcggacgaccagccggttttgcgaagatggtgacaaagtgcgcttttggatacatttcacgaatcgcaaccgcagtaccaccggtatccaccaggtcatcaataacgatgaagccttcgccatcgccttctgcgcgtttcagcactttaagctcgcgctggttgtcgtgatcgtagctggaaatacaaacggtatcgacatgacgaatacccagttcacgcgccagtaacgcacccggtaccagaccgccacggcttacggcaataatgcctttccattgttcagaaggcatcagtcggcttgcgagtttacgtgcatggatctgcaacatgtcccaggtgacgatgtatttttcgctcatgtgaagtgtcccagcctgtttatctacggcttaaaaagtgttcgaggggaaaataggttgcgcgagattatagagatccgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagaagcttcgaattcgagctcccgggtaccatggcatgcatcgatagatcgcagccttaattaaggatgcatgtttaaac

SEQ ID NO: 6 - DNA, 226889 bp, Human cytomegalovirus
ggcgatgaagagccagagtatgggaagcatgaagcttagcaaacagaggatggctaaccgtcgttgcatgttccaggccatgagccaggctaggcccgtacaccagacgcagagcatggatgacaggacataggcctggattaccacggtgcgatcgaaacacagcccgatggtggacacggatatcgtagtgagggtggtatataccatgaccagcatcagggtcccgggtcggcgctgacgttccagccagtacgcgtggcaacgcagagcacagggtagcagtgtgctccagaagggcagtgtatcgcgcaggtagggggtcgtcacgcgccacggtatgagcatgaaaaggatggtagtggctatggtggcgctggtctggaacacgacggtgccgtagagacgtaccatccagagaaagtgttgaacgctccgcagggtgtcttcatctttggtgattacggtgactcgacggatcggcggtggtgacggcggcgacacgggtgggggtttctctttcttatggccgagtggctcgccttggtgaaactggatctgtaccatgacgggtgctagacgaacagtcgtcggggcttcaggtacctggcaagttttatagagaaagggggacgatgggtggtggctacgagccaccgccaccttcgcaatacgaggatctgaaggcggcaaagacggtcgtccagggcaggcgccagaggttgggactgagcacgatcagcgtgattttaaacatggtcaccagtcctacgtagattagcagcgagccgcgtaacgtctgagcagccggcagttcgtcgcggatgtaacgcgtgccgtagaaagtcacggtcatcataaggaagacgatggcgccgtagccgtagagtagaatacgctgatgatggaacacggtctggtcgccgataacccagagcgtgatgaaaaaaacgctggtgagcacccgtgagcatatgagctcccaacgcttagcgcgaaagctgtccccaaccatgacagcgccggtgcaagctatccacagcgtgaggaccagtgtgtagtcgatgaggatggcgggcaggtcggagcaccaggtgtagaaaaccgtggtaacggagaggaggcctacgtagcccatggtcaataccacgtcgtcggggtgcctttcgccctgtatcaagaccaaacaccagagaagggagggggcaaaaaccagcagcagaggggaagattcatgttgacatatgttgtgggaatcggggatacccagccaaatcattccgcagaaagccgtactgatggcgatgtgaaagaccactagggcgtagacccggacgaggacagcaaaacggcgcagccacataaggccgtggtgcagctgcaggagggaagcccattgcggcgaatgtagcgacggcagcggcgggtccatgaggcgggtgatgcgcccgagtgaacgggtgagcgtctcggtggagtcttcttataaaccagcgggtctcaagcaaccctgctctggaacgtcgcggtggtgctgttgaggatgacgctgagcgtgccgttgtcaacccggtaatgatgataggtgcccagcttggccaggtagctgaacatttggtcccagcgtgccgaccacaccacgggcgtgagcatcaggagtgtggtgtgatagatgagtgtctcggtggcgtaaagtaccagcgagctgcggatgatgtggctcacgggcattttggtggcgatgtagcgcacgtcttggaaaaggacagccaggatgcagcccacgaacacggtgtagagacacagcagagtcttatgcaaccaggtgtaagtagaagccaggacgctgaccatcaccgtcaaaagtgtggaggtgaaaagcgcgtcacgccacacagagctgagacggtgttcccaagccacgccgttgcaggccacgaacaacgtccacgttaggatgaggctggaaacgccgatgggcgctgtggcgcacaggttgagcccggcggtggtgaacgagagaagcgccacatacagcgcaaacaccaggccgttgctggggtgtctgtggtcggtgagctccagcgcgcccagaaccaacaccggtgtgcagctaagcaatagcggcgagggatcgtcgctgcactcgtagcccagtgaggggtaacccagccaaaccagcgcgctaatgagtacgctgaaagcggtttccagcgtcagcaatccgtagacacgcatgacgatcgcggtccgacgtagccaacacaccgcatcttcggaagctgtggacgctgtttccgaataccgggaggagatcgtgcttccctcttccaaggatcggaaagtagcgtccgtcgtttccgcggacgcggcttccctggtacgctccgtttccgacgacgcggtttcccgctgcgtggaaactgtctccatgtcgggaccgcagcgcccggcggcgtatccgcaaggtctcgaagctacagcttgtcagaggaaaagtaggtttgcaaaaaggtgcgcagggtcatgattctcagcaccatcagcagagtgaaaaccaggctgagaaacaccttgacggccgccaaaagcgcgcgttccagcggcgtctcgtagcgtacagccagggccgcttcgtggaaatgcgagacggctagacaggtaatgagcacgctgaaggacaagacgatcttaaagcaccaggaccaaccacgcctcaagatgaccaccacgattgccgtgaaggtcaacgtgatcaaagcatggacgaccacgatctgacggcggacggtacgttcgggagccaacaacgctacgccggtgcagctgagaaaggccagtaaggtgaacaacgcggccgagacgaccaacgtaccgtccaggcagagacatatcacgatcaacggcggcacgtgaagcagcgtgtaaaagagcagaacgccgatattgctgggatgcgatgtttcgtaacagtgaatgaagatcaccgacgtgacgggtatgacaaagacgaggctgggcgaggactccgtgagacacagacgggaatggtgaaaccacgtcgcgggcgccgcgtagcagaaggcgctcaacaacgcggtcaagccggccagctgccaacccacggcgccataggtgtgcagcgccacgcggcaacagtcgacccaagccagactgcgggtcgccagccgggtctcttggatcccggggggcacgtagatgaccgtgccatcggtgggtgcttgaaaccctttttctcttctcatggtgcgctgcgttctctggaaacggctgctctgtccgaaaaccagttccgaacgaaaatctagggcgagagggtggacaacggcgtcgacgacgaagcatgggacaggtcgttcggcgttaacgtcatcgcgtcggacgacggtagttctaagagacgtagatcgctcagcaggtcctgacagttgcggattcgcaagatcagaaaaaaaagggaaatgaacgtaataaagagctgtagcgacgtatgcgccacatcgcgtggcataagaacgtgacggacgaaaaggacctgctgcgaaaagtggccggcgaagataaggcccaccgtgctgtagaagcccaaaagcagccgcaggggccaagtccagggccgcgtgaagacgatgagaacgttagccagaaagaccacgacccagacgccgttgatgagggtaaattgatcggacagggtgcagttgtcgcgacagatgaagactacttccgcgcagagcaaggtgatgaccaacgtgagcacaaacgacgtcaacacctcgcggggctcctggcaggcacacgtgacacctagcgccgggatgtgcgccaggaggccggcgagtaatagcaccagctgtcggaacggacgacggcagcgcgggtgccggtttcgctgagcgagaaccggtcgctcatagcggaaatacacgaagagcgcggaggccacaggcaccaggaggagcacctcgggcgcccagacaacgtgacaaggaaagcccggacgcgacttaagagtcgctgtagggaagaccagagagaagctacccaagacggccaccgccgcggagatttgaaacaggagcaagccggcgattcggacgacaacctcgaagcgatgcacccagcccagcacggccaccacggccgcttcatcatagtcgtcgttgttgccgctgtcgaacagccgccgaaacacgatctgtcgctgggtcgcggtgggaaagcgcagacccatgacagccggaggctatatgaccgtgcgtctaaggcgcgagatccgtggggggacttttagatgtttgggcggcccgcggttctaacaggcttgattggtggagacggccggcgcggcgggtgggggaaacgacgagtttttccgttacgccatggttcgcgtgaggtttctctgtacctcccgcaaaaggtcacagcccgaaatggaggccgcgttggtggccccggtggcgcgtgacgataaccaggtcatccaagcgatgagtttgtctaatgagtcctcggtggtgaagaggataagaatgagcaggtacaggtacaccaggttctcatagagacacaaggtgagcaggtcggcctcggaccacgcgatctcaaacaggcgcgtggtgtcaaagaccgtgacgaccagcatgaagctgagcgccatggcgtaatagcccaaaaaaagtttgtgccctaacggtacgggctgcaggtaaagtgcgatcaagaacgcgataacgccgatcacaaacagcgtgatgatgacctgccatcgacggtgattatgggcggctagacccgtgacgcagctgcagaggctaaaaagcacgcaagccaagaggcccgagaaggtcaccagcgtagaggaggagcaggcgctggccacgatcaccgaaagcgtcgtgagcacgctgtaaatggtgagcaggcccgggctcggcggcgacgtgaacgatccctcgtcgcgtttgccgtgcagcagagctagacagatggtgggcaccaccaaactcaaaggcggcataaagccagtgcaacagagaaagacggtgcttttgagatgcggaaaagccagcaccaggcccagacagagcaagaaggtgcaagtgccctgcacggccacggtgctgtacacccgcatacaaagcaaaaagcgacgtacgtcgttcgtcgagacggaggaaatcataatgactccgcgcgagggtcgcgggggtgggggcgcccaggccgtcccggtggcctctgagttcggagacatgacggcggtggcgatcaaaaggcgcgtatgagaaaccgtttatagagtgtaatagaatcaccgtcatccccacacggcgttcccccataaagtcacgtcacactcgagtaagcgtgaaaaagctttattgttgaataaaaaacacaagtacaacaccgagttgcggtgtcctgtctgtctactgggtgggggaggttcatcgtctgtctctggaaggaaggtggggaacgttaaagcgagcaggagcgtgtcatctcccccatctttttataacaagctgaggagactcacgccgtcgatgcgtccgccgtgtttctcggcgtactgctgcacccagacgtggccgctaaagatggcgacgctcatgtttaggagactcatgacgatggtgtacaacacgacgctgacacagacgctgtttttagacaacgttccacgctggtagatgagatccagggtctcgtaaataagcacggccgaagcggcggtcaccaccaggacgtagagtccgctgtagatcttgctgacccacagcacgggcgaaaagtaaagcaataggtaaaagacgatgacggaccagccgtagccaatcccgatgactttccagcgcgtgggattgttgccggccaggtaggtaagaccgctgcagagaacgaaaaagaccatcaccagggcaaacgacagaccgatgacgcgcctttctccgcaaaagcccgtgcacacggtgatgccggtgttgatcagcaagcacgccaccgtgagatgagcaaaattggtggtgtgtgggcgaaactcggcgaaaccgcgtagcatagccagcgtggacacgggtacgatggaggatagggctggcactatgccgttggcgcactgtccctgcacatcggggaaggcgagccaagccagcaagcagaccgtgagggtacaagccagctgccacacgagcccgtgatagacctccatgagcagcttaaagcgtttcaaccattggaagagctgctgttcggccaccagcgcgtggctgcgatggagcggcacgatggtgaccgtcggcgactcatggtgttcggaaaccgaggcggtgtcgcccatgctgccgcttacgaccgctgtcggtctaaggtaggcgtcgatgaaacagtccgtcttatcagcacccggttaccgcggatttgattgacgtcacgagtgtggtcaaaccgtggcggcaccctgtatccgacccgtcgtcatgggctccacaaccagagcctcagaagatggtacatgccgatgaataaagccacattttcgacatagaggcgtagcgagggctgaaaactctccgggaaagaactctgacaggtgatcagggacagatcgtgaattagcatcagcgtcaccgtcaacagcgtcgtcgcgtgtaaaccgagaaagaacggggccgcggcccgcagcagccaaagtcccagcgccgtagcgcagagcagagacaggaccgacggtagccacagccgccggagagacgcgccaggatcgcaacccaaaagcgaggcccccaggcagccgagatctaccgccagggcgagaagagccgcgctgagaaaggcctgcggcgacggctggcacatcagcaaggtcagaaaggctagcgcgtgcggcaggcagtaagccaacaggagtgggagtttgcggggacaacggtcgagcgacggaccgcgtagcagcaggaacaggcaaccgacgggcacgacgaggctgagatgagaaagcggcggtgggtcgtcgtcccgtccccgttcgcatagctcggccaccggtggcggcatgagccaccagctgagcacgctgagggcgacggtggcggtaagctggaaggcgacgaggacggaggcgcgcagccataccgccagcctctctaggtaggggactacctcctcgacggtccattctagcgggacgacatgaagcatggcgacaagcgcggctgctctgaaaacgggcacggttttataggcattaggacgtccccgtcgtactggcggctgtcaaagtcccgttgtccaaagacgcgccgtccgaaagactaatccaacggggacccgagagcatgagcaacaacgtgagaaagatggccatgctgtccaggtagagacagacggcatgacggatgcactggttaggtgggcagaaaaagatgaccatgagactatcgtaggccagaatacccaaaaagaagctgatggagaaggcgcacaacgtcaccactatcttctgcagccagtcggcgtcgcttagcagagcgagcgtgaggaacgaaagcagcatcaccacgtagacgcagctgatgcatttccaacgacgtcggtcacggccacctagaaacgccagccccgtaaaggagataaacaacgccagggtcatcacgtaggaacctactagtacgcggctttcagagcacatttggaagatggccgccgtcaggctgttggccaacagatagatgaaaagcaccgtggcgttactagggtgttcgttgcccaacgtgtacgtgatgaacatgcagacgatgggcacgagcacggtgagaaagaagctgtagttctcgacacaaaagttgcggttttgtgggaaccccaaccaaaaaacgcttcccaagccgaagctgaaagccagctgaaagatgaagatggcgtacacgcgcagccatacggtgaactttttgaaccactcgagagcctccatgcgggagagcagcagcgcgttagcctcctgcgcctgcatggtggcgacggtctcggcacaaagccgctgcggcgcacctacccttctcttatacacaagcgagcgagtggggcacggtgacgtggtcacgccgcggacacgtcgattaggagacgaactggggcgacgccgctgctgtggcagcgaccgtcgcagcgaccgtcgtctgagcagtgtgggtgctgccgggctcggagggcatgaagtagagcacggagacaaagaggtacatgaggtccatgtacaagcagagcgcgcccgggatataactctcatactcgatgtcgtgcaggatgtcctgcgtatcgcacaccaccgaggtcacgatgacggccaaaccggctatcatcaccaggatctcacttaccgcctcgggaaagagagaaaatacggcgaacagtaagagaatcagcgtggatgcacccgtcaatagggaacgctgtaattccacgtcgcgggcaaaaagataggtagcgagcgtgaggaaacaaaatagcgtcactgtggccaccatggcgtaaatgaccgaacgatgactaaaatggaagcctgacgccgtgacagccacgctggtaagcaacgtgtacgtcagtaagatccatacgtttttgggaaagttgggctcggcccaacgcaacagacctaggcacacgatggagatcattaagcaagacagcgtcagacgcacgctggaaaagagctgctccagccggtgcggcaacaccagccagcaaaaggcgcagacgctcataaggatgaggcattgcacccagataaggatgtagatgcgcagcaggaagaccgaccgggctatctggacctgaccgcggagcgacatggcggcaacgccggcggttatcgccgagattcgtctaaatacacaaagcgaactagaaaacgcacacacgtgatttgcaaaaagaaagcagctgccggcttattattttattaaaaatttatctgtgcagaatcataagtttatgatgaataaaaacggggaaagggaatctgcttttagggacccgggtctggtccgtcgtctcccatctggtcgggttcggggatggggacctgtttcagcgtgtgtccgcgggcgtgcatggcttttgctcgccggccgcgctgtaaccaggcctctttctctgtggtcggcgagtcttccgacgggtagggagtctgggagtccatcgcttcaggcccaccgctcgttccctcgaccgtcgtgtcgtcctcgttttcgctattacacggggtttctggagtatcgcctatacggttggcgattctccgggggcggccgctctcgtcctcgtcgctgctatcgccgcccggtaattcgacgccgcattcgttgtacggagcgcggcacatgggcggcggaaagaacttgggcatgcgaaagcagcgttgtccatccacggtctgcgtggtttcatcgttatcctcccataatcccccctgtagcgccggcagcgtttcgacgctgtgagaggggaaggcccagttctggttgtcttgcagcgcgcccgtgggcagtaggtccgtgcggccccaggcgctgctgttgttgggtaccttgtcagtgccgcgagtaggtcgcagaaaccagtccagagcgctctctagctgcgagcgtgtaatggtgcccagtgcgccgtgccagcgcagcacgtctcttttcagcgtgtggtgacagacgggcagctcctccagccgacactcgccgcgcaatccgcggtcgaagcggcagagaccacgcagtttaagcaggccgcacttgagaaacatgtgaaaattatcggcaatgcgatacaggtccgagtcctcgatcttgtgtaggtagaccacgccaaacttgtcgagcagtaccaggccgctgggcacaaaaggcccgtaggccaggtaatagcccacgaggccgacgacgtaccactcgcagcacaagcgttgacgaataaagttcagaagatcgcgaaagtccgcggccggcatgtggtcaaaaggccggcaggcgcgcaggccctcgatggagcccagcatgagcaacggctccacctcggtgcgacccggcgtgcggatgaccaggttgagaccgctcatttcgcgtgccgtcttggccacggccgcagcgtcagtggggtcggtgcagaggaatttttgcacatgatagcgcggttcggtggtggcgaacggcgtttgtgggtgccgatacacatattcgcaccagagtaggccgttcttggaaaaggctttgatatcactggccacctcgtagagcccgtcggtctcccagtcgtagacgtagacggtgccgtaatgacttagcatgagcacgcagggcagttcctgcgcctgctttgtgtttcgtgttagatcgctgtcgggtggacgcacggctagtacaccgacggcttccagggtgtcatcgcagcagagatagtcggcggccagagaacgtgcgtaaatctgcgggatggcggcctgttcgcgcatcactaggaaccagttggcggggttgcgcagtgctacggtggttccttggtggcgctgcacgtaggttctcagcgccggaggatcgtactggcgcagatagaggccttgcagcatcgataacgtcttttgaaagacggtgtttctaaattggaaaacgccgtagtcgcagcggatagcatcttcgcagcgctcgtcgcgctgtcggagataggtgccccaggcttcggcggcggctttggtgagtagggacatgccggcggagccgtctcgacagcgagtcggataaagcgcgctgcgcgaaagcttaatataggagcagcgtcagacgaatcgcggctggtggcccggggggtgggacgcgccgcctacacaaagtgttcccgaaaatcgaaactcttgacccactccggagacaaatccgtattcagattgatgcgtcgcgcttctacttcggcttccgaaacctcggcctccgtccggtaggcgttaacgatacgctgacccaggtgccaacgctctttctctgccaaacgccgttgctcaaaccattcgtctacgtccttgaggtcaaagacagtgtcttcctcaaggtcaaagcctaggtcttcccactcgtcgtcatcgctctcgtggccggcggccatacgcgcggcaactgcgtcttcccctcctctttcaacgttgggtaccacgttgttttcttcgggttccatgggttctgcgccactgtcgtcatcgtcctctccctgctcctcatcgtccgccaaggcgtcgtggatcacctccaggttctgattgtcgggtacgacgtggttatcttcgtcgtcgtcgcgtggcatgggcggcggccgacggcggacaaccggcatggcgcggccgtcgtttccttcgtcttcctcttccccgtctcccagggaacgcggtcgacggcgttccgcgaagtcgccgcggaccacgcgcgcctgccagatggtaaacgcgtcccaaccgtcccagttattgagcatttcggcgcggaaacggtcgcctcgacagagccagcgaaattgccgcgcgtagtcgcggtctacgccgctgtcgaacatggtaaagtgcagacgcgccgcctcgcccatgtgtacgcagcctccgttgcgttccagcctggccgcgcgccgcagaccgtgttcgtagcggcgacgcacgtacaccttcatgaggccggcgcgaaaaagttcctctaggctgtcggccagacggtagatttcaccggcaagacgctgcaggggcggcgagcggtccaggtgcgacttgacgatcaccacgtaaaaacgacagaaacggtcgaagatgatgaggaatgacgtgtcaaagaaaccaccggcgcggtaggagcccacggcgcccagcaggtaccagcggcaacgcagttgcagcgtgacgtacatttcgcactcggccaagcgggcggctggcgctacctcgaagggccagcagtccgtcaagcagccgaaactggtcaggagtttcaacgttttggcatggcgcccaggtgtatgaaagttcacgtcgcgtccgtggtgttcgccaacgcaggcggccaacgcgtcggcgtcatgaccgtgacgcagcagcatcgctaccacgtcgtgcggtacccgcgtagcaaacggcgtctgtggctgacggtatacggcttcggtgtacatcataccgtaacgcgccagctcgtccagatgacgcgcgcacagcagcagaatctcttgcgagggttcgtagatgtagaggcgcgtaccgccacccatgcagagcaccagctccgtctcttcgtagtgatcttccaccatgatcacgcacttgcctagcacgataaggcgttcggggcaacaaatcacgtcgtccagcagctggtcgcgtagctccggcatggtgctgccgggccgtacctgcaggaaccagttgtgcggaatgccgagcgacagcacctggtcgacgtggttacggacccagtcgcgaagcacgtcggcgctgtactggcactcaaagatgccctgaaagtcgcccatgacccgcagaaaagtttcgtagcgcgtgtggcaatagaggaattcatcgtttcgcgtaaacgtgggagctccgtcttcccaacgtgtacgccacatgtcaaaagaggccgccagctagacaccccagaaaagaagcagagaaagagacttctttgtgcgacacgttttattccgcgttctccgctcgacgttcaaatctggatgtactcgcgcacacccgtcaggctctttaagggaaaagggtccgagtacgtcactaaccgcgactgatgcaccagggcggtaatcacccgctccgcgccctcgcgcgtcgacgaacgcgtcgtcaccaggcagtgcagccgcgggcccgtatcgtcctgatgaccagcggcctcgcgctcggctgcttccacaccgacaatgtcgggatccaacacgtagctctgcgagttggtatcgtagcggtgtagcaccaacgtgttggggtccagacgctcccacgcgccctcgtgcgggtcaaaacgctccgttaaacagagccagtcatactgctgctgcagaatacgccgctcgcgctcgcgtcgctcatcgggcaacgcggcgtcttcgttgaagagaatgtcccgcttgtggtctacggcacgctcgtggtgatgcgggcacagatgacggtgttccatacgcgtctgacgttgacgctcgcgctcgaaacgccggtgtcgaaagaccattttcagcaaccccatgcggaaaaactccgtgatggtgttggcaacgcgccgcacgtagtggttggggtcgtccatctggatggcgtacacggcaccgaaccagtccaacagtaccagcacttcggccacaaaactgcgtcccggtcgcggacgtcccgtcacgcctagcacataccacggcgtggccagattagcacggacagcccaccaccaacgacggctctccacctcggtgagcgcacaaaagggccaaatgcggtgtaactgctgcaccgttttcatcagccgcataatcaccgtgccgtaacccggtgtatgcaacttcacgtcgcaacccaggattcgttcggccgtggcgtacgagccctcaggtgtggtgtcattgagaaacaaaacatgcatggtacgcgcgcccttagggtatcgtcgcggaacaggtaccgtcattctccgcagagtggtgtgaatcacgtcgcgatacgcaatctccgaacgtgacacaccgtaacgtgccagttcgtccaggttgtgcgataccaacaccatgtacttttcacgagtgtcgtaggcgtagacgcgagaaaagcgacccataaaaaccacgtacggggtagccaccatgccatcatggtgatcgcgacgtggctcgggcaacaaaataacagcgtatcccaacggcgtcagcggctcgcggcaacagatgagctttgacgccgcctgtttggcggcggtaatgatcccgtcctccgtacgtaacatcacatgccagcccttggggggacccaaggacagacagcgtccctcgttacgatgaacgtaacgcgtgatttccattggctccaggcaaaagaacagttccttaaaatctcgcaacacttgtcggtataacgccatgggatcctcggccgccacaggcagcgcggggagctccggcggcacaactgcagcgccgtcagggccagaacccgcagccggatccatcattgcgcgacactctcagccggacaaccggcgtcactgacagaagccgagccaaatacagagaaagcaacgctacaccgtcaccccgctcccaagcgccgcggaaagtgctccgatttttcaccgtcgttcgcgacgttgatttgcctcggtctgagaaccgacctagcgttcggaccggtgcgcagaaacagccggcggtccgagccactgagcggttcacagccccggccgccgatagttaccggagagacgttcgagctgcaggtacatcggcgctccccgcttcgccaccccgcgcccgccccagtttatactctccgacgccccttccaacgcgcctgtggagggccaatcggaccgcgggagctctccaagtggatgacagacacagccgggtgcccgaccgtgaagagccctcatccacctgaacagaccgctaaccgaaggaccccgagtcgcgtccgtcggtcccgacgtccgtcgccatctggctccctgctgttggctacctctcggatttcaaaaaagagcacgtgccgatgacggtgcacaggaaagagccaaagtgtcacagcgtctttttttatttgtattcctttcctgttttgtactcgtaaactgttgacgttgtttttacatccaaaagggcaagtaagaaacaggatgaggcatggtaggtttgggcgtggggcggccctccagcacggcggcccgggccgcccggcgggtgagcacccggcgttgcgccgtgtctatcttgtgtttcttctgtgtctttttcctatcttgttccgcgacggcctctttcatcacgttcagcatgcgttcctcgacgcccttcagggatcctggggaggagggagtcctagtgaggcttccaatgttgttttgtggattttcggtttcctcttcttggtcgtcatcgtcggacgtgtcgtcttcctcttgatcctcttcttcgtccgagtagtagacgcatagtccttggttcatcaggctgggattcatcaggttctgacggggaatccgctgctgtagacgtttaaccgcccgttccaggcgagagctcatgccgcaccagacgctgtaacgccgcacgggcccgtagcgggctgtttgttcgcgtacgtgatcgttgagctcttgccaatattgtttggcacactccagatcggaggtttgtggatagtcgggtcggatccgtggatcccaactcacatcggcggtgccggagacttcgtccagactgttacgcatagagcaccagtcgggtcggacgataaacctgtccttgcggattaaccatttataacgtagttcgtgatggcgtgtagaggcccgtacacgctccacggtcccaaagcggtcccagaagggaaagttttcgtgggggcagcgacccggcacttccagacgttcggcgtcgtccacggcgtagtgaaaacgccggccggcctggtaaattttgagcagacccactgttaacaacatatccacgctgtcagccaaccgccagatctcgcggcgagacacgtcaaaatagaaaaattcgcaggctcggtcgaccaggatcacgaaatcggcgtgaaagacgccggagggtagcgattcgcccaccacacccattatcatggtttcacagcataagcggtccacaaagaacttcaacaggttgttgaattgctccgtctccatacagatgaagggccagacgcctttgaggttctcggcctggccgcagagcagtagcggacgtgtcatctcgcccggagtgcgcagaggcacgcattcgccgcgataacgacaggtcacacgctgtagttcgctgatgctgttgtcgtgcaggcgaaggtcgcagataatatgatccggttgcgtggttagcagcggcgtgcgcatttgctcgccgtagatggcctcgcagtgcaacagcccgtgtcgcgcaaaatcgtccagactgtgcgccaggtagtaaagcaccccgcgatcgcggtctagacaccacacggtttcgtaacgtcctaacaggagcaccagacgggcctggctaggtggctcaatttcctctacatacacgaaaaagtcgtcatcgtccgagtcctcgtcctcagaagaggaccgcggcccgtgtactctgggcaacacggtggtagagaactgcaggacgcccagagactcgagcgactcttcgcagcagatgagctgaccccagggcgtttcgggcccgtcggtgacagccgcgctgccaaagatgtcctcaaactctacaaaatctagacgccatccgggtggcgctgaaatgggaaggctaatgttcatatcagcatagctacgaactaagtggcggatgtcctgccgcaagtcttggcagagaatgagctttcgtaaaccctttagggtcctccgaacaacggccccagacgcgtagcgataggactggcgcatggtgccgcggcgtggagcggcacttggcagcctattttatggagtttcttcagtgacgtggcttgttcacgtcgttcgtgggctgcggttggcagctccggtctgtaaaccacccgaaaagactgacatcgacgtcaaagactcacgtaatttggaacatgtgcgaccgaaaagtgcgtcagaatagcacgtggctttaggacataaaaagtaccgtgaggtctagacgtggtttttgtgattgacacttacaccaggtaagccaagggacggtgaaactgtatgtgaggaacctgggtgcttagacaactaacgtgtaatgctttttacaggaccgttcaacaggtgatactacctgcaaggtaatgactacatctactacaactaccactaatatcatgctacaggtgagcaacgtaacgaatcacaccttgaatagcaccgaaatttatcagttgttcgagtacactcggttcggggtatggttgatgtgcatcgtgggcacgtttctgaacgtgctggtgattaccaccatcctgtactaccgtcgtaagaaaaaatctccgagcgatacctacatctgcaacctggctgtagccgatctgttgattgtcgtcggcctgccgttttttctagaatatgccaagcatcaccccaaactcagccgagaggtggtttgttcgggactcaacgcttgtttctacatctgtctttttgccggcgtttgttttctcatcaacctgtcgatggatcgctactgcgtcattgtctggggtgtagaattgaaccgcgttcgaaataacaagcgggctacctgttgggtggtgattttttggatactggccgcgctcatggggatgccacactacctgatgtacagtcataccaataacgagtgtgttggtgaatttgctaacgagacttcaggttggttccccgtctttttgaacaccaaagtcaacatttgcggctacctggcgcccatcgtgctgatggcgtacacgtacaaccgtatggtgcggtttatcattaactacgtgggtaaatggcacatgcagacgctccacgttcttttagttgtggttgtatcttttgccagcttttggttccccttcaacctggcactatttttagaatccatccgtcttttagcgagaacgcaaaacgagactctacaaaccgttattactttctgtctatacgtcggtcagtttttagcctacgttcgtgcttgtctgaatccggggatctacatcctagtaggcactcaaatgaggaaggacatgtggacaaccctaagggtattcgcctgttgctgcgtgaagcaggagataccttaccaggacattgatattgagctacaaaaggacatacaaagaagggccaaacacaccaaacgtacccattatgacagaaaaaatgcacctatggagtccggggaggaggaatttctgttgtaattcgatcctctctcacgcgtccgccgcacatctatttttgctaattgcacgtttcttcgtggtcacgtcggctcgaagaggttggtgtgaaaacgtcatctcgccgacgtggtgaaccgctcatatagaccaaaccggacgctgcctcagtctctcggtgcgtggaccagacggcgtccatgcaccgagggcagaactggtgctaccatgacgccgacgacgacgaccgcggaactcacgacggagtttgactacgatgaagccgcgactccttgtgttttcaccgacgtgcttaatcaatcaaagccggttacgttgtttctgtacggcgttgtctttctgttcggttccatcggcaacttcttggtgatcttcaccatcacctggcgacgtcggattcaatgctccggcgatgtttactttatcaacctcgcggccgccgatttgcttttcgtttgtacactacctctgtggatgcaatacctcctagatcacaactccctagccagcgtgccgtgtacgttactcactgcctgtttctacgtggctatgtttgccagtttgtgttttatcacggagattgcactcgatcgctactacgctattgtttacatgagatatcggcctgtaaaacaggcctgccttttcagtattttttggtggatctttgccgtgatcatcgccattccacactttatggtggtgaccaaaaaaaacaatcaatgtatgaccgactacgactacttagaggtcagttacccgatcatcctcaacgtagaactcatgctcggtgctttcgtgatcccgctcagtgttatcagctactgctactaccgcatttccagaatcgttgcggtgtctcagtcgcgccacaaaggtcgcattgtacgggtacttatagcggtcgtgcttgtctttatcatcttttggctgccgtaccacctaacgctgtttgtggacacgttaaaactcctcaaatggatctccagcagctgcgagttcgaaagatcgctcaaacgtgcgctcatcttgaccgagtcgctcgccttttgtcactgttgtctcaatccgctgctgtacgtcttcgtgggcaccaagtttcggcaagaactgcactgtctgctggccgagtttcgccagcgactcttttcccgcgatgtatcctggtaccacagcatgagcttttcgcgtcggagctcgccgagccgaagagagacatcttccgacacgctgtccgacgaggtgtgtcgcgtctcacaaattataccgtaataaaaaagcgctacctcggtcttttcgtacaaaccccgtgtccgcccctcttttccccgtgcccgatatacacgatattaaacccacgaccatttccgtgcgattagcgaaccggaaaagtttatggggaaaaagacgtaggaaaggatcatgtagaaaaacatgcggtgtttccgatggtggctctacagtgggtggtggtggctcacgtttggatgtgctcggaccgtgacggtgggtttcgtcgcgcccacggtccgggcacaatcaaccgtggtccgctctgagccggctccgccgtcgaaaacccgacgagacaacaatgacacgtcttacttcagcagcacctctttccattcttccgtgtcccctgccacctcagtggaccgtcaatttcgacggcccacgtacgaccgttgggacggtcgacgttggctgcgcacccgctacgggaacgccagcgcctgcgtgacgggcacccaatggagcaccaacttttttttctctcagtgtgagcactaccctagtttcgtgaaactcaacggggtgcagcgctggacacctgttcggagacctatgggcgaggttgcctactacgggggttgttgtatggtgggcgggggtaatcgtgcgtacgtgatactcgtgagcggttacgggaccgccagctacggcaacgctttacgcgtgaattttgggcgcggcaactgcacggcgccgaaacgcacctaccctcggcgcttggaactgcacgatggccgcacagaccctagccgttgcgatccctaccaagtgtatttctacggtctgcagtgtcctgagcaactggttatcaccgcccacggcggcgtgggtatgcgccgctgtcctaccggctctcgtcccaccccgtcccggccccaccggcatgacttggagaacgagctacatggtctgtgtgtggatcttctggtgtgcgtccttttattagctctgctgctgttggagctcgttcccatggaagccgtgcgtcacccgctgcttttctggcgacgcgtggcgttatcgccgtccacttccaaggtggatcgcgccgtcaagctgtgtcttcggcgcatgctgggtctgccgccgccaccgtcagtcgcaccacctggggaaaagaaggagccaccggctcaggcggccttgtcgccgccactgaccacctggtcactaccgccgtttccgtccacgcggatacctgacagtccgccgccaccgtaccagcttcgtcacgccacgtcactagtgacggtacccacgctgctgttatatacgtcatccgacatcggtgacacagcttcagaaacaacgtgtgtggcgcacgctacttatggggaacccccggagcccgctcaatcgacggctacggttcaggaatgtgccgttcttaccgccccaaattgcggcatcgtcaacaacgacggcgcggtctctgaaggccaagaccatggagatacggttcaccatagcctggatgtggtttcccagtgtgctgctgatactggggttgttgacgcctccgagtaacggctgcactgtcgatgtcggacaaaacatgtccattcgagaacagtgccgtcttcgagacggtgcgacgttctccaagggagacatcgaaggtaacttcagtgggcccgtcgtcgtggagttggactacgaagacgtcgatattactggcgaacggcagcgacttcggtttcatctcagcggactcgggtgtcctacaaaggaaaatataagaaaagacaatgaaagcgacgtcagcggtggaattcgctgggctctatatatacaaaccggcgacaccaagtacggtattcgtaatcagcatttgagtatacggttgatgtatcctggggaaaaaaatacacaacagctgttgggttctgatttcagttgcgaacgtcaccggagaccgtccacgccgttgggaaataacgccaaagtgcctttcacgacccgcacgtcttctacatacggcgtcctcagcgcctttgtggtgtggatcggatccggcctcaatatcatctggtggaccggcatcgtgcttctggcggcggacgctctcgggcttggcgagcgttggctgaggttggcgctgtcccaccgggacaaacatcacgcatcgcgaaccgcggcgctccagtgtcaacgcgacatgttacttcggcaacgtcgacgggctcggcggctgcacgccgtttctgaaggcaaactgcaggaagagaagaaacgacagtctgctctggtctggaacgttgaggcgcgaccctttccgtccacacatcagctgattgtgctgccccctcctgtagcgtcagctcctcctgcagttccctcgcagccccccgagtattcgtctgtgtttccgcctgtataaaaataaagagacgggaggctgatcgcggccttcagcgtctcatttgtctttactctcgagtgcggtcggtgtctcgtcggtgagacgaggccgccgcccgacaagttcgatctcatgtcgctcttggagcgcgaagagagttggcgtcgcgtagtcgactactcgcacaacctgtggtgtacgtgcggtaactggcagagccacgttgagattcaggacgaggagcccaactgcgagcagccggagcccgcacactggctggaatacgtggcggtccagtggcaggcccgggttcgcgattctcacgatcgctggtgtctctgcaacgcctggcgtgatcacgccttgcgcggccgttggggtacggcgtattcctcgggttcctcggcctcttcctccggtttcgtcgcggaaagcaagttcacctggtggaaacgactgcgccacagtacccggcgctggttgtttcgccgccggcgagctcgatacactccgtctaactgtggggaaagtagcactagcagcggccagagtagcggtgacgagagtaactgcagtctacgcacccacggcgtgtacacacggggtgaacaacactaatcgataagtcgcgtgtaggcgactggctacatcaaccggatatctgcggggatttaaaaagacgacccgttgtcatccggcttagagcaaaccgtccttttatcatcttccgtcgccatggctatgtacacatccgaatccgaacgcgactggcgtcgtgtaatccacgactcgcacggcctgtggtgcgactgcggcgactggcgagagcacctctattgtgtgtacgacagccattttcagcgacgacccacgacccgagccgaacggagggccgccaattggcggcgacagatgcggcggttacaccgtctgtggtgtttttgtcaggactggaagtgtcacgcgttatacgccgagtgggacggcaaagaatccgacgacgagtcgtcggcgtcttcctcgggcgaagcgccagagcaacaggtccccgcttggaagaccgtgcgagccttctcgcgggcctaccatcaccgcattaaccggggtctgcggggcacgcccccaccgcgcaacttgccgggatacgagcacgcctccgagggctggcggttttgcagtcgacgggaacggcgagaggacgatcttcgcacgcgggctgagccggaccgcgtggtgttccagttagggggagtgccgcctcgccgtcaccgggaaacttacgtgtaagaacacggcgtgacaataaacaacatagcgtaaatccccgtgtgatgtgtgtgattgacgttcaggaaacatgtccccatcatcagcgtcacaactgacgtgggttgggtactgacgtgcaggatattacgcgagtcagagaatcgcataagaacggggtggtgagcgggttcccacaggagtttctggcacagaggcaccatgagcctcaagttccccgagagggtgggttacgagaaattgggacaccgcccgtataccaaacgcgtgcgggtgcatgacccgttgggattgacgcggtttatcatgaggcaactcatgatgtacccgctggtgttgccgttcacttttccgttttacgtgccgcggtcctagcacgtcagtggtgacgctgataattgcaacatggcccatgacgaacccgcttgggacgaacgtcaataccacgtcaaaccaccgtgacttggctgaacgttgaaacataaagccaaagcgccgtcggcacttggcttcagagcagcgcctcggggcgatgcgacggcgatgaacttagagcaactcatcaacgtccttggtctgctcgtctggattgccgctcgtgctgtcagccgcgttggtccgcatggctccggactcgtttatcgtgagcttcatgatttctacgggtatttgcagctggaccttctgggaccagtggtggcggggaatcgctcagtccggacctggagagagcaggcggaccgagccagagggaccttcgctcggcgttcaggccttaatactagccacatcttacctgtcggcagcatgtatcggggctccgacaccttatccgccggcctgtatcgttccaaagaagaggtgttcctcctcttgaaccgctgtcacgggccactgtcaacgccgaaaaacgcttgtctggctgaggttggtgtcgttaatggaacttttttgtctcgcttcaatgtcggtgattttcacggagcgtcatgggaaaacggtaccgctcccgatggagagcccggggtatgctgaaattcttcttaaaattacgtaaacgacgtcgtccagtcgttgtgccgcgattcgtacggttcatcgtctacgtcgttttgttcaccgtcgctgtgcaacgtgtgaaacaagagcgcgatgcgcaccttcggcggtatgaagaacggttacggaaaaatcacgcacggcgtcggcagtcttttccgtgacttggggcgatgggtccgagctgcggtatgggtcacggcggcgtgtgtcttactgacgaagatgccgatgtatgactaaaaacgtcccagccccagagcgatgtgtttcaataaaaaaatatgtagtatcatattatgcgtgtcctggtttttcatttctggatgtatttgttacataaaaggcggtgggatatggggatgaaacatatgtagatacgcagttttattatccgaacaaagctcgtgtgatgcgaaaaacggtactgcaggatgaaagtcccgttgggggggggggcagagagtagtcgcttttgccgctgggcatacgctatgcttgtatttgtgactatactatgtgcagtcgtgtgtcgatgttcctattgggaagggtgtgaatgtacgaggtataaagaatggtgggacgcaggaagacatcgctagacacagctgtattgtgctagccccacttagcgtcatgggtaaaacggtgataaagcgtcaaaacaccataggggggggggggcaggaggcttggtggcggtgttcattaaatgcattatgtgtatttattgttacatttgcaaatcgccgagtataccggtataatgtagcaataatcgtattatgtgtgtactatacagcgaacattacaacatcagtgtagcgtgaagcaagtgtgggaacaatgccagtgaagaatatataaaaggcagaaacatacataaatgaattgctagatacagggttctttgtgtactagcccaatcatgtcaatacaatgtgtacagaaaaaagacgcgacaacgacgggggggggggcgcgtacgattaatcttacatattacagtacaggctaccgcgtggtgttgtatatgttacgatgcggtgtgcctgtcagtgtaattggatgtatgttacttatccgtggcgttgtgatagtgttgtgaaaaataattgtcgtgagcataatgacagctgcaaaataaaaccgttttattgagcattgtaatggtagtgtgtggctacattagaaaacgtgacgcgtcgcatgtcgcggcacaatctggcagcggggtcggggtagggtacggtgggaggcatgtacacagatggaacaaaagcagaagtaacgtgagacggagcatatagcccagtatccagcggttcctgagtagcaccacccatcaactgaacgccctcatgagtaaaagtctgcgggcggcagcccttggggaccgttggcatgggacgatcaatctccaaaccacagcgtaacacggttttcttccaacgtcgttgatacacgtcgtttttacggttactccccagaacccagaaagtctcgtccaagtcgtaccaggagtcttccccagggagacgtggcggtttccaatcctcatcgtcccgtcgcaaagcacgtcccaaactggcttggggagtcaacggtggttctgtgggtcgggtgtagcgcgagtgttttcccttcatgaccgattcgtcctccttgcctttaggctttttggtctttttgtgtatcatctggccgccggcttccataaccaccgtggccaagtccagtcccagagcttgagcgtcggcgcggcgtcgagcgtcttgcaggtagtcttccacatttgcacagatggccgggtgtttggtggctagggtgaggacctcagcctcgccgcggcccggacgtaataaaaaagctaactgcccgtgcggctcgcgcgcccacagcgcggcgcgcgggtgcaggtgcagcgcgtcccagcgcggccgctcccactgctcgcggtccagctcgggcagcagccgccgcgcggcctcggcggcgggcgccgactcgcgccccagcgccagcgcgcccagcacgcccgcgcgcagaaagtgcgacagctccgccgccagcgggtacacgtgcccgtccagcgggcagtacccgaacacggcgcccagctcgtccagcaccaccaccagcatggcgcgcggcacggtccctgacgccgccggacccgccatcgccgtcggacccaccaacaccgtcggcgccgccactgctgccgccgcatccgccccgaccaccgcgtgcgcgtccgcgtttggcacgcacaccgcgttcccgccggcggaggcgccgtatggctgcggaggcacaggtacagcggaccccacggctcccgccatcgcgcacggcgcgtccccgccggcggcctccgtctccgtgccgctcgcccccgccggcaacgtcgtccccgccgtcatcgtcgtcgtccccgccgccgtccctgtcgccggccccgccggccccgccgcgcagcccagccaccgcgcgggcagcaccgcgcccagcgccagccagccgcagcacaaccgttggttcaggtgccgacgcacggccgtcagcagcgacgcggggtgcggggccgacgcgaacggttcgtactgcgccagctcctgccacgcgcccagcagcaccatcggctgcagtcgccttcccggcgtctgtagtgccaccgtcgtgcctgcccaccgccggcgcagctcccgtccgagcgccgtcgcctcctcggcgcgcagcaacgtctgtcggagcgccggctgaggcagcagcgtcgcgcgcggtgtccccacgcccagccggttgcagcggtacagccgcaccacctcgcccgcgccgtgccgaaaccactcgtccgcgtcgcgcgccgccaggatcagcgtgttgttcgccaggtcgtacacgaacacgcggaacccggcgcccagcgccaggtacagtccgtcctgcgcgcacagaccctcgggatggccggccttgtcgcccaccgtcgggtcggccgcggggtccacctcgtgcaccacggtcgccaccaacacgatccacgcgtcacgcggcgacaattgacgcaggtccgtcgcgcccacgccgttcatctggctgcgcggcgtcacccgcgcgtagaatccgtacggccgtccgagcggcagcagtgtgcccgcgtcgcgctgcgaccacttgcgcatggcgcggcccgtgctgttggccagaaacgccgcgcgccacacggcgcccatggcctggtattccagctccgtcagcgcctggcgctccacaggaatctgagacagcaacaggcgctccgggccgtgccaaaagttgctgttgttgccgctacccggaggggcgcccggcggcccgcggggttctacgcggtggacgccgtgggccggcgtcgccgaacccgcagtactcgcaccagtccccgctgttgacgtcgctgccatcggcacacaagaagaagaaggggaggaaccaacccccgaaggccctccggcaccgcggccgcgaccgaggggcggggggcgcggcgacatgccgttgcgctgggccatggccgccggacacctccgacgtcgagccgacgtccactatatagcaacacaacccgcgtccgcgaccacgccgtttacacacggggacgtctccgttgtccgtgtgctacggtcgccacgcacctggcttttataggcagcggcgtgcacggcgcttgctagcgccgccttggcgccgcgcagtctaaaaggccgtggaaaaccacccggcagcccagccacccgaaggaacacgcgcgacagccccggagtgcaaagcaaagccgcctcccgagcgcgcacccacctaggtggacggccgacatccattccgggccgtgtgctgggtccccgaggggcgggggggtgtttttagcgggggggtgaaatttggagtcttggagccgcgtgtgctgtggaggacggtgacggtggtaagagtgtgctgcggtgcggttgggacggcggcggcgaataaaagcggcgtgcggcgcgcacggcgaaaagcagacgcgcgtctgtgttgtgtgtctttgaccgcggcggaacacacgcggaaaagcgagtcccaggggacacacgacgagcgagtcccagggggggacgacgacggccagggacgcggaaacgacgcggaaaagaggaagtccccagggggacgggcggaaaagaggaagcgcctaggggaccgcgggggcaggaacagacgaagtacgccgcaacccgcgtcgaggacacacgcagaagcggccgcccaggggagggggggggggggactcgcgggccccggggcacacttgttgttccctccggccgccgacacgcaccccgaagccgcgcacaccgccgacacacccctgacacacccgcgacacacccgccacacgcccgacacacgcccgcgacacacccgaccgacacaccctgacacaccccgccaacacacccagccgcacccgccccgccaacacacccccgacacacccgacacacgcccgcgacacacccggcacacacccacccacccagccgcgcccccgacacaccccgaacggcgccggtgcgggacagggctcacggaggtttgcgggccgtgagcacgcctccctttgtacacactaccggtgcgtggcgtcccacgctatttgttcgcgagaccggactaagggaggtttgcggtgcgtcagcgcggggcggcgtttgcggcgtgtttcgaccagcgctttgtgcgcgctgcctgtgcgtgtcgtcccatggtctttgtcagcggcacggcgctggggacggggtttcaccgcgctgagggatctttctgcgggtgtgagggacggagcttttttcgcacgctgggcaccgggctgggggacggggggtgtgcgggacggcggtggggccggggcgttgcgggtacggggattacgctgggaacggggactcgcggacccgggctgagggacgggggtggcgggggtgtttgcggcgaggacgggggccttttgcggcggggacggggactcgcgggaccggcggtcgcgggggtgtgcggggacggggggcttttgcagcgacgagggttgcgcggccaggagtgtgcggagccggggggctttgccggcggacacgggaccgggggcggcggggactccacaaaccacacgcacacgcagctcacttcagcggtcgccctatcagaaccgccgctattctttattaacgtcttaatcccccccgcttatacacgcaacgctgcatgcagctatgctcacactctatctcttcacagcgacatgttgcttcgtctatgcactgccgcagcagacaccagcggacaccgccatctgccaccacacatggcccatgtgctccgacgtcccgcatcctacgtcgtctgctcacaacacggcgctttcttccccgcacgccatctccatcgaacaccgtctgctgcattcgccgtcgcctccacgagagaacatacgccacagcatgcgctgtcgccgccgcgacatggcctcctcggcttccacacctgtttcgcacacccaacctctggctgccaaccacagacgttcaaggatcacgtacgcgacgaccgatcccaccaattctccaacggcctcgcccgccaagtcagacaagctggaagccgacgcagacccagcactccatcgacgcccggcctcgctgttgcgccacctcttccagccctgccacgcccaacgcggcacttccaacagagccacatcccagagggcttccttgaacgccgtgcaccacaaactctgcggcgcgatgatatcttcgtcgtgttccaccacttgcacaccgctgattatggacttgccgtcgctgtccgtggaactatctgcaggacacaagaaaaaagaaacaccaaccgagggtgggtggggcggtgaagaaggggaggacgacgttctcgccacaatccgcaacacgttgtccgccccaacctcacctgctgcggctaccacgcatcgactgtcgttccctggagaatcgaccttctgcctcaccgctgtttccgagtgctcacaacgtcgaacatcaacggctgcattaacgccgccgccgccagcggtagctgctgcgttctctttttcgtccacggtctccgagaccggcacttttccgcagagcacaacaggccgcacacgtgtcgacgacaccgccgtcgttaccgccggagacccgcgctctcctgtgacacacgtaactctcctccagatattccgtctgcgtagctcgctgctgacgagcaggtccggcggcgctctccgcggaggtgagcacgaggccatccccaaagtcgcgtcgctgttctggacgctgctcaaagcaacacagatagttgagatgactcacaaaacaccgagtgccgactctcaccgcaacccacaaaaatacaccgaccgcccacaacgcctgctgttgacagcacttgccatctggcaacgaacctacaatgacacgcgtgccgcccacgcgccgcaagtgcgtttgctcggcgacatcctcacttaccgcagaccgcaaactgccaccgcgtctaccaaagcacacacgcagcagcagccagaggaaccaaaaggccaacagatctggacgcagacagccggccaggccgcgccacacggcgacgagccgcatagcgacggcgagctacgccgcgagtcgcattctgcaccgccgacgtctcgtacactacccgatacgattttggcagtgaaacgccgttccgttgcccaacggtcacacgtccgactggacgcgaaacccggactgaatgagcgggacggctttcgccaacggttgttgctccccttatccggctatttccgcgccaacgagctccggaatcaacaatttatgggctatggaacaaagaacggccttaagaatacttggctcacccgccctctgggtgtcgcggggggtgtgcgggagacgattggggagcgacaagacaggaacgtggcggactctgcgacgcaacgcgttttccacacgttgtacgccgcactgcagaccgtacgggtgtggtataccgcgttaggcaccgcgtggcgtacctcggggtctcgtacgcgtgagtctctgttcgatggtccacgacgtcgcgatcggcaggcggcccggctacggcgcttggagctgtagccgccagagacttgtctagccgctgctgctcccgctgcgtgcctgctgctgcgtaaagtacatcagggccaccagacagactccgatgaagatgacgatagcaacactgatccaccatctcctgatggcgttgtcgggccaccagggctgttccttggtcttgaccagataagtactggtggtgacacacttgggcgccgtcatgccgcgactcctccaggttgctccggcggttgcttcggcgagtccctggtcgagggaaacgatccctgcggtgaaggaggaagagcagaaggaagaggagtttccctgaagcagcgccgtaggcaagtgccgcggcgcgtgtccgggtggctttataacggccgtcgatgatggtttttaaaccgggacgacggtggttcacgtgaagtaccaagcgacgatactgaccatgacgccgagcagcagagtgaagacgatgacgttgaacaggatttccagatagtgtcccatgttccgcgtggttcctgcgcggttcctgcgtggtttctttttttcctgtgttaacaccggcgtttttgggacggtcggttaacgtgggtttcaggggaaggccgtaagcacggggaaggagcgctgataggcaagacaacgcacgaaggtccaagcggcggcggcgccgacttccaccatcaggccaacgaccagcatccgcagcagcagcgcccaggcgatctcgcgctcgacgacggctacggcgacgaggcagaacatctcaacccagacgacaagcgccaggaggtagagcacggccggaaagaccgcgggcgttaacatctagtcgcggagaaggaaacaaaaactgttgaaaacggggaccgagaagttgcttcgctcaggagacaacgggagcgaacgggatggcgctagatacgctagcggggctggctatctgcgtgggtctaatcatgggtgtcaccgtgatcgcgtcgtgcgcgctgctggtgttttattattgcgatgagagaggggatggccgtccgtcgaagctgttgcaacgtagcattcgacgttggcgacacggccttagcaccgaatccttaaccgctatcctgccggacggttcgtccacggagcaggagatctaccacacgcgactttaagtcacggaggaagttacgtgggtaggagggcaccgtgccccgaggcggcgacgggctagcgtataacaagccgcgcgacatcgggcgagcggcggtgagacagacgcgggcacgtcggtggcgatagccatgagttccagcaacaatctcgatccctggattcccgtgtgcgtcgtggtggtcatgacctccgtagtcctgttcgcaggtctgcacgtgtacctgtggtacgttcggcggcagctggtggcgttctgcctggagaaggtgtgcgtccgctgctgcggcaaagatgagacgacgccgctggtagaggatgccgaaccgccggccgagctggagatggtggaagtgtcggacgagtgttactaggagatcgccgcggccgatgggctacaacacggaggggaaggggggtacaaaacgtgaaattagacttttttttttaatgatgttttgtccctctctgtcttactctcccataggctgtaaggccctcgaggaagagacttacggattgtagttgcagctcgtcagtttgttgtgtacgacctggcgtgtcaatgaatgggtcatggtggtgacgatcccgcgaatctcagccgttttctcgggactgtagcagacttcgccgtccggacaccgcagcctgtggattcatgaaaatctactctggcattcccgaggatcgtcgatggaacatggctatcagaaacgtcgagagacaaatccagacgcaccacagaacgcagacaatcatgaaaatacgtacgcgacggtgaagcgattgcacattttgaaatcgtaacagcgttccggcgggtggttgacgtttatgaattcgcaacattcttctgcgcgcacccgcggcacgcggctgtgacccaatagcagccacaacgtcgtcaagaacggcgtcaggtctttgggactcatgacgcgcggttttcaaaattccctgcgcgcgcgacgggctcaaatgatgagattgggatgggtacagaaggtgtaagtctggttattggcctcggtgaacgtcaatcgcacctgaaaagacacgctgtagtcccggaagacgtgggcccagctctccagcttcatcacacacatctgataacgcgtgccatcgttgacgacgaagcgtagcagcttggtctgcttgggcaccatgtgcgctccaaaaatcttggcgtcttccacgctgatctgcacgtttccgtcgctcggtttcgaagccgtttggggcatccgttggaggatggtctggttgcgaccgctcagataccagatcacctttttcacccaggtggagcttctctccaccaaggtctggccttcccggttgtacagcagatacagggtctcgttgcgacactcgggacccgttgatacctgctggaaccccgagaattgcaagggggaccgtgggggcgagggatagagaaaaggacagtaaaacgtcgccgcgtcatgcggtttggaatacgtcagtttagaccatggcggggacggattctggtttgccgttagcgtcgaccacggagacgccagacagggcgttgcccaaaccgcgcacagaagcaggcagtgaaagtggtgacgaagcagaagccgcagcatattatttcccgtgacgcaggctagttggcaaagagccgcacgctgaactcgaggctccgggcgtgtggcgccagcgaaccggcggcgttgaacgtggtccttttgttggtgccgccgcgacggttctgacgtctaaagtcgctgatgagcaacgacacctcggtcacgttgattctgcaagcacaggttccaaacgtcatttcataccccatgcggttacttagccgttacccgttcgcccttaccttcccgttgtcatgcacctttagcgcgtaccctcacctcttgagcacgtcaaagttgtccaagccgtggctcgcatcgtagtggtagttcaacgtgaggtccacgagctgttccacatacttgtaacgggtttggtcgggcagcgcgcgagagcacgcgtcccagtaatgcggtactcggtaataatcgtttttttccgcggtttcccgctggcactgacccagcaccacggcgcacagacaaacagacagccacacccgacacagctgcatgttgcagactgagaaagaaagctttattatgagacatcatacacatagtataggcgaggtgatggggcggggaaagagttggaaccgaaagacaaaaaaaaaagcctagtcgtactcgggatctctgagcgagacgggttgcatggcaactttcattagtttgggaatctgccagctggtgctgttcgaaggttcttccatttccgaggcggtcagttcatcgtacaccgaaacgtagtacctgatggggtcctcctcattgtccgagaggtgagattcgatggtcaaaggcgagcctctcccataattgggattcacgaacgacgtgtccaagttgccatcctttctgaaatagatgacgttctcaggatcatgtttcatgcgctcgcgggccgcggacgcctcctcctcctcgtcccagtcccgagtttccaaccgctgataagggctcgaggaacaaaatccggcggggatctgagaacctcgtcgggaaccgctgccaaacgggctgctgccgccactgtcgtccgtgtcgtccaacaggttgacggcctcttcgtcggcgaaacgaaagcggcccgggtgcttgcaacacgaggagtaaactaccgcgatcagtaccgctatgaagctgaaaatggaggtgcctgtcacgatgtagaagaggatagccagcactttcatgatctcgttattgcgcacgttgtgaacggaagactcgtgggtggtggtcatgttgatcccggttgtgggtccgctactcgtggcgttgtcgacgttatttctgttgctggtgctagtagggacttttgtgctgctggtcacattcgtagcgtcgctgaggtctatctgaagcagcaacccgaacgcgaccagggccaggaatgttgcgcgaaggggaccccgcaaggccggcattctcgagatgtggcgacgtggatttcttgctatgtccgcgaacgacgtgtgacgaggacgtggtttccgcaagcctctaccgacgccgcgacaccaggtaggttatcaaaacgcgagcccatatcgccgccatcattgtaatcagcaatgtgttgaggtactgcacgatgaatctgtctagtgacaccagccaaccctctgcttttgcgggcaagcgcgctttcggtgacagggtgtatcgtacgtagccgcgggtcaggcgcgcgttgtagcggtacacgcagaaatctatccacaggccaacgcccggctgtagcttcggatggtggataatagcgcggtgacgtacgccgcggggttttagaatctccacctgtaaggccatctcctccaggtagtgggtctgactgcgacgcagcgtccagttcatgtaaaagtcggtctcgccgtgtccggccacgaagaggctgcttactaaatcgggcgccagagctaggtcaggcgtatcaaattccactgccaggcgacctgattctaacggttccacgatccgggagagtgtttctagatatagagcaaagcgtaccacgtctacctgcggtgtaaaaaactgttgtgggcgttcgccgtcgttgaccacgtaggccacgtagaggccaacattttccaccacgggttctagctgcaggcggcacgtaaagcttagaaacgacggctgtacggtttggttcccgtgaagctgaagcgtcacttccttgccggggctcaccgtgctgtaacgccgcaccgagtcggtcatctgctccagatcggtagaccagaagggtgtgcaatgcatactgtcccagtcgcgacacgcagcccagcctagctcggtgaagggtcgacgcacacccgagaaagtgtgcttgaagaccagggggtcgcctcggtagctcagtagccgaacatgcacatagtcgcggctagcgccgacagactgcccgtggagggccagcaggacgagcgtgaacagcaagcgcaacatgctgcgcgggttaggaaatgcggcgtgtcggccaccgcccgactcataaacgctaccagcatgacgtctcagatcacacaagtgacgaggagcgtaccgcaaatcactagggaaaaggccagcagagcccgatagtcttgctcttcgcgaacgatctcgtccggttcctcgcagtcttcgtgatccgcagaagatgaggagcaggaattttcgttaatctctgcgaggatgctagtgctgtaccacaccaaagcgcttagcgtgcccagagctaccgcacggtaaaatagggacatgatcaccagcgcagtctgaagtggtggtagttcagtctcttggcgtatttccaaagaaaggctttgtaggccgtagggactggccaggcaccgaactcaatattggtagacactacgtcgtaaatgcgttgttcctcgtctaagattaaccgaaaaaatagccggttgatgtgacgacgcacggcttgcgcgttaggattgagacacttggttcccttgtcctttaaaatagccagcacttcctgacgattgcagctttcgctcgctgcgattggcttaagcaattcggttccgaccggcagggtattcaacagaatttggttgttgcaacggcagcgcctgtcgtaatcttctagttctaaaacatggacggctaggggacatatggtaagtaacatatatgcgattaatgacaggtgtcgtaccgataacagattgatatgcgagtttgaaaccggatggtgcaaccatgttagcaccatattaaacacatactgtaatattttgttttaacgaacttgtctgtttgaaaacatacattaaatattatcctctaacacctatcaaggttatatttattcgtctcggtcctggtgatttcgttatgttaacattataccacctattatcgttgtgtttgtctaaccattttgagaagaggtgatcgggcgataaacatactccaggtccaggcggtttccttccgtctggatacaataaatgttcatttttatcgcatccgggccctctgggatcgcgatgaagccaataattacccaatataattttattaggcggccattttctatgaagacatctgcagcgtaattctgttccattcacctcataatgatacacatatgctaaaaaaataatcaacgcaccaaaaattaatcgcattataattttattatctacgtcactaccagtaattcgtaatatccggtattcccggaaaatcgctcaaaactgcgtccatgacacatcaattcccgataagtacccccctttgaaatcggatccccccacataccaatcaatcacacaacacagaggtttaaaaatcgatcacacgtcaattaggtttcaaaatcgatactgtttattatcaggaatctagactaattctacaatgacagctctaaatttctctctcgtctttcttgtcaggttctcatcatcaatcatcacttccacccatcgaggagtcatcgtcgctccaaactcctttggggtcgctagttggaaaagtctctgacacgatccaggcaccccgcacccagtccgactgatctagcttgcggagcatctcaacaggcatgagctgcagggccacggctgtcacggcactgtatcgatgtaacactagggactttctttgcgatgtagccatcaacacggcgtatgccccgtagttcgcgtgatacgacgcatgatgggttaaacgttcccatccggcagtgccgtctcgggtccgtgcacataacagctgcacggcgttatgatgcttaaaattaaccataacgctggggctactgatgaaggagtagtaatgagccaggacgccgtacatcgaaggcaacaagaaagagtgacagcacgatagcaccgggctcttatgtaggcgacagcttatttttcctgacgtcggcaaaaagtacctaaattccccacagatactcagacacggttccgtaaagtgcttctttttttagtgcaggaattggaaaaaataataaaaaatatgaacagctcatctgtaattatctgtgtgacttcatcgtaccgtgatgtaaaaacaacaacaggaagcttacagggtgcggtagaaaattttgccgattgagcaacactgttggcatctctcactccgataggcggctataagatagagaattaaaagtatgatacccacaagaaagataaagagagacaaccaggctagagtatgacgaccgctttttccttgtttgacggttatatgtgcggtatgattttgctgtcgttgtttgtgatgttggacgcctggagtggaaaagtacgtatggttcttaggtgcgcatacggtattattggtggaagtgcagttacgaatcatgacctgagtgacgttacattgagtgcaatcggtacagttgtaaagtcccgatacatacgtgccgttggggcaaggggtacacgttacactggtataatccgtgcatactttagtaactctttgtcccgaaccacacggagggcagcactcattgcccagttgcacttcattatgctgacacactttagtcactccaagctgcaataatatcacagcaaagcagatgagcattatcagaggcttcatgcctcctaccggaagaataaaaataactcatggggccgaacggtatcatcctctccgcggtttgtaatacgagatcgtaaacgtaaataaatgacataacttcactaacccgcatactgcaaagtccacctacgacgccaaaagtttttccaggacagaacaggatagttagccatcttcacaggtaaccagtttccagccacagtatagcgaacctaagagaccgcacacggtctctgctggaaaaacataccactacatcgatttgtcgtgccgtacaaccgtcaagttttccgaacttttatacacgccaatggcgttaggactatgtgtgctgctgtgattggaggcttcgtgagttatgtgacagctgtgattacacctgtcgccaaggctgacagcggttacccagatggagcacaatcacaagctgatggacgttggttgacccgttgattcccatggatattttaacggtgacagtacagctcccgttaaacattagattaatagacgctagtggatgacagcatgttattcgcccaaatgtgattgtggctatactttcttgttttttgctcatatgctgtaaggtgttcgaggatcgtggggagtatatgtgttgaatccgaatcgtctttactgaccgcgccatacctcgtatacgaacttaaccggcgtaaagtgtttcccgatatataaaccggcgcctattgtggctgtagcgcccataggtatggcatatatccacggtgatgttgtgttattcgttttttgtgataaaacgtagcttatgtttaacgtgtgtttcgtcacgttatgtgtgtcgttaaaagacggcgtctgtacagtatggctttgagttgtattttgaattgttattgtatttggaggtattgtgtgcatagtggttgttgcgtgttgagatgttgttatgttttgaggcacagttgtggtgtatacggactccaaggtgtagttacggagtctttctatgcaggtagtgttgagatatttttgaatgctggttatgttcgattctgtgaggttaaagtgtgtactatttatgacggtgtaatttagacggtcttgccatcccgaggatgttagtgttaggtaattcgtgttgttcacgtttacttgatatgtataggtaggtgtactgtttgtgaggtcgcaagtgtgattctcttgcagagattttatccatcttgtgtgaaaatattgagatacgcgatgaatgttttcgctatctatattataaagcgtttcagtgtcacctaggggttgtttgttgtaacttttattttggacccagggtgtgaaccatgattccaatacttgtatagtaaggtgtcctattaataaagacgaactgattcctaccgtaatgttataccgcacacctagggtgccgtttacaaacacggaaatgtttccgttgcaaaccacgttggtagatgaattagattccaagtggtaacgataggataatgaccgttcgctcccaacggatgacacaaagtatccgaataaccaccacacccattcaatccgcatattttaatcacactattcacacttcacacactgcattttttaacatattatttttttattttatacgtgttctcacctcttcatctttctaacaccggggtaactatcgtaagtcggtaggcgtcgatagccctcaccgcctcgtcgtccccttcccggcgtgggacaccagcgtccacaacactgcagataacacaggtagcataggaaacatacggtaaaaatactccaaaaccccaaaaacgccgcgattccccgagtggcccagggagacatcccggtgtctatgtcggccggcggtgctggcgtcaccggtaaaaatttcggcgggtgtggctgcgaacggtagcagtcgccggggagccggtaacgctgtatcactgtccaacagcggtcgggttcctcgtccggacatgcgggtttccagcaatcctcggcgtcggcgcggccgatatagaagtagttgcgttgaaagccgcggtacgttccgcagtcgtgattccgtagacgccagggcgtcggcgaccagatctggtctcccagcgagtagcgacctaacgccggtgtgcagcaaggttcgtcgggccggctgagcgtctccagctgcgtgagaattacgaagcgttgcatgatgaggccgtggctgtagttgcgtagcacgcattcgtacatgccggctgtgtccatcgatacgttaaaagtaagcgagaatatttggccgagatgcaattgcgagaaattccaagtggcgtacggcaggcggtactggagtccgttcatcagccgatggcctttgacggcgtccaggatgagctcgtcgctgccgtcgtgggaacgacagaaacgtgcgcgaatggagaccatgggccaggagtgtgtcatgaccgtgcaggggatggtaacttgctctccctcggcgaccaacaccggcgccggcgacgtggtctcataattctcggcccacatcttttcggcaatgtcagcggtggcgaaggggaacgaagaggaagaatattcgaggagtcgcgggcagctcaacagcacccagaacagccacggcagagttcggagcgactcccggcggcacatgatgattcttttcttccctttttcacagagacgctgcccgcctgctcctgctccgtgtgtcggccgctcaaacgtcgggccggcgtggtggtgaccaccgtgcgacgcagcttctcgcccgggatgcccgcaactgagcgtccggtttttttgcaggtcttttttgctgcctccccctcgccgtcgccgtcgcggccgacgtggtggaccagcaccgcgcaggaactctcgcgtcgccggcggtacgcgacctgtctcattgctacctcggatgtttaagaaggaacgttcatctgcgtcacagggtctgatgaagctgccaagagtcgtggctgtgtcgtagtgcgttctgtacagcgcgtttcactgctttctgcatggccgccaccacgtcgggcgggagcggctccggcggaagctcgatgagcagttgctgcgagtctcggcgctcggcgtccgccgtttcgtcggacgtggcgtagaaaaccgaggtggtcgcccagtcgtccacgctgtcgacggcctctgtcagtgccgggttgtcaaaaccgccatcggacgcgggtgataaaagaacgtacgatgacacgctgttagtacgactctcgtcgtcgctctgggaacgacgtgatggacgacggtagatgacctcgtcttgccacgcgtcgaagcggtcgcaacagcgctggatccaagcgcagcggagcagcttacggaacacgtcgttgttccaaaagtagagcataaagagaaagaaaagtagcgtaacgataaagccgaaaacgacgagggtcggcagggcactaccgccgctgccgttttttgcgtcgtgcgggtgcacggtggtagtcgcgttagtctgagcgggggtcatgacaagtctgaagagatgagagcacgggtgctcatcaggaacagttgaggtctctccctaccgaagccttagcctctacggtgttttatgatgaacgtgtatacggacgtcattgtgaaagtgacgtctcaggccttccgaaaccgcgttaggttcaacgtgggtttcggtttagcctacgtcaccgaggcggaggtggaaatgagccgtcctgtgggggagtgtacgaccctgtagtgcccatgggtaacgttgcgtcggaagaagtgaatgcggcattggtgtacgcgtgggttgttttgctctctgactcggaggagttgccgcagcagctgcagattttacgtactagccaaaagcagcaaaagcagcaggtaaataagagaaggagtccagataatgtccagccgctagcggcaagcagcgcgagctgtggtactgtccagctactgccgttagaggcattaatacatgtcgatacggtcgtgttggcggtagcactagtagattgactggaattagagctggtacctgtagtggtttcactcgccgatgcggcgagtgcaaataaaactaatatccacagcatgttcgttactatataatggatataccaactcgtttgtcgtaacaatcagcgttatacacgctgtatcggcatcgttttaccggaaagtttatcgtaatgtaacccgcgttgtgtacattcgtactgacagggaacccccggtgatatgcacattatactctttcattctggggtttcccaatgacgtaaaaatttccactacacaataaaattacgaactcatgtgaaaagtgtgctttttattaacagagcagagggtttacagtagatatatgtttgccagggccaccgttttctaacaccgatcaccgccaccattaccacccgttgaactccacacccgggagccgcctgatcgccagggactcctcaccgtccatcgtccgaacaagctcccgccaccgatgctgccaccatcaccgagggaaagaaccgcttgctgcagatacgcttgggctcgcctccgtgcggatgccgtttcgtgcagacgctgagtagatcgagcagagaatgtcaaagcgacattatcgcgatccgctcccctcttttttctttttctcattcacgtgtactcttgatgataatgtaccatggctacggtggtgaactgcgtcgcggatcccgtcacgggtttcaacagatcgacgtcggtcagcggcgccgtcaccgccatgtccggcggaggcacgctgtttctctggctagcgacgtggaccgacgacgaagacgatgaacccacacggcggtctgttatccgcgacgacgcgtagctgcactgggaagacacttcctcccaacggaccaagatctcgtcgggccgttcggagaaacggtatcgtctgtccgactcccgccgtacggcgccgaggcccagagacgacaggtccgcgaaccggcgctcgtactccccgtacagctcgcaacagcggatcagccagcggtagctcagaaacatgcgcaccagtttgaaggtgtcgtgccagtggtaagccagatagcagaggatggccacgatcagcacgagcatcacgccgatgatgggtaacccgacattcagcggcagatcgtccatggtgaccgtcctctgtccggatctacgtcccagtctctctcttttgtacagcactcgcgcgggaacggccccctcaaccctcttacgtagcgggagatacggcgttctcccgcgggccacttacttgcacggtcgcttgaacggcggcttggaccgccacatgcaccgcatccatccattctggcagcagtgcgttcggcgacgtcgtacgagtcgcgggtgatgttaccccgccagcacctccgccggcaaccgcgtcgtcgttgctatcgtcgccggtttcgggcgatgacagcgccggcggcgcgggtctcgtctcgtccaccatttccaccgtgtcgaagcgacagccgctgccgtagtacatagctccgttcaacggccggcgggccgggtcgccgagttccgggtcgggcacatccatggcttgccgtctccttctctgccgctcgtggtgccgacggcacttctcgggataatgacagccgcaaaatagatcgtggagcatgtctcgccaactgtcctggtggtaatatcttaagtacgcgatgagcgcgccgatggccataatcataagcgtaagcaaaacggcacagataacgtgaaacaccgcggtcatccaagtcgggcggcgtcggggacgcggtgggtcggtttctcttacgccggcgtcactcagccaccacacccgtagccgacattcccagaaccggtgaatgcgactcagggcctttcgacgccgccatttatttctaacgtccaagtcccacgtcatttctggcatctccacgcccttgactgacatactctctttctctctcttagctgcggtgaaaaagagggaaggcgtgtgctgctatacaactgtacaacggacgcgctcgctctttcggtctcaggtcatctgcatcgactcggcgtccttcatgacgctctgcaccgcctgttccaagagttcctcgatgtccgaccatcgaggaggcggggctagctcggaaaccgacacgataggcagcgtggtcggctccgtcggcgtgcggggtcggggacagggacacgagagtcccaccttcgagagattctccagaccgacggtgcgcggtagtctcggattccgcggcggcttttgtggcgtcggcgttttcgggaagggcctgggtgtcaccggcggtgtccagccgaccggcttgggtttcgtgggcggcggcgttttcttggtgggcggcgtgctcaggttcttacgcggcgcgggtatcggcgtcgggggtctgtgcgacgacagccgcgtggtgggggcccggaccggcggcgtaggcggccgcttcttgcgcccgggcggcggaggtggcttccaggatggcggcggctgatgcagcaccgtgtcgacgctggtcgaggacgacaaagagctcgacgaggagcaatgcgacggagatcggccgatgctggtcggcgttcccggcgtggatacgtcggggatctcgaaccgcgccggaggaaactcgggtttatctatcggcagaccatcctctcctatgtagagcgacgtacaccgcggcacctgcggcgtcggcgggtgggtggccacccgcatgagccccagttccagatccagcggctcgacgacgtcttctttcggatttcgatagcagcacgcgcaggcaccacgcttatcagaagcagcacccgggagccggcctcgcgacgaagtctcgtcggatcgcttgcggcctcggcgctgggtaaataaggaaatggccaggaccagggaagccagtccggtaccgccgaggagcccgatgccgagccatatccacaccatgatcttctctcctgcttggaatctcaaactccgtgttgggaagggccggtgtacggacatttatgccttggatttctggaaacgtcattttttggcaaggaatgtgtttattgtccaaacattgaggaaggagatgtgcgccaagtcggaaaattccttatcgcaccgggggcgggttacgttccggtctgatgctgctgctgttgttgtagagccgcggccacggccgcctgcacggcagcttgtaccgcctcggccacgccgggtggcatctgcggcatggcggggggaggcgcgtcgggcggaccgccgggcattgccgtcggctgcgacggtggttgtgaactcaccgtcggttcgcacggaggtttgtctttcggtctacccttcggtttatctttcgccctacctttcttcggtttgggttccgatgtcggtgctggcggctgcggtgggatgacgggctggtgggactcctccgacggcggggggacggacaccgtcggcgccgaaaccgggggactctcgactatctcgcagatcaccctgtcgggatcgtcgccgtgtccgggacgccgtcgatgaccgtattggaccatgtcgtaaatcatcgtctccttgtaacacgctgaacagcagcggctacaggggcccgagatgcatttgcagctgcacttacagctgcagctgcagtagcgaacccatcggcaggtaaggaggtcgattacggagtctttgaagaattcccggtaacggatgagatacgcgcagaggaaaatcatgaaaacagaacagccgactacggctgcgatgccgggtcccgaagagacatccgccgacgatcccgccaaacaccaaattcctaaagccgcgcatgttatccaggccacgataatcgtgggaacgccccattggcattgccacgaaggatcgtgcacgtcgcaacccatcgctactgcgttctcccacaaacgccatcgcactatttatccctacagcggctgacgggcgaatacgctgcggcaaagtgaacgacaaggcgcagtacctgctgggcgccgctggcagcgttccctatcgatggatcaacctggaatacgacaagataacccggatcgtgggcctggatcagtacctggagagcgttaaaaaacacaaacggctggatgtgtgccgcgctaaaatgggctatatgctgcagtgaataataaaatgtgtgtttgtccgaaatacgcgttttgagatttctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgattttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattagtcattggttatatagcataaatcaatattggctattggccattgcatgcgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctataggctctataggcacacccctttggctcttatgcatgctatactgtttttggcttggggcctatacacccccgcttccttacgctataggtgatggtatagcttagcctataggtgtgggttattgaccattattgaccactcccctattggtgacgatactttccattactaatccataacatggctctttgccacaactccctttattggctatatgccaataatctgtccttcagagactgacacggactctgtatttttacaggatgaggtctcatttattatttacaaattcacatatacaacaacaccgtccccagtgcccgcagtttttattaaacatagcgtggaatctccacgcgaatctcgggtacgtgttccggacatgggctcttctccggtagcggcggagcttctacatccgagccctgctcccatgcctccagcggctcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcagcagaagaagatgcaggcagctgagttgttgtgttctgataagagtcagaggtaactcccgttgcggtgctgttaacggtggagggcagtgtagtctgagcagtactcgtggctgccgcgcgcgccaccagacataatagctgacagactaacagactgttcctttccatggatcctttctgcagtcaccgtccttgacacgatggagtcctctgccaagagaaagatggaccctgacaaccctgacgagggcccttcctccaaggtgccacggtacgtgtcggggtttgtgcccctctctttttttttttaataaagttgtatttttaatgttatatacatatctcctgtatgtgacccatgtgcttatgactctatttctcatgtgtttaggcccgagacacccgtgaccaaggccacgacgttcctgcagactatgttgaggaaggaggttaacagtcagctgagcctgggagacccgctgtttccagagttggccgaagaatccctcaaaacttttgaacaagtgaccgaggattgcaacgagaaccccgagaaagatgtcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaaggttcgagtggacatggtgcggcatagaatcaaggagcacatgctgaaaaaatatacccagacggaagagaaattcactggcgcctttaatatgatgggaggatgtttgcagaatgccttagatatcttagataaggttcatgagcctttcgaggagatgaaatgtattgggctaactatgcagaacatgtatgagaactacattgtacccgaggataagcgggagatgtggatggcttgtattaaggaactctataatgtgaccaagggtgcagctaacaagctagggggtgcactgcaggctaaggctcgtgccaaaaaggacgaacttaagagaaagatgatgtatatgtgctataggaatgtagagttctttaccaagaactcagccttccctaagaccaccaatggctgcagccaggccatggcggcgttacagaacttgcctcaatgctctcctaatgagattatgacttattcccagaagatctttaagattctggatgaggagagagacaaggtgctcacgcacattgatcatatatttatggatatcctcactacatgtgtggagaccatgtgcagtgagtacaaggtcaccagtgacgcttgtatgatgggcatgtacggggctatctctctcttgactgagttctgtcgagtgctgtgctgttatatcttagaggagactagtgtgttgctggccaagcggcctctgataaccaagcctgaggttatcaatatcatgaagcgccgcattgaggagatctgcatgaaggtctttgcccagtacattctgggggccgatcctctgagagtctgctctcctagtgtggatgacctacgggccatcgctgaggagtcagatgaggaaaatgctattgcagcctacactttggccaccgctggtgctagctcctctgattctctggtgtcacccccagagtcccctgtacccgcgactatccctctgtcctcagtgattgtggctgagaacagtgatcaggaagaaagtgagcagagtgatgaggaacgggaggagggtgctcaggaggagcgggaggacactgtgtctgtcaagtctgagccagtgtctgagatagagcaagttgcctcagaggaagaggaggatggtgctgaggaacccaccacctctggaggcaagagcacccaccctatggtgactagaagcaaggctgaccactaaactattgtatatatatcagttactgttatggatcccacgtcactattgtatactctatattatactctatgttatactctgtaatcctactcaataaacgtgtcacgcctgtaaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcagcccgcgtaagaaaccgcgcaaaaccacgcgtcctttcaaggtgattattaaaccgcccgtgcctcccgcgcctatcatgctgcccctcatcaaacaggaagacatcaagcccgagcccgactttaccatccagtaccgcaacaagattatcgataccgccggctgtatcgtgatctctgatagcgaggaagaacagggtgaagaagtcgaaacccgcggtgccaccgcgtcttccccttccaccggcagcggcacgccgcgagtgacctctcccacgcatccgctctcccagatgaaccaccctcctcttcccgatcccctggcccggcccgatgaagatagttcctcttcgtcttcctcctcctgcagttcggcttcggactcggagagtgagtccgaggagatgaaatgcagcagtggcggaggagcatccgtgacctcgagccaccatgggcgcggcggttttggtggcgcggcctcctcctccctgttgagctgcggccatcagagcagcggcggggcaagcaccggaccccgcaagaagaagagcaagcgcatctccgagttggacaacgagaaggtgcgcaatatcatgaaagataagaacacccccttctgcacacccaacgtgcagactcggcggggtcgcgtcaagattgacgaggtgagccgcatgttccgcaacaccaatcgctctcttgagtacaagaacctgcccttcacgattcccagtatgcaccaggtgttagatgaggccatcaaagcctgcaaaaccatgcaggtgaacaacaagggcatccagatcatctacacccgcaatcatgaggtgaagagtgaggtggatgcggtgcggtgtcgcctgggcaccatgtgcaacctggccctctccactcccttcctcatggagcacaccatgcctgtgacacacccacccgaagtggcgcagcgcacggccgatgcttgtaacgaaggcgtcaaggccgcgtggagcctcaaagaattgcacacccaccaattatgcccccgttcctccgattaccgcaacatgatcatccacgctgccacccccgtggacctgttgggcgctctcaacctgtgcctgcccctgatgcaaaagtttcccaaacaggtcatggtgcgcatcttctccaccaaccagggtgggttcatgctgcctatttacgagacggccgcgaaggcctacgccgtggggcagtttgagcagcccaccgagacccctcccgaagacctggacaccctaagcctggccatcgaggcagccatccaggacctgaggaacaagtctcagtaagtgaaaaactggaaagagagacatggactcttgtacatagtgattccccgtgacagtattaacgtgtggtgagaatgctgtttaataaaagtagctttttttatacatctccgtctctggtctcgtgatgtgggggtgcgggtggtcccggatacttgtccttctccccctcatgtgtatagctctgatggcaaggggcacacacggggcttacatctgctcccccaacccagggagacttagaatctcttgcgccctctcggtgttggaccaaagactgtggtgggagatccagtattcatcgggtcgtctcacccgagtcctggtctttcatgatgagggtgatgagggtgatgacttacatctcacggatacccgtcactgcacttcctgtacacatccctatgtgatttctttggttaccccgctgaccatcaatgccacgctacggctgctgatacgggatggaatgtacgggcggggggagaaggagttgtgcatcgcccatctacccaccctgcgagacatccgcacctgccgcgtcgacgccgacctaggactcctatacgccgtctgtctgatcctgtcgttcagcatcgtcgcggcggccctgtggaaggtagattacgacagatccgttgcggttgtgtccaaaatctataaatcatagccactgacgcaggcacgtcattgacagccggcgacgtcgagagggtaactatgtaccgtgcgggggtgacgttgttagtggtggcggtgataagtgtcgggagatgggacgtggtggcggttgcgattgggtggtatgagccccaagttagcgtggcttatatgtatgaacataatgacactaacctgactattttctgtaacactacagcttgcgattcgccctttttggcctcggggatgatgattagtattccacagaacacacagtttctcaccagcaaagtcaactacagtgatgatatgtataacgataggaaaaattatactcatgaactgaaacgcatgctgacaggggcaccgggaacctatgtgaacggcagcgttacctgctggggctctaacgggacttttggtgccaaaactttcttagtaaaatccatgatcaatacgacggccggtaacaccagcacgtcaatcatccactttgttcaacaggatgaattggtggagaatcctgcatactttaggcgcagtaatcatcgagcctttatgattgtcatactgacgcaagtggtttttgtggtgttcattattaacgcctcttttatctggagctggacatttaagcgtcacaagaggtgacgcggcctctcgccacatatagctcgtccacccgccgtcttgtcacacggcaacatgtgtcccgcactggcgattgcgctcgcagccgcgctcttgagtaacacgcacccgggaatgggaagtagcactacaagtgccgtcacttcccctaatatcaccgtcacattcactacgtcgataaatacccccaataacgttacttccaccgtcaccaccacggtacaaacctctactttcacgtccggctctacctccacgtccgcctctacctccgtggcaaccacgacgcagaaagaggggcacctgtataatgtgaattgcgaagccagctacagctacgaccaggtgtctctgaacgccacctgcaaagttaacctgttgaacaacaccaaaaatccagacattttatcagttacctgttatgcacggacaaactgcaaaggtcctttcactcaggtggggtatcttagcgctttcccctccgacgataaaggtaagtagcacctacctttccgtctattccccttcctcccccgctaacctgacatcaaaataaacagtttatgaattttatccacaggaaaactacatctgtcctacaatgccacggctcaagagctgcttatctcgggactcagaccgcaggagaccactgagtacacgtgctctttcttcagctggggccgccatcacaacgccacttgggaccttttcacctatcccatctacgccgtgtacgggactcgcttgaacgccaccacgatgcgggtccgcgtgctgcttcaggaacacgaacactgcttgctcaacggtagcagcctctatcaccccaacagcaccgtgcatctgcatcaaggcaaccagctcattccgccgtggaatattagtaacgtgacgtataacggacaacggttacgcgagtttgtcttctacctcaacggcacgtatactgtcgtgcgtctccacgttcagatcgcgggccgaagttttaccaccacctacgtgtttatcaagagcgacccgctgttcgaagaccggctgctggcctacggcgtgctggctttcctggtgttcatggtgattattcttttgtacgtgacctacatgctggcgcgccggcgggactggtcctataagagactggaggagcctgttgaggaaaagaaacacccggtgccctacttcaagcagtggtagggcctgagaagagaggagcggctgctgtgttgtctttatttcgttgacttttacggggttttccctcagcctctgtgttcccaacgcgtccccccgctgagcgttggcggcgatggtcatgttctcccaggaccacgtccagatcgtctacggctccacacgcatctgcaagtccctggccccggccaacaagagaaagacccatcgcaccatcgtggtagcgccacggcggggttttttgcgtattcccccggacgggcaggacgtcaaccacgtcaagatcgtacccaccaccacctcctcttccctcgcgccgccccgtgacgacgagcggcggccgaccccgccgttgcggccgccgctcacaatctatccctatggcacgtcgctgatccgcaggtcagctagggacgcaaaactccgctccaagctaatcgtcttccatataactcggcccgcactcggtcagcacccgcagaatcccgggatctcgggccctgcggccatggatcatagtgagttcctcaccagctttcgtcgcgaggtcgatcggcaaaccgtactgaccgccgagagcgcgcccgccactgtggaagtctgtctgggcgacgctctgcccggcggcgtcacgggtggcggaggactgccggcgggtgtgggctcggccagcgccgccgtggccgccgctgccgccgctgtggccggagtgcccgtcgccgcaaaccccgtcatgcccgccaccgccacggtcaccacgccgcccatgatcgaccttaccagccaccaccggccgctgacgctgtttacgccggcctccgcggccgctgcgcccgccgtggccaccaacggcggtaacgccacctacattttgccggccgactgtcggtacgcgccactctttgccaacaagtataagtacgtcttcgaagaggtgtcacgtctcatgcggctgcacgactccacggccgtgcagctgcagatcagcgcctcgtgcggcaacgctttccaagccctcaagagtgccctgctcaagttgcacaacgtcaccgtgttagcgggccagcagctcatcacgcagacgatgccgcacacgccacaggccgtagccacattcaaattctttcaccaggatcccaaccgcgttctggactgcatccgtccggtggtgccgcgctctacttcgtaccacgaaacgggtgtgtaccagatgtgggtctcgggcgccaccaagaaagacctgtttgacgccgtgaccctgtgcgcttccatcgtagaaaagcagccagacgtatttaatatcaacgtcagcttattgacgtacccttcgatcgcggcgccccacttgccactgtacaacgaattcaccagctttcgcctgcccacctcatgaagcggcggcggcgatggcggggctggttgcttttcctggccctgtgcttttgcttactgtgtgaagcggtggaaaccaacacgaccaccgttaccagtaccaccgctgccgccgccacgacaaacactaccgtcgccaccaccggtaccactactacctcccccaacgtcacttcaaccacgtccagcgccacgtcgaattcaatctccaccgctccagcgacgtcaacagtttctgaggcaaaaaacacaaggaataataccacaaccgtcggtacgaacgctacttccccctccccttctgtatccatacttaccaccgtgacaccggccgcaacttctaccacctccaacggggatgtaacatccgactacactccaacttttgacctggaaaacattaccaccacccgcgctcccacgcgtcctcccgcccaggacctgtgtagccataacctgtcaatcatcctgtacgaagaggaatctcagagcagcgtggacattgcggtgggtgaagaagagtcggagttggaagaggacgacgacgaagagtacgacgaactgtggttccccctctacttcgaggctgaatgcaacctaaattacacgctacaatacgtcaatcacagttgtgattacagcgtgcgccagtcgtctgtctcattccccccgtggcgagacatcgactcagttaccttcgtacccaggaacctctccaactgtagcgcccacggtctggccgtcatcgtcgtgggtaaccaaacctggtacgtgaatccgtttagcctggctcacctgctggatgcaatatataacgttttagggatcgaagacctgagcgccaactttcggcgccaactggctccttaccgtcacactctcatcgtgccgcagacttgatgtgccgccgcccggattgcggcttctctttctcacctggaccggtggtactgctgtggtgttgccttctgctgcccattgtttcctcagtcgccgtcagcgtcgctcctaccgccgccaagaaagtccccgcggagtgtcccgaactaacgcgccgatgcctgttgggtgaggtgtttcagggtgacaagtatgaaagttggctgcgtccgttggtaaatgttaccgggcgcgatggcccgctatcgcaacttatccgttaccgtcccgttacgccggaggccgccaactccgtgctgttggacgatgctttcctggacactctggccctgctgtacaacaatccggatcaattacgggccctgctgacgctgttgagctcggacacagcgccgcgctggatgacggtgatgcgcggctacagcgagtgcggcgatggctcgccggccgtgtacacgtgcgtggacgacctgtgccgcggctacgaccttacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgctaacattgctgataataaaggctctctgttaacccccgacgagcaggctcgcgtgttttgtctgagcgccgactggatccgcttcctcagcttgcccgaccacgacacggtgctgctgcgcgacacggtggcggcggtggagggcgcgcggcaactcgagatggtgtacccggcacccgagcacgtacaccgctggagctatctgtgtccgcccgagcaggtgcgcgtggtgatcgtgggccaggacccgtactgcgacggcagcgccagcggcctggccttcggcacgctggcgggccgactaccgccgccctccctcaacaacgtgtttcgcgaactggcacgtacggtggacgggtttcagcgcccggcctcgggttgcttggacgcctgggcgcgacgcggcgtgttgctgctcaacaccgtgttcaccgtggtgcacggacagcctggatctcaccgtcacttaggctggcagacgctgagtaaccatgtgatccggaggctgtcagagcgccgggagcatctggtgttcatgctgtggggcgccgacgcgcacacctgcgagtacctgatcgaccgacggcggcacttggtactcaagtcctgccacccgtcgccgcgcaacaccacccgcgccttcgtgggcaacgaccattttatattggccaacgcgtatctggacacgcattaccgagagaccatggactggcgactctgtgggtgattgatgataatagacacaccggggagacaaggtggtgaactgtgatgtctatctctttattgtaaaaaaaaatcagtaaccacaatatatatagacacacaccgaaaggggtggaaacccaaatgtccaagcgcgtcctgtttcatattttttccggtctcggctcggttttttaatcgtcgaaaaacgccgcgatcgaggcggcggcgatcgcagcttcctcgctgggatcgataatctcgagtccgtcctcgaggaacgagggccctcgccggcggccgctgccggcgacttgcgacaaccggagcagagggtcgttgtcctcctcgtcctcgtggcggttgtttctccgtcgcgatctccgagaggaggaggacgacgacgatgcggcctgccgccggctgtttctaccaccgccaccaccgccgcctcctcgggtattgttccgggcccgaccccgacgtccgcccggcggtggtggcggcggcggcagtggagcagaagaagacgaggaagagttactggcagccgcggcggtggcgacaacggggtttaccacgtagggcttgatttcacacacgggccggggaggagcagctggtgtttcgactgcggcggcaacgggcgcgacaccggcgacggaacctgagggtacaacaccggtggtgacgagtggcggacatgcggctgctggggggccaacgccggctgtggagacagctgcggcggtcctcgcgacgctgctgtggttgacgacgacagtcccgcccgacgtctctggcaagagtctgctggaaaccagggggagatcgcacaatcttttctccttacaatcattgagcattttggtcaatgactgtataatgtcatcaaaacgcggactgcgaggaggctgaggcgccgcggattcctgcgaattcggaggaacacggcagttagagactggagtggtggaatcattctcctcctccgactgcggtggtgcctccgccgcctcagccggagccctcctcatcctcctcatcatcattaaccccgcagccgccgccgtcgccgccgcctcggactcctgcaccgtctcgcccgcgctgtgggcgctgccgggtcgagggagcgaaagaagtgacgacggcgacgtcgacgacggcgacgaaaccaccgctccgcgctcaatgggtagaagtaacgcaccgtcggtgccggcggccacgtccgtcacggcgttatggtggtgatgatggtggtggtggttgttggaggaagaagagaccgcggaggatgaggacgagtaattgagaaaggccaccgcttcagacgtgtccagcggcagcgacatgcggccgctgccgccgccaccaccaccgccagcaccaccggactgctgctccgtctcgttcttgccgccgccgccatggccttcgtgctgtgcggtggtcttttgtctcttcgcctcccggaggggaggagagcctacagacgggacgacacatagcgcacgaaaaagcacatggttatcatccacacaaccaccagcgcaccaacaccgctcgcctgctcgctcgtgcgctacggggggctcacgagtccactcggaaagcaccgtgacgcgaagagggccgggactcaccgtcgttctcggaggagggaggcggccgccgctccttctgccggttcatcaaccggggatcccgcagcagtccgttggcggagtccgaggagtgctgaccgccgctcccgccgccgccaccgccaccaccagcgccgccgcctccaccaccaccggcagacgaggacgattttttgcgccgttcttcgtgacgctgttcctgccttcgccgttgctgttcctccgcagaagggccgtcgcgagtcccgccgctgccacccagcgaggacacgcagacggcggaggcagtagacgcggcgccgcaaccaccgcctccgctggaggattcgccgtggtttttcaggtaatgccgcacgtaagtcacttgcaaattaccgttctcggaaatcatagtgagcagcgcgctctcattgggtccgctggagcccaccaccgaggagacggatttgttaaagacgataccgccgcgtacaaagaggtgctcctgaagttccccgtcgcccgtaatgtcaatggacatgaagccctgctgcgtcttggcgccggccgaagcctcgccgtgctgcataatggtagcgcagagccagcccttgttgaggtgcagcaccttgccatcgccgtccacgcagttgaccagacgcgcggtatcaaagacgaactggcgcacgtcgaaagtctgattgacgctctgatgcaggatgcggttaggattcgcaaaagtccagtattttcgcacgacggtagtagggagatccatgacgcggcggcgcaaagcgcgagcgcaacgctcgtcggaggccgtggagcgagtgccgccgcagccggcagagcgccgaaccccgtcgcagactctatttatacatcatctttccagcccgcctagcaacacccacaaacaacgtcacgacgcaacgtggttaaacagtacgtttattaaagtaactgggtgaacgacaccggagcggactgcaaatcgcaacgctactttctcgagtgcagatactcctcgagacggctaaacaacgtgtccaactcgctgagacctttccgcgtgccgttatccgatttcctttccgcctcctgagacagccgactaatcacggacttatctccgcaacctaacagaggctgggagcccgacaaaagtaaaacagcgtgctatgaacacgttgttacctctgcgcggacagcgccgccacagagacacttacgcattgccgcatgtctttgtagatggattctagcgtcgagcgcatactatgcaattccgtcttgagtccgggatagacgtggtcgcctgcggggaacacgatctccagataccgccttaacaaccagtccatgacgctgcatccccaacagcctttgaccaccgtaccgtcgagccacacggagtagtcgtcctcacgttgctacaagaggaaaactacgtcacccgacacgcggaaaagaaagaccgtcacaataaaccgtacctacgtgacctaccaacgtaggttttactcgatgaaaggtgacgcggagatcttgcaatctggtcgcgtaatcctctggacgacactgcggctttgtattctttatcgtcgtcgtcgccggcttcgcctcctcggaagcgcctagaaaaaagacgattaggaccagagaggaagagaccatcaccgacagcatcgccgcagcatgctaccccagtccgccgcccaactgcgcgtcccaggtaggtggtcctttatgttatgatgtttttgtcaattttttttttttcaatttctttcttccgcggttagaatagtttctgtaggaaccaattatcaatctgacgggttatcgtcaccacttgatggcaaaacgaaatttttttttcattgccttgaagtctctcccgccaccaccaccaccaccaccgccgttgtctccggctggagatcaagacgaaattcctcctctctaaaaaaaaaggtggtgggctcaattgatcatggcaagaagaaaaactatactgaataaactgtgtgcaaaactactagtaacaacaaaaatagcgactagatacaccacggacaatctcagcagatactctctcaaaagaaaaaaagacgccgtaacgtcggagaatctggtatctactgcctgacgaatttttttttttcgtccatgtatgtgattacgagtagtagtggtatgtagaacaagaagaaaaatcgtagtccccaaaaggataataaaaataacactcatagagaatcacagattttctctagacaactctctatccaaataacgaatgtgaagcgtacaaagtaagatattcaaagaatagcaccttcatagattcatttcagctttctactccttgtaatttaaagttgcactaaacaaagctcttaaagaaggttcgagccgctctcgatcactcatcgatcacgcgagtcttattattccaccacaacgtaacattcttcactttgtagagacactttatcgtagagtaaccctcgatttcctagctgttgttttttgattattttgttcgctctaagagagatactcgaaatcctacttacaccaaggaccctacatcatcgcaggaagaataaacataccgtagaaatctcgacacgcaaacgcgaatgtacacgaaccaaaagccacagacccactatttctgtgccgtatttttttttgacaatctgtctgaatctgcggaaatagttacggagaagcaattctgttacaaaattcagtacgttagcagcaaaagataatcatttcgtgtgatagcaagtaaatcacctcacttaggatcgatttcgtgcgaaaaaattattttttctcctaatcaacagataatatggttaccatttagagtagtgtcactttactttcacggaagatgcaacccccgagaaaaagaagaatcgatcatagataaaagaaatcaagccagacttgttaagaaaaaaaaaagatcaaaaaattactacctaaaaagaacgcctagccattgggagacgcgcacgtctgtgtggtctccgcgatcatgagaacgaaaaaaaagacacgacaatacacaggctgacctttgaaaaccaagcctattgataataatctaccccatagaacaggatataatcaagcatccaaacaacaaacagcgccgccgtgcctcctccagaggacggtgacgacgtatgtctgtcgtctcccttctcgctctggcttctggggctctcctcctctccccatcatcttctccttcgtcccagacggacggctatcggttcgcgcgctcgtcttttcttcgatgtgcgcaggtttcgtcatcggagaagaagaccgcgaccgtatcataatgatgataataataatacattcaccgaccatctttatcctcttttgttgttccaaagagaaaagaaaaaaaaaacaagcagccactctaaccatcacactcacgagttaatatggggttaggggggaggaagagaaataccgccatgaaggcaagagcagcagcagcaacgacgtcactacgatgattgatgatgatacacgactaccactggaggagaggaaaacggagaaaactcatcgtgatgatggaaacaagaatgatgataataatgatgacgataaagccaccacacgatatatacagagaacaacaaaaccaccacgacgatgaaacaaaacgctcaaccaaacattgtgtaaccgctacgcgtccgtggccgcggccggcggcctcttgttttcgttgtccccttcgcgggggacatcatcgccgccaacccgcgtgtgccctgcctcacggctggtccgtgatgaactcttgctcgtaaccgccaagcgataaacaagccaccgtgatagaagacaccttataggaccatatcctagttacatagtagtgcatatatatagtaatagtagaataagtgaactttagacacgatagatgaagccatagtctgaatagtcatgatgttaggaacactatacgactagtacatacatacatacacccccttaggaggaacgatgaatcaaagaataatacatcatgtagcataagtacattaagcctttaaacgaacaaattgttaaccaaaatcgatcaccaccatagacgtactatcatcattacaacgaaaaactagacggatggatagctgtaagtctcacctagctaactaacgatcacattttttctccacgatatagtcaccacaaccatgaatgatagccgcctatttgaagtttgatatctcgacgaatctctatagtcatagcccgttctttttttccaagtatcctttagtccataagcattattataaccgtattacccagaaatctttgttatgagtctcttcgctgtcaactgattagtagcaagttgctgtgattttttttccaatcccataggcatccttagttaaaacattaagaagtaagtaggttctggatagctaatcatcttttttttttttacttcggtagattaaaacaaatgaaacacgtagctgttgttttttggtgaatatagtttggtaagtccttagcgggtaagttctaagaaacattagttactttttattgttctgtctcctctccccctaccttacgttgggaggtagcttcgtcatgtaggataataattaggtaagcaaacaacatagatagtgattttagtatagacaactcgtgtaagtgttttagtgacttgtaactcgactcggtagacttctcagagtttcgcctcacacaggcgggtacactcgttaagaaacgcaaaatacctaaaagggtacgttacatagcagataagttgatagatgaccgatattatacttcattaactcacgaagatgactgtaagtaaggatattgttgttcatgatagtagccaggttataaggatcatatatatctcgtcagggaaatacaagttagaccataatgttgactactttagagataataagacaccataggattctgaatttaccatgatataagttaagaagattgatatctgtcctttttttgaaacgaagataggcctttttattttttcgaattcatgttcgaaaacacaagcttccataacaagaacccgtaccgaagaaaagttccatcgactaaaaagaaaaaagaaaacgaagcaagacctcgacgacaacaacacatcaaagaaagacgaccagctgattatgttcttaggaattccacacacccgcgagccgatccgcaaacgtcgtgcgaggcgcgctttctctggctcgacacaatgatcacaccgcacgctatagacacgtcgtcgtggacgacgatgacctcaggccacgaatgacaaccaacatgggcaaagtccaattagccaaaaagacgacgattctaagaattgatgaatcctcgatatacgcctatcgataggtttcaattgtgtcatatacatcaaatgaaaaacaggacgcacgataaaagcttccttacagcataactgtaacatacgatcatcgaacatctcctcacatacctttctcctctcacataggaaaacaaaactctttttttttctttcctgtcaaggaaaaaatcaatgtaccaccacatcactttctgctcggtcccggcgacggatgggcgcgcacgcggacaaagacccaccggccacttccacttattttttgttgttaatcgtcttctcccccgcacgcggagcaccaccaagcctagctgctcattcgctcaaccagtcacaccgcgcacgcgagaaggggccggggtccgcgggcaccgccgccggaggcgcggttccctctctctaattccctggaaaacaagtaatgacaaacaaaaagacgacaaaaggtctctattctgctacatgagagaaattatagctgttggcaatttttcaaaatacatgttataaggcatcctctctgccacacgcgcagtcacggataggatcagtgcgtattcattataaaaaaaacacaaacaacccatatatgtgaagcagaatgatgaccgaccacacggagcgacgccgtcgactgacccacgcggcatgtacgccgtccgcgaacaaccaaaggacgacccgtctccccccgcacccgggttttttctcttggtcgaacccggcttgcgacgacgggttgttcctttaccggacgacggtcagccgcggggttgatacccagcgacggcgtcgctcccacccgggtttcttctcttgcaggtaccactcgtagactgtcagcctcgcgaggagacaccgcggaccagggaaacggataagtttacgaacagaaatcacaagagaaatacgctgacccgataagtaccgtaacggagacacggtggtttttattgaatttccagtgtatcgagccaccgtgatgcaggtacggcggttttatgtaaagtgccgctatctataggcgatgtgttccctgacggtgtgtgtttttttggggatagacaacgtggttcttgtacgtggtttttaccctgctcaataaagtcacgttttcattacacggtgttgtgtcaaaaaataagcgtggtgcgtttgtctttgagcgcgcgacagatatagggggtgatggcggtgttcttctcatagggcagtcgcaacgggttaacgttcatcatgaggtgctcggggtccgtgactcgcgacatggccacgtagatgtggctcatcttgaggttcttgggatggtccccaaagtccacggccaccttctcgagcgacaggccctgactcttggcgatggtcatggccgtgcgcgaagtgaggccgtagtccacggtggtgcacacgtgcagactcttgccctgcgccgactcgacgaagcgcgaaacgttaacgtcgagcacaaagaggaacccgagcgcatcgcgtagcaccagccgcgaaaggccgcgctgcaccacctcggggtggatgcggtggcggtcactgggcagactgagcacgttgtcgctggtgtagccctcgagcgtgtacgtctgcgccggcgacacatgcgaaagcatgcccacgaaggagccggtctgcgagctgatctgacagttggccttgaacaccacgttacggcgattgtaggtaacgagcggcaacgtggcgaagcgaccgcccgtgagacgctgcatgagctggtagcgcttgagaaaaatgtcgcggaaggtagtgtacatgtgcaccgtctcctcgaaagaaagcagcgccaggctaggtggcttgacgtatttgagaaaaaagggatccgcgtacagactggtgtgatccatgagttcggcgtccgtgacggcgtccgagtcgtcatggtggttggacaggcaggggatgtcgtgggtctcctcttggccatgttccatccgttgagataccggcacgctctggccgccctgagaagaatccgcgtcgacgtgattatttatcggattctctcccccgctccaagcgggagcggcggccgtggcggcggcagcggcgcagagcgaactcacgtcgggcagctcaacgcgcgccagctcacgcaacatctcctcggtcgtgtagggcgacacgtagaagtagtacatggccgagaagagcaggcccgaaactaacgagtaggcgtaggccgcctgctcgcagggcgtgcgttcgataaacgtgtccttttgcaagatgtccacgaaacgttcgaccgtgccctggtatccgataacacaggcccgcaccttagagttgactcccaccgaactgcccttgatgtaggtaatgcgcaaggtgagcagcgtctcacggctatcgggcgcggtggtggtatcatcgtcctggaaaaacgccgtctcgtcgttgccgccggtgctcccgattacagatcctccccctccgtgagcctggacggaggagttgttggtggcaacgacgtcggccgcggggcgcagcgcctccttggtgatctcgctggagaggttgtggtcgacaaactgcgagtagttaatgatgcgcgccaagttctggcggaaccagagctcgacgggctgcggcgagtcgcccagcgggtcggccagctcgcagagctcctggtacgcgcggttgttgaccacgcagtagacgggcagatcaaagagacggtggcgctcgctcaggcggatctgctcgtgcagccgcttgaagtaagcctgcacctcgacgtgcgagagaaaaagccgcgtcatctcggcggcgtacgatgggttgcggatggagctgggcggccgcacgaagcggtccacgtaggccacgtgctcctccttgagcgggataccgaactccatgtacttgagcaggtcgccaaagtccaggtcggtgcaacgcttgttgtgaataaacatgacccagttgtcggcgatgtcgcagtagttgatgagcacctcgttctgaatcagcgccgagagcacgtcaacgcccttgcgcacgctcttgttttgcgtgtagtggtcgtagcggctctccagcgcctcggtctgcgtgggcgaaccgacgcagatgatgcagggcacgcggcgttcgcggtaaagtcgcgtgtcgcccagggcgttgtaaaagtagtaaaaaaacaccaccacctgcagcatgtagcgcagcataaggccgcactcgtcgatgacgatgatattgctctcgcacagctccgagaggtcctcgcaggcggcggctgcggccgcggcggaggccgaagcggccttgcgctcccacatatttaagcatttgtccacgatgtcggcgatgaccggccagtaggcgagcagatcgttgatctgcaggcgctggatggtggtctcctcgtgcggctcgcacacgcggtagcgttccagcgtctcgtggctaacggcgctgtcagccagcggcacgtgcttgctgacgaagccgaagacgcggtagatggtcttgacctgcgccgagcgagtgcggttgaggatcgcgctgaggttctgcgcggcgatcaccgtggtaccggtgatcacgcaatctagattggccgccagcacctggatgctggaagtcttgccggcgcccgccgtgccggtgacgagcagcgcgcggaagggaaagaagggccaacggtcgacgcagggcacgcgcgtgccgccggcctcggacgaagcggcagcggcggcagaagaggaggcggaggagtgaacggtcgtcgttgccgcggcggtagttgcggcagaggggttgttatctgtcgttcgttcaacgcgactgatggagcgaaaccactggaacgaaaaatcctcgggcgcaaagcgctcgcgcgagagggacttgaccttgtcgacgatccgttcgatcttggcggccgacgagaggttgaggatcaaggcgtcgtcgtacttgggcgtgggccgcggcgtggatgacgaggccgtcatcgacattttccccacggggcagacgatgagcttcctgcggttgctgcacggctttctggggacgtgtcgcgggcaaagcatgcaccaggtgctgcgcgacccgtgcgtactgcgcaagcagctgctctacggagtgtgcaaaacgctctttgacaccatcacggtgcggcgcgtggccgaggagtggaagttgcacgcggcgctatttccctaccgcgcgctggacgaagaggacctggagcagtatctgttggtgtggagcgcctcgttgcgccagagcgtgcaaacgggcgtgctgggcgcgctccgcgacattttatatcagtacgccgataacgacgactatggtctctacgtggattggtgcgtaacggtgggactggtaccgctgctggacgtgaagaccaagccgagcgaggcggccgagcgggcgcaatttgtacgcgcggccgtgcagcgggccaccgagacacacccgctggcgcaggacctgctgcaggctaacctggcgctgctgctgcaggtggccgagcgcctgggcgccgtgcgcgtagccaacgcgcccgaggtacgcgtcttcaagaaggtgcgctcggagcggctggaggcgcagctgcgcggcaagcacatccgcttgtacgtggcggccgaaccgctggcttatgagcgcgacaagctgctgttcaccacgccggtggcacacctgcacgaggagattctgcgctacgacgggctctgccgccaccaaaagatctgccagttgctcaatacctttcctgtgaaagtggtgaccgccagccgccacgagctcaactgcaagaagctggtggagatgatggagcagcacgaccggggcagcgacgccaaaaagtccattatgaagtttttgcttaacgtctcggacagcaaatcgcgcatcggcatcgaggacagcgtcgagtcctttctgcaggacctgaccccctcgctggtggaccaaaaccgtctactacccgcgcgtggtccgggcggacccggcgtggtgggacccggcggcgccgtggtgggaggacccgcgggccacgtcgggctgctgccgccgccacccggcccggcggcgcccgagcgggacatccgcgacctgtttaagaagcaggttatcaagtgcctggaggagcagatccagtcgcaggtggacgagatccaggacctgcgcacgcttaaccagacctgggagaatcgcgtgcgcgaactgcgcgacctgctcacgcgctacgcctcgcgccgcgaggactccatgagcctgggcgcgcgcgacgccgaactctaccacctgcccgtgttggaggccgtgcgcaaggcgcgcgacgcggcgcccttccgtccgctggcggtggaagacaaccgcctggtggccaacagcttcttctcgcagttcgtgcccggcaccgagtcgctggaacgcttcctcacgcagttgtgggaaaacgagtatttccgtacctttcgcctacggcgtctggtcacgcatcaaggggccgaagaggccatcgtctactccaattacacggtagagcgcgtgaccctgccctatctgtgtcacatcctggcgctgggcacgctggaccccgtacccgaggcctacctgcagctctccttcggcgagatcgtggccgccgcctacgacgacagcaagttttgccgatacgtggagctgatttgcagccgcgagaaggcgcgtcggcgccaaatgagccgcgaagcggcgggcggagtgccagaaaggggaactgcctcgagcggcggcccaggaacgcttgaaaggtccgcgccgcgccgcttgatcacggcagacgaggagcggcgcggcccagagcgtgtcggccgatttcgaaatggaggccctgatgatccgcggcgtgctggaggtccatacggatttcactagacagaatgtgatgatcatggagccgcaagtgctcgactttacggtgcgcggcgacaagctgtggctgcacacggagcacgggctgctggtttccatggccgagtaccgcagcgagttgctgtgcacctcggcctttctaggctactccgccgtgtttttgctcgagaccgaagacgccgtcacgcaggtgaggctctcggatctgcggctcaaacaccgctgcggcatcgtcaaagccgacaacctgctgcacttcgcgctctgtaccgttatttcgtgcgtggaaaattgcaacttaacgcgcaagtgcctgcacgacctgctccagtatctggacgcggtgaacgtgcgcgaaagcttcggccggctgctgcaccacagcgcccggcggctgatctgcagcgcgctctacctactctttgaggaaaaagagccgcatattgtgcagtacgtgcccgctaccttcgtgctcttccagcagacgcggcatacctgcctgcagctggtagcacgcttctttttccgccttaccggtcaggacgaggcacactcgttcagcctcaagctgaccgagcgtaagaccgtggacggttggcccgtgggcctgggcctgctagacgtgctcaacgccaactaccccaatttaccctcaccccccaagctgccgccgcgctgggaacgaggagaggaagagtgagaagcgaactagacacgcatatcatagaataaaaaaaacacgcaacacgtagtgagctttgacgtcccttttactagtatccacgtcacacgctaagagctttgacgcacttttttttactagtatccacgtcacttacccacgtagttcccctacgtgactcgttaagcgttgagccggaaaaaccgcaggccctcggaagccacccgcttagcggcgtgttgcgcgtcaaccgccagcgagcgcacccactcgtcgcgctcctcgagccaagtcgccgacgaagaagaacaagacggaggagacaccgtcgccgtgcccgaagaggacgaagtgacggacggcaaggcggaggagagaacggaagaagaagaacaagcggtggtggaagcggtggaggacgacaataactctcgcgcccagacctccacgcaagccgtgagcatggcaaaggccttgtccacatagacgccgtagccgatatcggccgccaacgccgtatcgcgtgactgtacgatgatctggccctgctcggcccacacgccgtggaagggcgcgcagtcaatcaccccggcgtgcggccttacttcgttttcaccgggctggaagcgcagtaaccaaaagtccacgtcgttgcggcgagccacgaagcgaaagaggatctcgcggtacacggcttccagctcggacacgctcacgcgctcccgtaacagcgccggcagccggcccaagacatgacccacggccgagagccagtcgccaccggccgcgcagcaacagccacccaacgccgcgggcggcgtggagggagaaacccgatcactaccgccgttatgaccactcccggcagcggcatctagaccgccgccactcgcgtggtccgcgtcgcccacgccactaccaccgccgccgctagaatggcggtgagtgacgacgcagcccgcgcaacaagcgccgccgcaatgtcccgccgcgaaaccacccaccaccccgtggagcggactaccaccggcgccgccgttgccgtagaagaagttgaagggacccaccaaccgctcgtcgccccagaccaacagcacgccgggcgcgctctcttgaacacgacaggtgggacctggatcgtcgccgccaaaaagtttgcgccaataacagtcgaccacagtccgcacgcacacttcggccgagacgggtccgtgacccgaatagccgtcgtagacataaaactcgcggtggccgcgcgacagaacccacaaaaggccggccgaagcgcaggctgacgtaacgtgctcggagatgtagcccagcagactctggatctgccagaaggcgcgtcgcgagcgaaaacgcagattttcaataaacttttcacaaaccgcataagtgtggagtcgatgactataacgcacgtagggattgaagtcgcgcgcgcgtacacacttggccagcacgcgctcgaccaaatccacgatgagcactcgatgtagcgtggcgtcgcgaacgtgcacggtgaaagtggcgtcgtcgctcggcgggtgcgcaccgccggtgctgctgctgacttccacgacgttgttttcaccgtcgccgtcgtcacgcggcagcggcggcaacagccagcgacgatcgccgccggccggtcgctcgcgaaaagccgtggcattgagacgcacggcgccgccgccggcctcggtgccgaagacctgccactcatcctcgggcacgccgagcgagagcgcgcagggttccacctccagcttgccggccgagcccacgatgtcgggcaggccgcaccacgagagcacctcagccgccgcgtccaacgccgtctcgcgcattaacgtgtgcagaccgtggaccgcgtagacgggcacgggcgggaaaccgggaaaaaagaaagaacgggcagcgcccgtctcaaagaggtccggccccaggtagtcgcgtagcggcggctgcccagcgaaaccacgaaaaagcacgtcgtaaaggtgagtccaggccgactgcagcaataaacaacactgctcatcggtcactgccacggccacgaaaccgacgggcgtgaccagacgcagacaggtgcgcaaaaaacacacctcgcgcacctcaaagaggcgtgccaggacggcctcgtcgtcgcgctccagcacatacttgtgagtgccgacgcgaaacgacatggccaaatcgtaggcgtagtaaccgcgacgcaattttttgtgcgcgtgggtgccatactcttcggagacgcgttccgcggcatgcgtgaccacacgcggctcgtgcacttcgggatacgagccgatgaccactaacttggctacgtggaaaagactaagcgcgttcgacagcgctgcggtttccacgcccaatgccggcgcggcctccaagatctccacgccgctagcgtccgtctgaatctgcaccggcgtgaaggtgcgcgccaacacgcggattaacgcgctgccttctagcaacacgcgcgccaacacggcgctacgctgctctaggccgcgccggcgctcgtcggcgtccgtagtcacggccgaggccagcgcggcgtagctggcgcgatgcacagcacgcacctcagccggcggcagacggtcaccgcgcaccacgaacgtgtgaagccgcggttcggcacggccgccacccagatccaaaaacagacattgtacgatgggcaccgaggcctccagaaggccgtaccagctgagatgacagctggtcccgaacagggtgtacgggtggtggcggtggtgcagcggcggctgagcggtcatcctcggacagaagagagtcgcgaaggcccgcggggtcttttttcgccgaccgcccggacgcgctcaaaccgcgtcgtgagccgcggcggctcccatcgtagtatttaacgacccgcgagcctgtcgtcatcggcgcgcccccatcgcctcccgagcgagcgggccgccgctatcgccatggccccctcgcacgtggataaggtgaatacacggacatggagcgcttctatcgttttcatggtgctgacttttgtcaacgtcagcgtgcatctggtgctgagcaattttccgcacctgggctacccctgcgtctactatcacgtcgtggactttgaaaggctcaacatgtcggcctacaacgtaatgcacctgcacacgcctatgcttttcttagactcggtgcagctggtgtgctacgccgtgttcatgcagctcgtctttttagccgtgaccatctactacctggtatgctggatcaagatcagcatgcgcaaggacaaaggcatgagcctaaaccagtcgacacgcgacatctcgtacatgggcgacagcctcacagccttccttttcatcctcagcatggacacattccaactattcacactgaccatgtcatttcggctgcccagcatgatcgccttcatggccgccgtgcactttttctgcctgaccattttcaacgtgagcatggtcacgcagtaccgcagctacaaacgctcgctctttttcttctcgcgtctgcaccccaagctcaaaggtacggtgcagttccgcacgctcatcgtcaacctggtggaggtagcgcttggtttcaacaccaccgtggtagccatggccctatgctacggcttcggaaacaactttttcgtgcgtacaggccacatggtgttagccgtcttcgtggtctacgctatcatctccatcatctactttttactgatcgaggccgtcttttttcaatacgtcaaggtgcaattcggctaccacctgggcgccttctttggactctgcggcctcatctaccccatcgtgcagtacgataccttcctcagcaacgaataccgcaccggcatcagctggtcgttcggcatgctctttttcatatgggccatgtttacgacgtgtcgcgccgtccgctactttcgcggacgcggtagcggtagtgtcaagtaccaggcgctggccacagcctccggcgaagaagtcgctgcgctcagtcaccacgacagcttggaaagccgtcgcctccgcgaacaagaggacgacgacgacgatgatgaagacttcgaggacgcttgaccccgccgccacccgcaccagacttggagacatggacataaaaaagagacacgcagaccgtgggtcgggagcacatacttttttttttattaaaggtttatctgttcttccaccagctactttacgtgtttcaaacagcacattagacacacgggggcgcaaacacacacacaaaaaaaataatatacacacggagaaacacccacgggtgtcccattcccgactcgcgaatcgtacgcgagacctgaaagtttatgggttaaaagggcaaggaggcggcgggcttttttgtcccgggggtgggtggacgttgtgaaatcttcttttggcgcggagtcctgggtgtgtcgggccgcggcagtcgcttagccaccacctggacgggggggaccgggggcggggacaggtaaattgaggtgtcctcttcgtctaggtcgtccgtctcctgcataatggagctttgctgatggtggtgacgttttgagggtttctttttcttttttgactgcttgctcggtttcggagccttgtcctcgcgaaacgtcgagcgcaccgcgtttttcttggagccgtcgtgggcggcctcgcggtggctgccgctactactgtcgtttcccccgcagctactaccgcagagccgcagcttctgttgccgctcctcgttatcgtcatcctccccgtcgtcatcgtcctccccttcgtccgaggaggaagtcggagggatgttgtcgtaggagcgtagagacacctggcgacccagagcatctttcaggggctcaccgggcgtggtaccgaactcacaacatattcgtttgcagagttcggcacccatatcggtaggttcgtcttgcgggacaggtcgcgactccaacggtctagcacggtagagacggcatggcgcgtaaactgagggtcaaagaccacgggcgtgacgatgagcaggagcgggatgtggtcgcagtggaaaacgcgaccgccggccagcaactcgcagcccagttcgctttcctcgcgctcgcggaagatggccgagaccaggtagacggtaggcaggtcgcggaaatcgatccgctccgggtccggatgcttctttatatagtattggctgagcacgtactgctgaatgagcatctgaaagtaatactggtgacgcggattgacaaaagccggcagtgaaaagcgcgctacctcgtacacgttgagccggcccagcagctcgggcgtgttttcgtcctcgaaaggtatcggcggcggcgaatcgcccgggctgccccgcaggtggtgatcagcgccgccgccagcggcgtcgcccgcggctaggccgagactcgcgttaatagtggtcgtggcgtccccgtcgctgttgtcgtcattcaggtgcttggcgtcaaacacgatcacttccgaacactcggccttattgagatacagcagatcggccaggtactcgcgcagcggttcgggcggcttgagcgggcgcgcgcgcttgagcgtggccctgaagagcgccgcgtcgtgcgaaagcagaaactcgcgtgccgacggggtctcgcgttcaccgcgaaactccacgcccggcaccgggtgtgactgcaacagcgaggccacggccgccgcgtcgtgcctccgcagcacgttctgcacaaaggggtcctcctttttgcgcaaatatttgtagcggcacttgatctcgtagacgcgcgcgcacggttccaccagcaaggtgcgaccgctgccctgcttgagcacgccgaagcacaggtccatggaagcgcccagcagccccgacgtggggtcgatgagcagaccgaggccgtcgcgcaccggctcgcgcccgtgcatcacgtaacattccaccagcgttttgactaagccctcgtgtttgataccgaactggatgcccggcgagacgccggcgcgcgagcccgtgtagtgcgagccgccgccacccgaaccgtccgccgccgcggcgccgggcagacagccgctgacgaaggcctcgtagaacttggtggccgagaccgtgtccatacgcaacagatgccacaccgagttgcgcgactgtccgcgcgattccttttccagcaactggaagagctcgacctgtcgatagttgggcgccaaatccagcaaccggctgagccacacgtagtcgtccgagccgccgtgccggtcgtcgcaccgctcggccacgcgctccagggcctcggcgatctcggcgcgcgaggcttcggcggcgtgccgctgacccaaaatgtcgcgcagaccctcgtcgcgagccagcgcggccacgcgcgtcataaagtcctcggctactggcgtaccgtgggcccgcaacatcttggcgaagatgcggtaggcgtaagacagacgcagcaccgtaaagggcagattacggaagccctcctggtgcagcaaaaaggtgttcataagaaagagactgaggggctcatcgtcccaaaccgccagcagccgggtgagctcctcatcgtcgtcgtagtccaaactcgagacgccccacatgatgatggcggcgcctcggtattttccccgccggtgggtttgtaccttctctgtcacctttcccctcagcaaccgtcacgttccgcgtcccggttactcggggaacagttggcggcagtcaccgtcaaggtcctcctcgcagattatgctggtagtgcgccgaaaggcgttatataaatacagcccgtcgctcgtggccaacagacgctccacgttctttctgacgtattcgtgcagcatggtctgcgagcattcgtggtagaagcggcgaaaggcgcgtacgcgacacgaggacatcttggcctccacaaagcgcagcgtgtgcgacaccagcgcggcgccatgctcgcccaggagacaggcgccgtagctcatttgcgccgccagaatgagcagacaggcgtcggagcagtgcgtgagcttgccgttctccaacgcgcggcaggccgcgccggcgtgcttaaagagcaacgcctccgtgcccatgcgcacctcgtccagaccgcgccggtccaacagccgcatgaggcaaaagcccagcacgttgcccagcgccgacagctccgacatgcaataacgccgtaggccggctacggggaaacgcgcgtgcgggtcgcagatgagcagcttctgcagcggcatgggtcggaaagcagggtggtaacattcgcgcagacggtgcgagcagttggggatgcggcgcgccgtgcccgtctcctgaaagacggccacacagcgctcgttgtaatccggatagggctcgctgaggctgtaatcgcacagcgcggcgcgcacgatctcgctggggttgtgcgggttcacgtcgatgagcacgttcatgggtgtaatgtcaaagtggcatacacgacactggtgattgagaaatttgatagcgtcggccaacgtgcaaaaggcacgtcggtagctgtcgatgcacgccagcttccactggtcgtgatgaaacatgtctgtgtggaaacgtcgatgtaccgtgacgttgtgcagcagacagcagcccgtggccgtgagcagaccgcggtgcacgcccgtgcccaccagcgacggcggctgctgttgctcgccagcggcgcgcgtgcggatcagacccgacatccagaccgtaagcaccgtctcgctgtgcttacgcgccaccttgaccacgcgatagcgatcgagcggccagacctcgccgaaggagccctggcccaggcggtagctctcgtcgctcatgtccacggcataacagatcttgtggcaaaaatcgtcctctttgggcacgtagaccagcaggtaggagatagagagttcgcagagctcgggatgcgtaaggcgcaagaacatacgcgggtcgcatgtaaggccgcggatggacgtggtgatgatctggtcgttggaacaggtgcaatgcacgtcgtcgtgcgacgtggagtcggcctccaccgccgtggcggattcctccccggaactaccgctgagcgactgcggaacgcggcccgggcccgatgccacggcgctgtcctgactttccgcgcgcagctccacgtcgttttcttcgagcaccgcgtccacgccgcccacacgacgtcggcacagcggggtgcgggccagcgacaccaacggcggacgcaacgggcgtttgcgtccaccgcggacgccgctcacgctgtctgaggggtcgctgccgccggtgaagagagcgcggcgtacgctggtcacgtcgccgtcgcgatcgtactcgaacgaccacatggccgaggtttcgcggcagcgcaagccgtggtaaccgtcgccgctggcggcgctgccgcgagacgacgtggacggcaccacgggccgacgcaggttctccttgtccgaagccgcgtcctctttttctccgtcacgcatcacgtcacttcgaacgcatgcggaaaaagtcgcgtgtccaagcacggtggttgtgctgacggaactcagagtggtcaacgtggtgacgccaccgccggcctcgtcggccatcagatccacgacctcgtcttcatcgacgtgagcctgggcaacctgagcggcggcggcctgcgcggcctgcaccgcggcttgagcggcggcctgcgcagcttcgcgcatccactggcgccggcgcgccctgctgggacgacgcaatggcggcggatcccagccctgagtcgtcgttccgagcgaggccgagcgagcccgagaccgaagtgcggaggacatagtggcgacagtcttccctgttcctagggctgcactagctaccacaccgacactgtcgttatgttgtgttttttttttaataaaatctgaacagaggcgtgacggagattgctatacctgttagacggcgtcgtcgacctccaggtccaaatcgcacgtccccgaaaccgagtccaccaaggtggctctcacgtcgtctaccgtgtccttcagctcggttaaagagtccagcgcgtcgtccacgttaccggattgcagctgtcgggcgcgttgcaactcttgctgcacggccgcccgttgctccaacaggtgtgcggccacgcactgcgtcgttcgctgactgtatcgggtctgttcccgagcggccacacgcatcaccgtcaaagcctgctgcgtggtgagccggtgctgcggtccgtaggtacgccgcagaaactgatgctgctgtcgctcaaggtcgacgcgcatcacgtcctttaagagctgtttgttgaccgacgtcatagattcaacgtgatgagacccgcgtcgttcagcgagagagcgtccagcaacttgccgacgtggtagacggggaaaagcgagacggtgctctggccgggcaagatgtggctcaaagtgacgtcggtgacagccgcggcgcagtcttggataacgatggggctataactcacggtccgcgcctcgtcacgcgcgagatctaaacagagacggttctgactgtagagcgcgcacaacaaacaggtgcgcgacgaggccggccaggcgggcacctcgcgccccgagaagcggccgcgcaccgcctgcaacacctctctgagacggtccagcgagacgggctttaaaggcaaatgcacctcgtcgccggcgtcatcgacccggcctgctgacgcgctcgtctcgaccgcacaagcgccggccccgccgccgccaccactaccaccaccaccacccgccgtcgtcgcctgcggcgtcggcgcagggaattcgtagccgcgataccaaacaaagacgtacagctcagccagattcatgtaggtcatatagtcccgcacgggttcgtaaaagagtttgggcaacaacgcggggaaaggacaaccgttcttttcgcgaccgaaacaggtgtcacgcgcgcaaaagctgcgcggtccacagtacagcagccacagcagggcctccacgtcgcacacgttgtgatgatctaacaagcccggcgtgtacacctgtcgcagcacggcttccacgtgttgcaccttgttgctggagagtgacagctccacgtgagccttgcgatacaacatgtaactgccgtagattaattcgccgtcgtaggtaacacggtcagcattgcgtaacgcataatcacgcacacaaagcgacggcaaaggctcagccgcggccgcgaaacgctccagcacgtcgtgtcgacgtagaaaagacggcgtggcggcgtcgtttttcggagcgcgtcgtctacgacggcgtttggcccgagacccaccgtcgttcttttcccccgcggttttattcccgacgtttttctttttgtcctccggcccgctatcgccaccgccgctactgctatccaacaccggcacctcggccgactcgcgcggaatcacgttggtgaccaataagaaattctcgtcgggcgtttcaattaggcgaaagcgatcgtaaggtgacacggcctcgcaggccaccagcgccatatttacggcctcctcgaagcgccaagcctcggagaccgagaaatcggcggccggagactgcgccgacagctcgaccatccgttccaccgagcacagggacgttgaaaccccggcggaccccggagacctgacggcagttgagggggaggagacggggaaactgagaggagaggcggaggaagattcgtccgagcctgacgccgaggaagacgacaccactagggacgacgaagacgaacgagtgacggcgcccgtcccacaagccacgtccgcgacaacgtggttttcgggtagatcctccgtcgtcctcgcggccgccatctttttcctctcctctcgacgctgccgcctaacctccgctcgcaccaccgccgccgccatcatgttgcgcggagattcggccgccaagatccaggagcgctacgcggagctgcagaagcgcaagagccaccccacctcctgcatctccacggccttcaccaatgtggcggcgctgtgccgcaagcgctaccagatgatgcaccccgaactcgggctggcccactcgtgcaacgaggccttcctgccgctcatggccttctgcggccgccaccgcgactacaactcgcccgaggaaagccagcgcgagctgctgtttcacgagcgcctcaagagcgcgctcgatgaactgacgtttcgcccgtgctccgaggagcagcgcgcctcctaccagaagctggacgcgttgaccgagctctaccgcgatccgcagtttcagcagatcaacaacttcatgaccgactttaaaaagtggctcgacggcggcttcagtaccgccgtcgagggcgacgcaaaagccatccgactcgaaccgtttcaaaagaatttattgatacacgtcatcttttttatagccgtgaccaagatccccgtgctggccaatcgcgtgctgcagtacctcatccacgccttccagatcgacttcctctcgcagacctccatcgacatctttaagcagaaagccaccgtgttcctggtgccgcgacgtcacggcaagacttggttcatcatccccattatctcgtttctgcttaagcacatgatcggcatcagcatcggctacgtggcgcaccaaaagcacgtgtcgcagtttgtgctcaaagaggtcgagttccgctgccgccacaccttcgcgcgcgactacgtggtcgagaacaaggacaacgtgatcagcatcgaccaccgcggcgccaagagcacggcgctttttgccagttgctacaacaccaacgtgagtagctccatgatgataacatacgccttgccacaaaccgtggcgagtccatgtcctcctttctttgttgtttcttgtttcttctccccgtgaactgtcagaccccgttagtgcactaggttcttaagcaccggacaggaacatactatcatacgtgacacaggttcctctaccttgaccaggtcccacacatcggtcttgacgggcagccatcggccctcagaatccttaacaccgatgtgataatccaggccgtctcccagtgtgacctgcgccgcggtcttagaacctacggcgcataggtacttggcgtcatcgctctcacagaaaaaagtcgcgggttcctcgttgtggatgagcgactgcgtcatgggcccacagggcacgtaacaaagacaacggcccatatcgggggtgcaacccacgtaattgccagtgggatctacgtgtccctcgtgatccgtgcaaaagctgcaacccgcctgcccgcaggccgtggccgccgccatgaggcgcgtcatggaagggatatcgcaccgattgccgcatgaggtaaacaggtcgtaacacagaatgtaaaagaaaagcgtgtagccttcgggacgcggcagcaaccaggcgccggcgccgcctagcgtcactgccttctgacaggtcaggtccatggcaccgtgacccttgaccaggatacgcttggcttcatcctggggcaccaacatgcagacctcgtaaatcacgtcgggcgtaataccatcgcacgtcatactgctggtcacctggctaaagcttggcaagaaatcgatgctggctggacccaaaggacctccgaagctcagttggtacaaggtaggtagatgacagatgcgtcgacgacgccgatgtacgtgattcacgccatagtggccttgataacggccgttgcagcaaaaacagatgatccattcgccgtcgcggtagagcaacagcaactggcataagatacacgagctgtcgtcctccggactaaagatcgtcgaacggcaagcgacggcccgatactcgcggtgtttccggctcttgccgaccagcttccacatgcattcctcttgcaagaactgcttcaaagttctggaatcggtctcgcaaagcccgctgcgccaagccatgaagagtgacgcgcgagaacacagcaaagccgcccggcagcacccagtaaaagtccaagtctggcgtgacgtagagcacgcacacctcgggctgcgagagccaacgtcgcaggcgtccgcggcgatcacgaacgatccaaagcccggtgcgaggacaacgcgccgcgcgcacttccacgcccaaatccacttgcgcgcgaacgcagcgcaccacgtcagcgtaccaagtccgttcggcgggcggaccgctctcgttccgcggcccgaaaagcagctcctgcggtttgggcgccgggcgctcgcgctggcgacgagctcgctgagcggcagcggcggcaccccggctcagacgaggcgtcagcgccttaataatacagctacgcacgtccgcccgatccatccagagcaccaaggcatgacggcaaagttcccaaacaacgcgccaggacatgttccgtggcacgtggcaggcgaaacgctgtggcaacgcgccgccgtcccgtcgtagtacagcatagatctcgtcgcgcacggcgcgaatcagcacgtactcgacggcgatgcgcgcccgataagcgtccaacgcccggtatagttcgacttcgtggtcatcgtagctcagctcgcgattgcgccaaaaggaattgacgtaccacagcacacggaggcgcacgcgatgctgcacatcccaaacctcgcggagacgcgagacgccggcgcccttccactcgtccgtacgcgcgacctcgtcgcggtcgtgcggatcggtggcgtacatgaggtctggatttacgtccaggcgcagctgcaccaactcgtgaccgcgtatcttggaaggcggctccaatggacccgcgtgatagatgaattcctcgtcgccgcgcaacaaacgcgctacccgctgctccaggttactgaatctgccgccgccattcgcggaggaggttcctgctccgttcggaatttcgaaaaatggagtactgacggccgtctccaaagaagccatagccgtttcgggcaatcggcgatccgacccattgtctaaattgttacgcagtccgccccgccgacggtgattcgtggccgtggccaattggtgctgccggtcgcgcttgttcgcttccatttcttctcgtaacaggtcacgcgctaaaaattcccagtcacgatagctgccgtcgggccagaccagtctcaggtgtagcgtctgcgcgcctgagagccgattatcggggcagcgcagacccaacgtagtgaagacggcatagaacatgcgcacgcgctgctctttctctaacgtcacagtgagaccgctttgacgtaggtaatcgagcaactccagtgggcgcggtagtacacgaaaacaggcccgctgccaagtccgccgctcgcggtcaaaagcgcgatcgccgcccacggcgtcctcggcgtcgtcggaggccggtgcgtcgtcctcatctccacccggagcgcggcccgcggatcggccagcgctgtctacattacgatagtagacgtagcgcagcgtctcggcctcctcgttactcagcacctcctggtcgagcaccaggtgtagaggcaattgctcatcatcagcgaaccgcgcttcaaacgccagatccgaatacaggtgcgtttccatattcggaacgcatctgtttcagaagcgcgtcctcgcgtttcttacgactaaccttgatgacacacgcgtcgtacttggtctgctttgagtagataccgatgataagctgaataaaaagttggctgatgacgggcaccgaaatacggttgacgttatgcatagaacggaaaaccttattaaaggtgaagtaaatactgtcctccacctgctttttgaggcggtcgcgctcgaccacctcttggatcacgtcggcgtaacggccggcatgcgtcatgaggtagctgtacacgccgctgagcacggcgctgatgatgttgacgtcgtccagtgcggcctcctcgatgggttccaacaggtggctacgcgccaccggatagagagcctcgtataccaggcccgtcttgacgcagacggagccctcgagcgtggagacgagcgcgcagccgctgcccagatcacacaggtgcgtgcgaaagcagcgcgtgcacgcgtagagcgagtgtaactggatctcctcggtaaacgcgttctggacgtgcctcatgtcacaggcgcccgaggcgtcgcacatgacgtctgagcgccgctgacagttttgggggcggagggaataggagaagggcagggacgacaggtgttgcttgtctccgcgacgttcacgtccgggtgactgcaggcgtccaggatgtcgttgacgcactccaccgtcaggtgctcgaacacggacgcgaccagttccaagcggcgcgggcctgactcctcggcctggaaaaggaaggaaaagtgttgaaagaggcggtcgacaaagataaaaacatcctccgtagtggcgtgcgcgacccccagtcggttgagttccgccagcaacgagttcatggcggctgtggcgggtcgcgacgacgacactttcgtttttatgggcgcgcgtcacgcggcgccggtgtcggcggattggttccggttttcaggtcgcagcccggttggcacacggcgatcccgcctcacctggcggctcacctggctcacctgtccggccccaccccgactctgtaggcttccagccgagcgtgcgtaatcataagagtcccttttctgtctcctctctacacagagcatccgaggacaaaacttccacttgctgctggtggacgaggcgcacttcatcaagaaagaggccttcaacaccattctggggttcctggcacagaataccaccaagatcatcttcatatcgtccaccaacactaccagtgacgccacgtgtttcttgacgcgcctcaacaatgcgccctttgacatgctcaacgtggtctcttacgtgtgcgaagagcacctgcacagcttcacggagaagggcgacgccacggcctgtccttgctaccgactgcacaagcccaccttcatcagcctcaactcgcaggtgcgcaagacggccaacatgtttatgccgggcgccttcatggacgagatcatcggcggtaccaataagatctcgcaaaacaccgtgctcatcacggaccagagccgcgaagagttcgatattttgcgttacagcacactcaacaccaacgcctacgattatttcggcaagacgctctacgtatatctggacccggccttcaccaccaaccgcaaggcctcgggcacgggcgtggcggccgtaggcgcctaccgacaccagtttctcatttacggcctagagcatttctttttgcgcgacctctccgagagttctgaggtagccatcgccgagtgcgcggcgcacatgatcatctcggtgctgagcctacacccttacctggacgaactgcgtatcgccgtggagggcaacactaaccaggcggcggccgtgcgcatcgcctgcctcatccgacagagcgtgcagagtagcacgctcatccgcgtgctcttctaccacacgcccgaccagaaccacatcgaacagcccttctacctcatgggccgcgacaaggcgctggccgtagaacagttcatctcgcgtttcaactcgggctacatcaaagcctcgcaagagctcgtctcctacaccatcaagctgagccacgaccccatcgagtatcttctggagcagattcagaacctgcaccgcgtcacgctggccgaaggcacgacggcacgctactcggccaagcgccagaatcgtatctcggacgatcttatcatcgccgtcatcatggccacctacctgtgtgacgatatacacgccatccgtttcagggtcagctaggcacgcagcagagccaccaggtgccggcgactgacgccggcatcggcagaaacgagacgatcgtaacccaggcgcgtaaaactccccaagggcgaaaacgtttcggcgtagtcggctaacaaagcccgggccgccgccagcgtccgcgcctgcacgccgccgtgactgcgatagtaacggcgcagcaccacgttgacaaggtcgttctcctcgacgcgcggcggcggaggatccaaggcctccagcgcctcctggtgcaaatgcagcgaattgagcagcaaacatagacaggcggccagcttcatcgtcttgcgatgtagcagaaaaccgccgcttgcgcccgagacggcggcatcctcgggctttccggccaacatgcccagcatctcctcgcccatctcgtcctcgtccagctcgtaaagacagacttgacaaagaaaatagttctccagacgcggcacgtcgagcaagagcagcttcttagcacccgccagccccacgcagtgctccagcagacgggcggatgaacgcggaatattactcattcgcaaacggtgataagcgctggccaccacaccgtcaaacatgtccgaatcaccgcgcgtagcactctgcaacaacggcgctagacgctcctccatctcgggcggacaaagaaccagctcctcgtgcgagcgccgttccagcaaaaaaaaatattggcggaacgtgttcaccagggcgcgcgccgccgagattcgtcgctgcaccgtagtgatcacaacgtccggcgcccaaagcacgctggtacccggccaaataacgtgtctggggccggtgctgccgccgtcgttgacgcgaatcatataaatacccggcacgtcgtacagctcgtccctgctgtcgtcgtctccccggcgctcctcaccactcgcatcaccgtcgcgccaccgtagcctactactccccaactgaccgcattccaccaccaacttggcgcaatgggtaatgcccgtaagcgcgtacaccagatcgctatgcttctgccaatagatggaaaagacggacgacctgcggttaaaacgaccgctgcaataaaaacacagctcggaagcaaaaaccacgtcgtcttcggcgtcgggcggcggcggtaacacacggcgaatcagttgcgacagcggtccgttgcgaaacgcgtgctcgcgcaccgtaccgtcgtccattaacaacgccgcgtcgtgccaacccggcgtcggacgctcctccggacgaaacgccgcggcggcagcggccgcggcttccatcatcgtgatgcaaaccgcgctcgcggcgacgtgggttcagaactgccgtcaacgctgacggaggttgggacagaagtgacggaggaagatgaggacacacacaatgggggaggggatgaacacaggcccgatgtggctgcggccgtcgagcacaatcgaaacaacgtctggtggatcacttcgcgcgtgtgcggcgtaccgctgatactctgcaacgcgcccagcgcctcgactaacactttgaggcgcgtgcgagggatcttgtgggcttccacgtgccgacacaccgtcagcacgttggcgttccggcccaggtgatccaatttgacttttttgttccgggccaggatcttgggcacgttgttggctagacgactgccgatgagcgcacaagtgtgcttgatcttggtgtgcgccgtgaggttcttgctgtagtcaaagagaccccgctgtgccgcctcaaatactaggcggtccaactgcagccgcttctctcgaccgtgcagcttgagcaggcaagcacgcagaaacagcactaactgcttggccaggaaggggatctggtacgaattgcgcagctctagttgcgtgaaaacgcggtgcagaccgtaatcgatgcacacgtcgcgcatgttcttgatgcacgagagttctttgagcagaatggcttccaggtcagcgcccgagacgcgcggcacaatggccgtagccgctttgaaccagcccacgttgacgttgttagtatgcgagatcatgcacggaaagttggtggtccagtacaccttgctgcgctccgagcggatcaccgcctggtcttccagcccatgcacgtccagcgaggagttgctgttgcacaccacggccggcagaaagaagtgatcgatattaacgtgcagccggtacacgcccagcgagtacagaaactcgggataggaaccgcgaatattgacgttgagcgagttgatgtagacggcgtcgttggaaacaaaagtgctgacggtgcaagcgggctccttgaaggtgtgcttgtacatcacaaaactgtgggtcatgttcttgggaagccgcggcgcgcgcacgccgagacccgacgcggcgatggacgagagtgcggccttcatattgataacgcggttggtgttgaaagcgttgacggcgatgcggtccagactaacgcccgtcacctcggcaaactccatcccgccgatgagcttacgacggcacggcgcgtaacgctgcacggctagatgtttacgacgtcggtgttcctgataggcccggcgcagctgctgccccgtaaagtcaaatggcggcgtggcgtcagtctcccccgattccaccgtctcttcctcctcttctcccgtctccgaccgccgtcgacggtgtttacgccatctctccccataccgggcgaacatgagacgcgagataatgcacacgtaacgtcgaacgcgatctgcggccgggtcgcgcggcagcgacagcttgtgacccgcgctcgtcgtcgggagcgcggtggaagacagcgcgtgtccgttggctgaaaccaccgtcggttctgacggtggtagccgcgacgtcctcggagcgcaagaaacaccgtaaccgcggcttacggatcggtcctctgtcccatgggaccccagatcccgagctagttcataataaacgtagaaaaggtttctccacaccgtgtccgtgtcggcaaacgtgacgctaagacgtcgataacacagtaggttgtggtgtccctgacttccaccgtttccccctcccccacttctgtcagcgtggccagtccggcacttgccgtagctcacctgtaacttgaagtacagtacctgtcgcttgaagcgactgagaacgaaggtgctcaggtggcacaccgtctgctcgggcaagcgaagtgccatcatgacgcgggcgcggtcgcgatgcagctgagccagtacgcgaccgaaaaactccgacgtgacttcgtggtgatattcaacgcccagccaaagcttttgcagctccagcagaaaaaagtcgcgtgtagcgtccaacgcgcacggcgcttgcggacgcacgttgagtccaaagagcagcttgtagtgaacctgaatgcgcggcgccgcggcctcgcccaggtagccggagacggcggttacgtagtcgtctacctcactgacgctgagtacgcgtccgatttccaccatcaggtaaggatagtcgtccaggtgcaggctgaggtcgcgcggcaggcaggccatggcgtagcgttcgtcggttcccaaggcgccaccgccgccaggacagtcgcaaaaaaggcccggcaactctcgattccattccgtcagcgagagcaatccgcgtaacacatgcgttgccacgtggttttcgagaacgtggcaggacagcgcgcgcccggcggtcacggatccgcaacaacaacgtcggtgcacgtagagcagcggcccgcgacaaaactgcgtcgtgggtaccagatgctcgccgtggccctccacttcaccgtcgcaaaaacagggtacggccacgggtcccagcaacagacgacccagtaccagcttgacacgctcggactcggtcctcgcgtgtacgggacaggcacggtagagagccgcgaaaacagcgcgtacccgttcgacgttaacgggtcgcggacgacagaagcgggcgtcctcgcccgtcgatagctcttgggtgaggttgcaggcgcgaacgtgcacggggacgtgtaaaacccggcgcggcgtagcggagccgccgacgactattagagcgtcgcagccgaggcggcgcggcgcagcgccggccattctccgggtcgcgctgctttccccgagctccgacgcctcgcgctcacgccgccgccgcgatggagaactggtcggcgctcgagctcctgcctaaagtaggcattcccactgactttctgacgcacgtcaagaccagcgccggcgaggagatgttcgaggccttacgtatctactacggcgacgaccccgagcgttacaatattcacttcgaagccatcttcggcaccttctgcaatcgcctggaatgggtttattttttgaccagcggcttggccgcggcggcgcacgccatcaagttccacgacctcaataaactgactacgggcaaaatgctgttccacgtgcaggtgccgcgtgtggccagcggcgccggtttgcccaccagtcgtcagaccaccattatggtcaccaaatacagtgaaaaatcccccatcaccatccccttcgagctcagcgcagcctgcctcacgtatctgcgcgagacattcgagggcaccatcttggacaagatcctcaacgtggaagccatgcacacggtgctgcgcgcgcttaaaaacacggccgacgccatggagcgcggcttgattcacagctttttacagacactgctacgcaaggcgccgccgtactttgtggtgcagacgctggtagaaaacgccacactggcgcgacaggcactgaaccgcatccagcgaagcaacatcttgcagagcttcaaggccaaaatgctggccacgctctttttgctgaatcgcacgcgcgatcgcgactatgtgctcaagttcctcacgcgtctggccgaagcggccaccgatagcatcctagacaaccccaccacgtacaccacgagctcgggggccaaggtcagcggcgtgatggtaagcacggccaacgttatgcaaatcattatgtcgctgctctcaagccacatcaccaaagagacggtctcggcgccggccacctacggcaactttgtgctcagtcccgaaaacgccgtcaccgccatttcctatcactcgatcctggccgatttcaactcatacaaggcccatctgacttcgggtcaaccgcatctgcccaacgactcgctttcgcaggccggggcgcacagcctaacgccgctaagcatggacgtgattcgactgggcgaaaaaacggtgattatggaaaacttgcggcgcgtctacaaaaacaccgataccaaagatccgctagaacgtaacgtggacctgacgtttttcttccccgtagggctgtatctgcccgaggatcgcggttacaccacggtggaaagcaaagttaagctcaacgacaccgtccgcaacgcgctgcccaccacggcctacctgctaaaccgggaccgtgccgtgcaaaagatagactttgtggacgcgcttaagacgctgtgccacccagtgctgcacgagcccgcgccctgtctgcaggccttcacggaacgcggaccgccctcggaacccgccatgcaacgactgctcgagtgtcgttttcagcaagagcccatgggcggtgcggcgcgccgcataccgcatttttaccgcgtacgacgcgaggtcccgcgcacggtgaacgaaataaagcaggactttgtagtcaccgacttctacaaggtgggcaacatcacgctctacaccgagctgcaccccttcttcgactttacgcactgccaggaaaacagcgaaacggtggcgctgtgtacaccgcgtatcgtcatcggtaatttgccagatggactggcaccgggccccttccacgaactgcgcacctgggagatcatggaacacatgcgactgcggccaccacccgactacgaagagacgttgcgacttttcaaaaccaccgtgaccagccctaattaccccgagctctgctacctggtcgacgtgctggtacacggcaacgccgacgcttttttgctaatccgcgctttcatagcacgttgtatcgtcaacatgtttcacacacgtcagctgctggtttttgcacacagctacgcgctggtgacgttgatcgccgaacacctggctgatggcgccctaccaccgcagttgctctttcactaccgcaatctggtcgccgtactgcgtctggtaacgcgcatctcagcgctgccgggactcaacaacggccaactggccgaggaaccgctgtcggcttacgtgaacgcgctgcacgaccaccggctgtggccgcccttcgttacgcacctgccgcgcaacatggaaggcgtacaggtagtggccgaccggcaaccgttgaacccggccaacatcgaggcgcgacaccacggcgtttcggacgtaccgcgtttgggcgccatggatgccgacgagccgctgtttgtggacgattaccgtgccaccgacgacgaatggacgttacaaaaggtcttttatctctgcctcatacccgccatgaccaacaaccgggcctgcggcctgggactcaacctcaagacgctgctagtagacctcttttaccgaccggcgtttctcctgatgccggccgccaccgcggtctccacgtcaggtacgacgtcgaaagagagcacaagcggcgtcacccccgaagactcggtagcggcgcaacgtcaagccgtaggcgagatgctgaccgagctggtggaggacgtcgccaccgacgcgcatacgccgctgctgcaggcgtgtcgtgagctgtttttggccgtgcaattcgtgggcgagcacgtcaaggtgctcgaagtgcgcgcgcctctggatcacgcgcaacgtcagggcctgccggactttatctcacgtcagcacgtgctttacaacggctgctgcgtcgtgacggcgcctaagacgctgatcgagtacagcctacccgtacctttccaccgtttctactcaaaccccaccatctgcgcggcgttgagcgacgacattaaacgctacgtgaccgagttcccgcactatcaccgtcacgacggtggttttccgctacccacagccttcgcacacgagtaccacaactggctgcgctcgcccttttcgcgctactcggccacctgtcccaacgtgttgcactcagttatgacgctggccgccatgttatacaaaatctcaccagtttcactggtgctgcagaccaaggcgcacatccacccgggattcgcactcacggccgtacgcaccgacaccttcgaggtggacatgctgctctacagcggcaaatcatgcacgtcagttatcatcaacaatcccatcgtgaccaaggaggaacgcgacatcagcaccacgtaccacgtcacgcagaacattaacaccgtagacatgggtctgggttacacgtcaaatacctgcgtagcctacgtaaaccgcgtgcggaccgacatgggcgtccgcgtgcaagacctctttcgcgtcttccctatgaacgtgtaccggcacgacgaggtggaccgctggatccggcacgcggccggcgtggaacggccgcaactgttagatacggagaccatctccatgctgacgttcggcagcatgtccgagcgcaacgccgccgccacggtgcacggacaaaaggccgtgtgcgaactcatcctcacgccggtaacgatggacgttaattacttcaaaatcaccaacaacccgcgcggacgcgcctcctgcatgctgggcgtcgatccgtacgacacggaagccgccaccaaggccatctacgatcatcgcgaagctgacgcacagactttcgcggccacacacaacccctgggcctcgcaagccggctgtctaagcgacgtactgtacaacacccgacatcgcgaacgtttgggctacaactccaaattctacagcccctgtgcgcagtactttaacacagaagagattatcgcggccaacaaaacgctcttcaaaaccatcgacgagtacctactacgcgccaaggactgcatccgcggcgacacggacacgcagtacgtctgcgtcgaaggcacggaacaactcatcgaaaacccgtgccgcctgacgcaggaagcgttgccgattctcagcaccaccacgctggcgctgatggagaccaaactcaagggtggcgccggggctttcgccacgtccgagacgcactttggtaactacgtcgtaggcgaaatcatcccgctgcagcaatccatgttatttaactcgtgaggccgtccggtgaggaggacggcgacgaccgcaggttagcggcgagtcacctagacgcaaacgcgggcccggacgcgccacgctcgctctgacgccgcgcccggtgcagacgttgttcgtctccgcttctcctccgtcgcggccacgatttcaccgccgctatggcggccatggaggccaacatcttctgtactttcgaccacaagctcagcatcgccgacgtaggcaaactgaccaagctagtagcggcagtcgtgcccattccgcagcgtctacatctcatcaagcactaccagctgggcctacaccagttcgtagatcacacccgcggctacgtgcgactgcgcggcctgctgcgcaatatgacgctgacgttgatgcggcgcgtagaaggcaaccagatcctcctacacgtaccgacgcacggactgctctacaccgtcctcaacacgggacccgtgacttgggagaagggcgacgcgctatgcgtgctgccgccgctcttccacggaccgctggcgcgcgagaacctgctgacgctgggccagtgggagctggtgctgccctggatcgtgcccatgccactggcgctggaaatcaaccagcgactactcatcatgggcctcttctcgctcgaccgttcgtacgaggaggtaaaggctgccgtgcagcagctgcagaccattacttttcgcgacgccaccttcaccatccccgatccggtcatcgaccagcacctgctgatcgacatgaagaccgcctgcctctccatgtccatggtggccaatctagcctcggagctgaccatgacctacgtgcgcaagttggcgctagaggacagctccatgctgctcgtcaagtgccaggagctgctgatgcggctggaccgcgagcgcagcgtcggcgagccgcgcacgcccgcgcggccgcagcacgtgtcgcccgacgacgagatcgcgcggctgtcggcgcttttcgtcatgctgcgacagctggatgacctcatccgcgaacaggtcgtcttcacggtgtgtgacgtttcacccgataacaaatccgcgacctgcatatttaaaggctgagccggccctctcgcgcccgcagacaccaagcatgccacgcgtcgaccccaaccttcggaatcgggcccgccggccacgagccagacgaggcggcggcggtggcgttggcagcaatagcagccgacacagcggcaaatgccgccgccaacgccgagctctgtcggcgccgccgctcactttcctcgccaccactaccaccacgaccatgatgggcgtcgccagtaccgacgacgacagtctcctcctgaaaacgccggacgagctggacaagcacagcggctcgccgcagaccatcctcacactgacggataaacacgacatccgtcagcctcgggtgcaccgcggcacctaccatctgatccagttgcacctcgacctccgacccgaagaattgcgggatcccttccagattctgctctctacgccgctgcaattgggggaagcgaacggcgagtctcaaaccgcccccgcgacgtcgcaagaagaagaaacggcggcttcccacgagcccgagaaaaaaaaggaaaaagaagagaagaaagaagaggacgaggatgaccgcaacgacgatcgtgaacgcggcattctatgcgtggtctctaacgaggattctgacgtgcgcccggccttctctctctttcccgcacgcccaggctgccatatcctgcgctcggtaatcgaccaacaactgacgcgcatggccatcgtgcgcttatcactcaatctcttcgcgctccgtatcatcacgccgctgctgaaacggctaccgctacgacgtaaagccgcgcatcacacggcgttacacgactgtctggcgctgcatctgccagaactcacgttcgagccgacgctggatataaacaacgtaacggagaacgcggcttccgccgccgatgccgcggaatcaacggacgcggatctgacgcccacgctgacggtgcgcgtacgacacgcgctgtgctggcatcgagtggaaggcggcatctcggggccgcgtggactcaccagccgtatctcggcgcgcctctcggaaaccactgccaagacattgggaccctccgtctttggacgattggagctagacccgaacgaatcaccgccggacctgacgctgtcgtcactcacgctataccaagacggcatgttacgtttcaacgtgacctgcgaccgcaccgaggcgccagccgacccagtggcgtttcgcctgcggctgcgacgcgaaacggtgcgacgacccttcttttcggacgcgccactgccttactttgtaccgccacgctccggcgcggcggacgagggactggaggtgcgcgtcccttacgaattgacgctgaagaactcgcacacgttacgtatctaccgccgcttttacgggccttatctaggtgtttttgtaccacacaaccgtcagggactcaaaatgcccgttacggtctggctaccgcgctcctggttggaattaaccgtactggtgagcgacgagaatggcgccacgttcccacgggacgcgctcctggggcgcctctattttatctcgtcaaagcatacgctgaatcgcggttgcctgtcagcaatgacgcaccaagtcaaatccacgctacactcgcggtccacgtcccattcgccgtcgcaacagcagctctcggtgctgggcgcttccatcgcgttggaggacctgctgcccatgcggctggcgtccccggagacggaaccgcaaaactgtaagcttacggaaaatacgacagataaaacgagtcctgtcactttagccatggtctgcggcgatctctaaacagaggaccctggtgatgggaaacggacactaggcgtccgcgcgatacggggttaaaacaaaaaaatcggtggtggtgtgtgatggggtgtggtgacggtggggctttgcctctttttttaataaaaaaagacactcaataatccgcggttgtctctgtgtagaacgtttttatttcgggttccgcgtctggtcgcctgcctatgtaaggcggcggccggagagggcgcgccgctcagtcgcctacacccgtacgcgcaggcagcatggagtcgcgcggtcgccgttgtcccgaaatgatatccgtactgggtcccatttcggggcacgtgctgaaagccgtgtttagtcgcggcgacacgccggtgctgccgcacgagacgcgactcctgcagacgggtatccacgtgcgcgtgagccagccctcgctgatcctggtgtcgcagtacacgcccgactcgacgccatgccaccgcggcgacaatcagctgcaggtgcagcacacgtactttacgggcagcgaggtggagaacgtatcggtcaacgtgcacaaccccacgggccggagcatctgtcccagccaggagcccatgtcgatctatgtgtacgcgctgccgctcaagatgctgaacatccccagcatcaacgtgcaccactacccgtcggcggccgagcgcaaacaccgacacctgcccgtagctgacgctgtgattcacgcgtcgggcaagcagatgtggcaggcgcgtctcacggtctctggactggcctggacgcgtcagcagaaccagtggaaagagcccgacgtctactacacgtcggcgtttgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggatctgacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccggggctgagcatctcaggtaacctattgatgaacgggcagcagatcttcctggaggtgcaagcgatacgcgagaccgtggaactgcgtcagtacgatcccgtggccgcgctcttctttttcgatatcgacctgctgctgcagcgcgggcctcagtacagcgagcaccccaccttcaccaaccagtatcgcatccagggcaagcttgagtaccgacacacctgggaccggcacgacgagggtgccgcccagggcgacgacgacgtctggaccagcggatcggactccgacgaggaactcgtaaccaccgagcgcaagacgccccgcgtcaccggcggcggcgccatggcgggcgcctctacttccgcgggccgcaaacgcaaatcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgcggaattggaaggcgtatggcagcccgctgcgcaacccaaacgtcgccgccaccggcaagaagccctgcccgggccatgcatcgcctcgacgcccaaaaagcatcgaggttgagccacccgccgcgcacgcgcttaagacgactctataaaaacccacgtccactcagacacgcgacttttgagcgccacacctgtcgccgctgctatatttgcgacagttgccggaacccttcccgacctcccacgaagaacccgtttacctttgtgcatcccctgaccctccccccatcccgccttcgcgatgtctcaggcatcgtcctcgcccggtgagggaccctcgtcggaagcggccgcgatcagcgaggctgaagccgccagcggaagctttggtcgcctgcactgccaggtgcttcggctcatcaccaacgtggaaggcggctcgctggaagccggtcgtctgcgactcctggacctgcgtaccaacatagaggtgagccggccctcggttctctgctgttttcaggagaacaaatctccgcacgacaccgtagacctgaccgacctaaacatcaagggccgctgcgtggtgggcgaacaggaccgactgctggtggacctcaacaactttggcccacgacgcctgacgccaggctcagaaaacaacacggtctcggtgctggcctttgcgctgccgctggatcgcgtgcccgtcagcggactgcacctctttcagagtcagcgacgcggcggcgaagaaaatcggccgcgagtggaggcccgagccatcatccgccgcacggctcactactgggccgtgcgactgaccgtaacgccgaactggcgccgcagaaccgacagcagcttggaggccggccagatctttgtcagccagttcgcctttcgcgccggcgctatcccgctgacgctggtagacgccctggagcagctggcctgttcggaccctaacacgtacatccacaaaacggagacggacgagcgaggccaatggatcatgctgtttctgcatcacgactcaccgcacccgccgaccagcgtgtttctgcacttttcggtttacacgcatcgcgccgaggtggtggcgcgacacaatccgtacccgcacctacgacgcttgccggacaacggcttccagctgttgattcccaaaagttttacgctgacgcgcatacatcccgaatacatcgtgcagatccagaatgcttttgagaccaatcagactcacgacaccatttttttcccggaaaacatcccgggcgtctccatagaagccggtccgctacccgatcgtgtgcgaatcaccctccgcgtcacgctgaccggcgatcaggccgttcatttggaacaccgacagccgctaggccgcatccattttttccgccgtgggttttggactctcacacccggtaaaccggacaagatcaagcgtccccaggtgcagctgcgcgccggtctctttccacggagcaacgtcatgcgcggcgccgtctccgagtttctcccgcagtcccccggattaccacccaccgaggaagaggaggaagaagaagaggaagaggacgacgacgatgacctctcctccacaccgacgccaacccccctgtccgaagccatgtttgccggcttcgaggaggccagcggtgacgaggactcggacacccaagccggactgtcccgggcactgattctgaccggacaaagacgccgaagcggtaacaacggggctctcacactcgtcatcccctcgtggcacgtctttgcgagcttggacgacctggtaccattaacggtgagcgtgcagcatggcgcactacgacctacctcttatctgcgcagcgacatggacggcgacgtgcgtaccgcggcagacatcagcagcacgttgcggtccgtgcccgcgccacgaccctcgcccatcagcaccgcttccacttccagcaccccacgcagtcgaccccgcatctagagagagacttctttgttgttcccccgcgtgtttttcccattccctgtatttatttctaaataataaaaatacagagacgttgataataaccgcggtgtgctttattagggtatcatggtgtagaaaaaaaagagagggaagccctaaatatagcgtctctcttattcgagcttattgagcgcagccacaaaaatccgccgattcagatccaccatgtctttgggcgggctctgggaagctgcggcggcttgggcagcagcggcggctaacacgacactagccggacaggaagaagaacccgccgtcgaaggccctgccgttgccgcctcagaacccgacgcggtagcgaggcggcaactggcgttcaccacgccggcctgagcgcgctcagctaccttggcacctcctgatagaagtgccgtcggtgtttctcctccgccgctcgtcagctcgccggtgggagtacacacggtagtagtagtcggggaggaagaggccgcagcggggagagccgccgaaagtaacgtagaactctgccgcgcggcaaacagatcgcgtttcagctcgtgaatggcatcccgcagttcatcgtaacgttgttgctgctgctgattggaacccgcgtgcccgccacttccaccgtcgctattgacgtgactttttagacgctttcgcgcccggccgtgctcggcctcgccggggaaactcaagtcttcgtccgaggacgacgacgacgacgccgccgcggcttccttacggcgtttgttgtgtccaccgctgcccccgtgacggtgctgcttctgcgactgaccacggtgaccaccgtcgtaacgctcccatccggacggtggttcatccataccgcccggagagtcgcgccgacggtaataggccggtgatggtggcggtggcacgggataagacggatgcaaagacggcgcgggctcgtaacgccgaccccacccgggataatggggatccacgtaatccgcaaagtgacgtaccgccaactggtcgtaacccacgacgggggcgccgtaggacgcgggataagatggcaaaggcagcggtgctggcgaagcagaaggaggggccgctacggcgccgggatacattacgggcgctgccgagcgactggccccaagtaacgagaaaaaagcgtccttgggtaaataaactccgtcgtgaggccacgctagagacggcacagccggcgacgcacctgccacggtagcacctggaggagccgtagcggcggtaaccgcagcactcagagggtgcgacatggacgccgcctctgccggctccgagggagaaagcgacggcggtgattccgcgggaagaacggacggcgacgctggaagcgcaggcggctggacaggagatggcggttcgactggaggcgacggggacgaagagggaacgcgcgccccagtcgccggcgtggcggcctgactgcggctgtcgcccgaacgctcggcggacgccgctttaatatcgcacgccgcctcaggcgaaacgctcgccttgacgtacgactcgcgctccgtcacgccgactagttgcttgtcgtagcgcagcttgggcagtcgctcacggatgtagagcgcgtccacgctgttgcccaacaggccgtagctgtctgagcgaaagggatcgcccgacgcgtcgacagcagtgctgccgcagcgctgccactgtgcacgtagcccgtcgcggtcggccgccgtgaggtctggaaaccgctgggtgacccactcgggatcgcgcccgtacacggccaacgtaccgcgacgccgacccacgctgcacaaagccacgtgtttgaacggcgtggtttccgagcccgaaagcgacgtcgcggcctccacgtcgtcgcagcgccggctggagagcgagaggccggcgtagctgccgctgagaaactccaccaccttgtctggctgcagcggactgacgggcccgcgcgaaaccagctcggacttttccgaagcgcggcgtacaatctccagaaacctgggcgaagtgacgcagcccaggcaaaaaagaccgtcgcggacgctctgcatcgccgcaacgtgtcctacaacggccgtatcgtcgtggttgatgttgagcgggagcgcgaccgacaacgaaggctgtccctggctctgcgcatacaaccagtgctccactacgtcccgcggcaacagcaattcggcctcgtccggagactggtcgtagcgggcgagaaagccgcccacgtagaccggcgccacagcctgcggctgttgctcgtccatcgtcattgtcgtcaccgtcactacccgctcaccgagcgaacgatgatggcccgcgacgaagagaaccccgccgtcccgcgggtccgcacgggcaaattctcctttacttgcgccaatcatctaatattacagattagcgagaagatgtcgcgcggacagccgctgagctcgctgcgtttggaagaactcaaaatcgtacgcctcatctgcgtcctcctctttcaccgcggtctcgaaacgctgctactgcgcgaaaccatgaacaacctgggtgtctcggaccacgccgtgcttagccgcaagacgccgcaaccctactggcctcatctgtaccgcgaactgcgccaggccttcccggggctggactttgaggcggccgtgttcgatgaaacgcgcgccgcccgtctcagccagcgcctgtgtcacccgcgcttgagcggcggactgctgacgcgctttgtgcagcgccacaccggcctgccggtcgttttccccgaagacctggcgcgcaacggcaacatcctcttctccctaggcacgctctacggacaccgcttgtttcgtctggcggccttcttcacgcgccactggggtgccgaagcgtacgaacccttgattcgcatcatctgtcaaaaaatgtggtacttttatctcgtcggcaccggcaagatgcgcattacccccgatgccttcgagatacagcggagtcgacacgagacgggcatttttacctttattatggaagattacagaacgttcgccggcacgttgtcccggcacccgcaccgtccgcacccacaacagcagcagcaccaccaccccggtcccccccatcctcctctttctcaccctgcctcgtcctgtctcagcccagaggccgtactggccgcccgcgcccttcatatgccgacgctggctaacgacgtgtgaacctgacgtgatttatctgccacttttctccccgctgccgtacagcgccgccgctcataatgccgtcaccgtcgcatccgacgcgacggtgttttcgccgtcggtgcagaggacggaggaactttcggccgaaacatcgatcgtagtcccaggacacatttcggaagccatgccttccgcgtgctccaccaacgtggctttctccgacgtggtcgtcgttaccacaacagccgccgacgtcgcgtcggcgtaacaacggctggaggactttttcaccgcctcggcgacgtctcggacggacgtagaaaagtaacacacggccagctccacgctatacatagcccgcttcaacgcctgcaccaaccgacgtacgaaatgaccgtggcagctctgatgacatttctcgaccagataatcaaaggagtcatccagatccttggtgggctcgcgggagaagaacgcaatgataaagagcggcagaatgccaagacgcatggtgagaagggtacgcgtagccaattccacgtaatccataatgccgaaaccggtgccggccgcgctagcgggctgcaatacaccgcgtaggactctgaagcagtagtaaggcacaaaaagcatgagacacgtcacgtagaaggtgcagacacgacccacgtaggaccagacgtggtcgcgccgatcgctgtaggccaactctaccacgttagccagtacggcgatcatgggcgcccccagcaaaaaccacattttgatggtgaggtccaccgcggcatactgtatagggatctgacagcctagccaacggtagtccagtgaacccgtagcggcggtgggcacagcggctacgatggaaagaacccaggcaaaggcgaccgcgtagagcgccacgccggcgttttcgcgcgtctcatgatgccagagatcacggccataagagatggccgacagacgatccagtatcagaaagaggaaaaacaacgccgtcgaatataggcccacgtcgtcgacaaagagcactaagcgacagaggctgagatttagagcgccacgcagcatgatacccttggacaacatggtagccacgatggaaaaaaactgactaagtaccaggttccaagtaaaaatcatcacggacacgggcggccgcgtaacacgcaacacccagaggcaaccgatgatggtcagcaggttgactaggctaacggagccgaacatgccgatgagcaggtccgaagcggcgcgatcggccgacatagagtagccttcgaacgggcccatgtatttgaaattcacgatagcgagcatgatggaatcggtgactgaggtagtcttctccgcagaaggggacatacccaccaccgccgcccgctctctccgaacgaatataccctctccggggacgctcgccctttatgcagcaagcgacacgtggtggaaattacaacaccgccacgctcggaagaaaacccaacactaaaaagtacaacagttcgtaaatatcgttgacgttaaagagggacgagcccagagtggacacacgatgacgcggcagggtcactgacaacagccgccctagcccgtgttcgtagtgaaagagcagggcgtcgtgtacttccaagcgacgtaaatcgccgtactgtttggagctctgcgcgaacatgtagtcggccacgggattgctcttgctgagctgcatgagcacagcgccgccgccgtcgccacctccggcgctgtcctcgcgacgtgagggatcccagccgctgcgcacgctctcggtcacggccaacagagccaggccgggaaagagctgcgacagcgtgaccgcggggtcgcgcgcgtaccacggcccgatgtagtactgcaccagaaactcaaagttacgtacccgcccgtgccgtcccccatagccctcctcttcgccgcccgcgcgccccccgggcaatccaccgccggccacagcgtccgaacccagcaggtcggccaacgtgaatttgcccgtacgcggagcgaagacgctatccgcgttggtcaccttccacaacagcaacaggctagccaggcaggtcaagcccgaacgcagatattgctgttcgtgcacaaagacgggcacgtcacgacccagcttgccgaccagcagacgtcggctccagagagaaagcacatcgtctcgcacctggcccgacagacgctcctgcaccagctcctctgttatcgtcccgtagcccggcaaatgctggaggacgccgcgtttgtggaaaagccgcaccagcacgtgacgatcaaaagtgcccgggtgatagtggcgaccaccacttaggggcatgtagtaacgtagatcgggcgagtcgcgatacgcgtaatagttgttacccgcggcgacagggccttcccaagcggcaatctcacgacttacgtcatcggccagacgcggcaacagctgagggagctcacccaacaccgtcgccacggagtccggcggatcgcggccctcccaaagcgcgtgtccgtaggcggccagcagacaagcggcggcttccaaatcggatagtacgcagtcgtacgtcggatacaccgtcacgttttccaaagcgttgaccacgccgagcagcagctcctgcgaaatggaaaagttgtccatctgcgccagatggtacactcgtttccaccgtggttgcgtgtacaacccccgcttgagccgatagtaccagataccaaaggagaaagtccaagtagaggcgttctcgaacatggtgttgaccacctcgccgcgaaaatcggtgtgaaagcggataaagggatcgttctgcgtgattccaaagtagctaggtacgttcccgggcaacggccgctcggcgcactgcgccagccaggtagaagaagcaccggcggccgctgacgcggcgaccgcgtcagacggggcaaccgcgtcagacggggcaaccgcgtcagacggggcggcggcgggtcccgtgatggcatcgtgccgactataaagaccgtgtgggacggcggaagctcctgccacgccggtccctggggacgacgaacgcggacgacacggtggttgtagcagcgtccgcggcgacggtccttcgtcgagctcgcactgctggttcaacagcgcctccgcctcggacacgcgcccttcgagatcctcgcagtaagtctgcaccctgtgacccagatccctgagctcctgacgcagataccgtttgcgcacccggtccatgagcacatcctcgcgccagcccccgccgcgcgttgccaccgccgcgtcctccagcaaccgccgaagcacgcgctcggggcagcgcagcacgttttcctcgtgcggctcgaagaagacggcgacgggtagccgccaaaaggtgtgcaacagactcatcctgacgccgtcccagatagtccaggacagaatcggtacacaagtcgaaacggcccgaacgaaaagcccgataaaaggatgggcgatcggccttttgctgaaaaaaaaccagactgggcactacgctccagacctgaccgccaccgcgcggcagacgcagaaaatcaaagtccaccagggcgcccttgagctggcgcaggccctcggcgtactgcaggctgtgggtggcgtgccaccgcacggactgatcgtcggcgtctgagtacgtggttttgaattcaatcacgtagcaatacacgatgccgcgcgacccagagtccggcggtaaaaataccaacacgcagtcgggaatccgccgacttaatcgtacttcgatgaaaagacggcgacggtacttttgcagctcgggtgggaaaaggcctcccaacaggcggttgagggccacaaacgagggaaagacccgcaacaggcgacggtagatgtccaggtgcttacgcttaccgatccgcttacgcacgtgaggcaatctccgcagagcgttccccgtcgaatcagcgtcgtccccacgcccggacggcatggcttacccgcgtgtcccctcttcttccttcgcagcggccaatgacatcgtattaaatagacagagacgcgacttttgtaacccgtagcgccacacccgggtgccccttcctgggatcctttctctccttctctcgggtgtaacgccaaccaccacctggatcacgccgctgaacccagcggcgcagccgcgctatgcggcccggcctccccccctacctcactgtcttcgccgtctacctcctcagtcacctaccttcgcaacgatatggcgcggacgccgcatccgaagcgctggaccctcacgcatttcacctactactcaacacctacgggagacccatccgcttcctgcgtgaaaacaccacccagtgcacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctagaaagataccaacagagacttaacacctacgcattggtatccaaagacctggccagctaccgatctttttcgcagcagctgaaggcacaagacagcctgggtcagcagcccaccaccgtgccaccgcccattgatctgtcaatacctcacgtttggatgccaccccaaaccactccacacgactggaagggatcgcacaccacctcgggactacatcggccacactttaaccagacctgtatcctctttgatggacacgatctgctttttagcaccgttacgccctgtctgcaccagggcttttacctcatggacgaactacgttacgttaaaatcacactgaccgaggacttcttcgtagttacggtatctatagacgacgacacacccatgctgcttatcttcggtcatcttccacgcgtactcttcaaagcgccctatcaacgcgacaactttatactacgacaaactgaaaaacacgagctcctggtactagttaagaaagctcaactaaaccgtcactcctatctcaaagactcggactttctcgacgccgcactcgacttcaactacctggacctcagcgcactgttacgtaacagctttcaccgttacgctgtagacgtactcaaaagcggtcgatgtcaaatgttggaccgccgcacggtagaaatggccttcgcctacgcattagcactgttcgcggcagcccgacaagaagagaccggcaccgaaatctccatcccacgagccctagaccgccaggccgcactcttacaaatacaagaatttatgatcacctgcctctcacaaacaccaccacgcaccacattgctgctatatcccacagccgtggacctggccaaacgagccctctggacgccggaccagatcaccgacatcaccagcctcgtacgcctggtctacatactttctaaacagaatcagcaacatctcattccccagtgggcactacgacagatcgccgactttgccctacaattacacaaaacgcacctggcctcttttctttcagccttcgcgcgccaagaactctacctcatgggcagcctcgtccactccatgttggtacatacgacggagagacgcgaaatcttcatcgtagaaacgggcctctgttcattggccgagctatcacactttacgcagttgctagctcatccgcaccacgaatacctcagcgacctgtacacaccctgttccagtagcgggcgacgcgatcactcgctcgaacgcctcacgcgtctcttccccgatgccaccgttcctgctaccgttcccgccgccctctccatcctatctaccatgcaaccaagcacgctggaaaccttccccgacctgttttgtctgccgctcggcgaatccttctccgcgctaaccgtctccgaacacgttagttatgtcgtaacaaaccagtacctgatcaaaggtatctcctaccctgtctccaccaccgtcgtaggccagagcctcatcatcacccaaacggacagtcaaactaaatgcgaactaacgcgcaacatgcacaccacacacagcatcacagcggcgctcaacatttcactagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtcctagaagtaactgacgtcgtcgtggacgccaccgacagtcgtctcctcatgatgtccgtctacgcgctatcggccatcatcggcatctatctgctctaccgcatgctcaaaacatgctgactgtagaacctgacagtttatgagaaaagggacagaaaagttaaagacattcacacaaaatcttctaaaacggtacgggccccaatacttaggggcactcttgctcgttgtaataaagtacacgccacacggtgtgatggtactatatgcgtgaggtctgtgcgtctttatttacgaggtactgttatgggtctggttacatatcgggccctggatacaagctcggtacacagccaaggtgcgggagactaggtcgtcttggaagccgatgcaacaacggtagatgagcagcaaaacgaccagaatcagcagtgagtacacgcaggcaagccaaaccacaaggcagacggacggtgcggagtctcctcctctgtcatggggagaaaaggagacatgagaagcatttctaaattattctttattatatcactgactgtcctgttattttctataataaactgtaaggtcgtcagaccaccgggacgttactggttaggtacagtactttctacgataggcaagcaaaaactagataaattcaagttagagattttaaaacaattagaaagggaaccttatacaaaatacttcaatatgactagacaacacgttaaaaatcttactatgaatatgacccagtttccacaatactacattctagcaggtcccattcgaaacgatagtataacctatctgtggttcgatttttatagtacccagcttagaaaacccgccaaatacgtctactcacagtacaatcatacggctaaaacgataacattcagacccccatcttgtggtacagtgccttcaatgacttgtctttccgaaatgttaaacgtttccaaacgtaatgatactggcgaacaaggctgcggtaattttaccacgttcaaccccatgtttttcaatgtaccacgttggaataccaaattgtacgtgggtccgactaaagttaacgtagatagtcaaacgatttattttttgggtttaaccgccctacttctacgttacgcacaacgcaactgcacacacagtttctacctggttaacgccatgagccggaatctattccgcgtccccaagtatattaacggcaccaagttgaaaaacactatgcgaaaactaaaacgtaaacaagcgccagtcaaagaacaattagaaaaaaagactaaaaaatctcagagtactactacgccatatttttcctatacaacgtctaccgctctcaacgtcactactaacgcgacttataaggttaccaccagcgcaaagcggattcccacatctacgattgcttatcgtcctgatagcagctttatgaagtccattatggccacgcagttaagggatctagcgacatgggtgtatactactctacggtatcggaatgaacccttttgtaaaccagaccgtaaccgtaccgccgtgtcagaatttatgaaaaacacgcacgtattgattcgtaacgaaacaccgtacactatttacggcactcttgacatgagctccttatactacaacgaaaccatgtccgtggaaaacgaaacggcttccgataataacgaaactacacctacgtcaccatcgacgaggtttcagaaaacgtttatagatcccttatgggactatctagactcgctgctgtttctagataaaatccgtaactttagcctccaattacccgcgtatggaaatcttaccccgccggaacaccgccgggctgtaaatctatccaccctcaatagcctttggtggtggtcgcagtaaagttctggaagcagcaatgtcgtagtacgatacaaaaggctcccatcagaatgagagcgttaagcatagtccaccaggctgcaaagctggatagtgaaagctcatacatatgcgatgtacaatgcgcattgtaaaaatcattgtgagcatgtggtctcatcacgttggggtcgtgagtggtggaaccgggtttggcactagtcgtcgatgaagtacttgtcgccgtagttgtactagttgtcgcaacagccgttgacttcacggttgttgaggtgcgagtagagctagaaggactcggtgtgctagcagtcgacgtattgttggaacttgccgctaccgataaaaccaaaagacctagtactagtgtgttccactccatcgcaccaccgccacgatgcttacgatgttgaccgaccgaatcgactctcaactggtactgtcgcggctgccgcgctcccgttttcagcgattctgggagacccctacgttaataatgaaggaagagtccgcaccgtcatcaggctccatcatcctagccgagaaatccgtcaacatgcgttactgcgtacgtttcgctagcgatagcgattttcaaaccacatttacgctgccccaatcggtcgaggagaaatacgacaaagagcagcatccgggagaagatgaagcgtcgtcgccattaccgtcaccgctcaaagttccctacaagtggatgccttccagtttcatcgtcaaacaatgccacacgcagctggccttttacaataaacacatcatttggctatcacgcgagcgcaaagtgcccacctcgctgggcgtcagcctctatatccccgaaggttttttcggcattaccttttacaaatgcctggacgcgcaattcgtttgcatgcccgagctgctggaatccgggctgcaagtcccgcagttggatgtcgtcaacctcaacgacacttttcagtccatctttccgggcaccatcgaaggcgatatcggcgttttcccctgttttgtgccagaaccctggcagctcatgaacttgccgccgcccaacgaacaccgtttcttttcattacgtacccgtcagacgctggtgatcggtccgggtcacacgcaaaccgtctattttgacgcggcctacgtgcacgcgcccggtatctgcgccctcatagtgggcgtgcgccagtttagtcagtcggatctcatcatccgacccaccatctggctcccgggtaccgcggccggcgtgacggtggtcaacacttcgcacaccaccgtctgcatctccccacacaccaccgtagccaaagcggtttttaccacccaccgctttacctatctgccggtgggcagtcaccccctaggacagatgatcgtgccgcccacccccgacatcggtttcacccacacgcccgagcacgcgttgctgcaacggacaccctcgccggtagacgatgacgtcgacgagacagaagaagatgaaaagagctccgacgcagaaagccctgtcaacacgaatgacgttatttttgacgtcggcccgaaacctccccgtcatccctgacctaataaagtacgtctatgagaaaccccgtactcgtcgtgtccgtgatcacgtacgttttccaaaacgtgccaggctgttcacgcggaggacagcaaggccgccgccgtgggtttctttttcttcacgcccctgagttcacgcgcggaacccacaaagggtatctggggaggaggtatggtgaccatggtcggtgacatcaccgcctcccgaggcacgtcggggctgtgtcgcatgagatccaaaatctcgcgttcgtgattcgtaggcagcgtctcctgcggcgccgactccttgtagcgccgacggtgagacccgcgtccctggggctgctgctgcacgggctcgaccggcggctgctgttgcacgggctcgggtgacggcgacatcacggtcacttcatcctcctcgtcgccctcttccagcagccgctggtcgaacctcataacggtaggacaggagacggtgttaatgtgagccaaactcatcataggacgcgtgacccccgtttcctcggggatcagcgagtccgaaaccgagggacaggcaaaggccgacacggcggcaaccgtttccccgtcctcgcggacaccgctttccccctgaacgaccgccggtggcgtcggtggcgcaaccgtcgcagccgcgccggcctcgagcatgtacgcgcttttctcgcagtccatgtccaccaggcccataacgcgctgcacctccaccagcgaggcctgatccgtggagaacttgtccagcaacatctccaagctgtcggcctcggacatggcaaactcgcccaccaccagtttgaggataagaatgtccagggcctccaggatacgctgcgatttcttgcactccacctcggccgccggccgcgtgtgaggcaaacagccctccgagagatagcccttgagaaacgcgcacttgctctggcattgcctatagagcggcagcagcttcagcaggtggttcaccacgtccgtgtcgcgagaaaaggttcgcaggtcggccggggtgatctccagctgcttaaagttctcgtccagaaacgcctgcagctcgcgcagctccacgtcctcgctaggctgcagcagcacgtaatcggccacaggcgcggctttgcgacggcacatcagcagctcgcacaggcgctgggctagctgcatcgtgccggcgcgacgatgacgctcgttctgttcgcaacagagtatgattctgctcatatagtcgccaacgtactctcgcagacaccgacggaccactgcgtcttccccctgctggtcaaacaccaggtctcgcgacgtgtttatttctgcctacagacgcaaaagtgctcggactcgcggcgggtggcgcccgtcttcgccgtgaacaacgaaacgctgcagctctcgcgctacctggccgcgcgccagcccatccccctctcggcgcttatcgccagtctggacgaggccgagacgcagccgctctaccggcatctcttccgcacgcccgtgctctcgcccgaacacggcggcgaggtgcgcgaattcaagcacctggtgtactttcaccacgcggccgtgctacgtcatctcaaccaggtcttcctctgccccacctcgccctcgtggttcatcagcgtcttcgggcacaccgagggccaggtgctgctgaccatggcctactacctattcgagggccagtacagcaccatctccaccgtggaggagtacgtgcgcagcttctgcacgcgcgacctgggcaccatcatccccacgcacgcctccatgggcgagttcgcgcgtctgctactgggctcgcccttccgtcagcgcgtgtctgctttcgtggcgtacgccgtggcgcgcaaccgccgcgactacaccgagctagagcaggtggacacgcagatcaacgcgttccgcgaacgtgcgcgtctgcccgacacggtctgcgtgcactacgtctacctggcctaccgcacggcgctggcacgcgcgcggttgctcgagtaccggcgcgtggtggcttacgacgctgacgcggcgcccgaagcgcagtgcacgcgcgaaccgggttttctggggcgccggctttccaccgagctgctggacgtcatgcaaaaatacttctcgctcgacaactttctacacgactacgtggagacgcacctactgcgtctcgacgaatccccccactcggcgaccagcccgcacggtctgggactggccggctacggcggccgcatcgacggcacgcacctggcgggcttcttcggcacctccacgcagctggcgcgccagctcgaacgcatcaacacgctttccgagtctgtcttctcgccgctggaacgctccctgtccggcttgttacgtctatgcgcctcgctgcgcacagcccagacctacaccaccggcacgctaacgcgttactcgcaacgtcgctacctgctacccgagcccgcgctggcaccgctgctggagcgaccgctgcccgtctaccgcgtacacctgcccaatgaccagcacgtcttctgcgccgtggcctccgaaacctggcatcgcagcctctttccgcgcgacctgctccgtcacgtacccgacagccgtttctcggacgaggccctgaccgagaccgtgtggctacacgacgacgacgtggccagcaccagccccgagacacagttctactacacgcgacacgaagtcttcaacgaacgtctgcccgtcttcaattttgtggccgactttgatttacggctacgcgacggcgtctccggtctggcgcgacacaccgtctttgagttatgtcgcggactacgacgcgtctggatgaccgtatgggcgagcctctttggctacacgcaccccgaccggcacccggtctatttcttcaaaagcgcgtgcccacccaacagcgtgcccgtggacgcggccggcgcgcctttcgatgacgacgactatctcgattaccgggacgagcgcgacacagaggaagacgaagacgggaaagagaataaaaataacgtcccggataacggcgtttttcaaaaaacaacgtcctctgttgacacgtcacccccttactgccgctgcaagggcaaactggggctgcgcatcatcacgccgttccccgcctgcaccgtagccgtacaccccagcgttttacgcgccgtggcgcaggtgctcaatcacgccgtctgtctcgacgccgaactgcacacgctgctggaccccatctcgcatcccgagagcagcctagacacaggcatctaccaccatggacgctctgtacgtctgccctacatgtataaaatggaccaagacgacggctatttcatgcatcgccgtctgttgccgctgttcatcgtgcccgacgcctaccgcgaacacccgctaggctttgtgcgcgcccaactggatctgcgtaacctgcttcaccaccacccgccgcacgacctgcccgcgttgcccctgtcgccgccgccacgcgtcattctcagtgtacgcgacaaaatctgcccctcgaccgaagccaactttatcgagacgcgctcgcttaacgtgacgcgttatcgacgccgcggtctcaccgaggtgctcgcctatcacctgtacggtggcgacggcgccactgccgctgcgatttccgacacggacttgcagcggctcgtcgtcacccgcgtgtggccgccgctgctcgagcacctcacgcaacactacgagccgcacgtcagcgagcagtttaccgcgccccacgtcctcctctttcagccccacggcgcctgctgcgtggccgtcaagcggcgcgacggcgcgcgcacgcgggattttcgctgtctcaactacacgcaccgcaacccgcaagagaccgtgcaggtgttcatcgacctgcgcaccgagcacagctacgcgctctgggccagcctctggagccgctgtttcaccaaaaagtgtcactccaacgccaaaaacgtccacatctccatcaaaatcagaccgcccgacgcgcccatgccgccggcgaccgccgtctgagcctcactttccacggcgccggtgacccgccccccggcagcggtctcatctatatatacatcagcgtgcccgaacgtgaccttcctagcgacggcggccatggagctgcactcacgcggccgtcacgacgctccgtcgttatcttccctgagcgagcgcgaacgccgcgcccgtcgcgcacggcgcttctgtctggattacgaacccgtgccacggaagttccgacgcgagcgaagtccaacctcgccgtcgacacggaacggagcagccgccagcgaataccatctcgcggaagataccgtcggcgccgcctcgcatcatcaccgaccctgcgtccccgcacgacgaccccgctacagcaaagacgatgataccgaaggcgatccggaccactatcctcctccccttccaccctcctcccgccacgcactcgggggcaccggcggacacatcatcatgggcaccgcgggcttccgtggcggacatagggcgtcctcctctttcaagcgacgcgtggccgcgtccgcctcggtgccccttaacccccactacggtaagtcttacgacaacgatgacggcgaaccgcaccatcacggcggcgattcgacgcatcttcgtcgccgagttcccagttgtcctacgactttcggttcttctcacccctcctcagccaataatcatcacggatcgtccgccggaccgcaacaacaacagatgctggcgcttattgacgacgaactggacgccatggacgaggacgaactacagcaactcagccgtttgatcgaaaagaaaaaaagagcgcgtctgcagcgcggcgccgcctcgtcgggtacctcaccgagttctacctcgcccgtctacgaccttcagcgctacacggccgagagtctacgtctggcaccctaccccgccgatctcaaggtccccaccgccttcccgcaagatcatcagccgcgcggtcgcatcctgctgtcacacgacgagctcatgcacaccgactacctgttgcacatccgtcaacagttcgattggctggaggaaccgttgctgcgcaagctggtggtggaaaagatcttcgccgtgtacaacgctcccaacttgcacacgttgctggccatcatcgacgaaacgctcagctacatgaagtaccaccacctgcacgggctacccgtcaacccgcacgatccctatctggagacggtgggcggcatgcgtcagctgctcttcaacaaactcaacaacctggacctgggctgcatcctggaccaccaggacggctggggcgaccattgcagcacgctcaaacggttagtcaagaagcccggtcaaatgagcgcctggctacgcgacgacgtctgcgatctgcagaagcgtccgcccgagaccttctcgcaacccatgcaccgcgccatggcctacgtgtgctctttctcgcgcgtagccgtctcgctacgccgtcgcgcgttgcaagtcaccggtacgccccaattttttgaccagttcgatactaacaacgccatgggtacctaccgctgcggagctgtctcggacctgatcctaggcgccctgcagtgccacgagtgtcagaacgagatgtgcgaactgcgcatccaacgcgcgttggcaccctatcgtttcatgatagcgtactgtcccttcgacgagcagtcgctattggatctcaccgtctttgccggtacgacaacgacaaccgccagcaaccatgccactgccggcggacaacagcggggaggagaccaaattcatcccaccgatgagcaatgcgcaaatatggaaagcaggacggacccagcaacgctgacagcttacgataaaaaggacagagaagggagtcatcgacatccctctccaatgatcgccgccgctcctcccgcccagccaccgtcgcaaccacagcagcactactctgagggcgagctggaagaggacgaagacagtgacgacgctagcagtcaagatctggtacgagccacggatcgacacggggacaccgtcgtctacaagacgaccgcggtccctcccagtcccccggcgcccctcgccggtgtccggagtcaccgtggtgagcttaacttgatgacgccgtcgccttctcacggcggcagtccaccccaggttccccacaagcagcccatcatcccggtgcagtccgccaacggtaatcacagtacgacggcaacccagcagcagccgccgccaccaccggtaccgcaagaagacgactcggtggtaatgcgctgccagacgcccgattacgaggacatgctgtgttacagcgatgatatggatgactaaaaagagagtgaagggtgttgtgcgtgatgattgctgtcccttatcccgttacaaagaaaaaatggtgttacacactccttggtactactatgacccgtggtgagatatccgatgatgataatgatgtacgcgtgcctgagcttggtgtttttttctctctgtgagcttttttccccataagctgtgtactgttcgtgtccggaccccatacacggttttcgttaatgacggccccctccttttcccccaccgtaaaaaaaaagcacaatacacatgtggttttttggttcgaatcgagcttggcgtttatttcttctcgagccccacgtcctctccctcccattcttatatatacacatgcccaagattgggggggaacgtgtgtcgtttccaggtcgtggtgacgatgatgatgtggtttttatcggggtggtagtacaagggtttgctactgtagtcgaaaaggtgggccgagaacatagaggaactaactcctaagcgatggctcaaaggcggatgagcaaatcattaaaatccttgactgtctatggttatgcaaaaggatatataaagtataaatagcgtatataaaaacatatatctatgtacaagacgcatgggataaataacacgtatttacacatttttctgcacatgtacaacatttgaggacgaggagacgacgaccggccggtcgccgccgccgcggttgctactactttcttaagtgatgcgaattggtggctatggtgaggagtttggaggaaataatatacatcatatattctgatgacagtgtagtaaacatttcactggctttggcccgatgcgacggagggccccgacgtcccctctcccggaggggggaagaggcacgacgagcgagggccccgtcgtacgaggaacaagaatcttcttcattctttcacagtaaagcacatttctttatgtggggacgggaatcgatgtcatttgtgtatttgcattcggtagagagctacagtctccagtttcacgatcgttgtgcatcatacaacgacactttttatcctacaaatttcacacctatctatatacacacaatataaggttatagcatcatctagtttgttcatttcatacctgttgagaacgtttatgttctagcaattgatttcgcgtcatagggctgtgacggtgattcttcagagaatcaggaaaaaaaaaagaggctcaacgagcaccagagactaagtcggaaaactcgcgcccgcttccccggacggtttcggcttagcctctggcctgcgatggtttttttattccaagttcgttccatgaatagagcgttatacgattgtgttttcgtgtcattcagacgtggttgatcatgttactacgtgtgtgttttttgctttggtcggtacacggtccctttcagcggacccagtgttccttggagagacgaaaagcgagcgtgtttcacgagatggctgatgccgagtgtcgtcgacataagtcattttctaaagaagcaacataaaaaaaagatgatgtggttcgtcgtactcacagtctcgtttagctactatagatattatagatccagagagcgtaccgcccgagagaacaccgtcttctccgggacgtcttgccgtcgtccgtcacccgggcgtcgagatgttcgtagagaacgatggaggacgaccaacaccgacaggtggtgctcatgagggtgtggtgtcgatggtgcgtttttttttgcctcggcacgaccgtatttgcccgtcttaccgcacctccggaaagatggtgtttttacgcaggtgggtgaggcagttttttttttcagatgacaacgatggtaccgatagagcctgagatgatgatggctacgaaggacgggcggacgggcaaacgatggtgagaggtcgccaccgaggggtgccttttttttttctggtcagatggaacgtcgtcggtctcgagcgccccccgatgtagggccgctctcttacgtatcccgggtcgattcagaccgacaaaaagagcgtccagagacgcggtctctttcttctcgaacggaaagtccgaatcctacacatttctagtcgtgacggctagctttttggtggtcatggcggtggtggtcaacatatatctccagatacaggagatgaggaaaaaaaaaggaggacaagtctaacggaataatatccgatcatatatatggagggatatcaggtcatcattgtgtatcaaaagatgatttgtacaacagggaaggatacggttttaaaggttagtgcagagaaactatataaagagcgtataacatggagttcattctgtcattaaaaaggttttaagtagagcatattaaaaatagacgagagctagagttttattcttggttcatcatatattttgtaaaaaaaaaaaaaaaaaaaaatagaaaaatataggtgccggacgccggctacgtcccagtccggggcttagcgcacccaaacgcaggtttcccccgttttcaaacacctcaagatcttttgagaaacacatatttttgttatacacagtgaaaacgtggggggacagagttccaaacacgtgtctatcaagcaaaaattcagacgatataaatatggagagttttttcttcttatacaacagcgacagttcggtgtacatagcgtataatatatataggtcacatacagacttatgagctttttaccaaacagatgcaaatcgcctaccggaggcgggatcgggcgtgaggttctggctgcacccgcccgatccctcgtcggcttctccggcggctgtcctaaaatgactaggttcgtatatagagctataggtctttcatgatactgatgagaaatctatggtttgcgcgtcttatctgaatatatctagcacgatatagacgatacacgtcaagatcattgtatcacttcttttcgtctacgtggtaagagtcttggatactaaatatgtatataggcagcatttatagtttcaaaggatagaagatagtttttggacactgatagatatggcgttgttgagcggttgtgttggatgaacttgtcatcattctgtattttttcacataaggtgttcttttcttcgagcagtttataaaaggggtcaggcgcgatgactagagggcgcactttgggtgcggtcctccatcgcttgtcaacaaccggatgtgactcagcgagcacgagatggtttgacgtcagcgacagttagccctcagggcgaaaacaggaagagtcgcctcgacggcgccctctaggtagcatcacggaacaggcggcgatcgcggactcgcctcggccagggggtaccgagggggtgcccgcgactcgcccctcctccaagatggcgccgctcggccagactcgtcgagattttcagggctatcattttttcgctctgagcagaaaaaaagctcttcaaaaacgtctcaaaaaagcacagaaaagttatcgtgctatttttttacccgcctggagcgaaaacgctcctcggctctcgacgccattttctctcgtccgccatgtcggagctcagaacggcatgacgagcgagagaaccgtcgagaaggtcaccaagatggcgccggttggggtgcggtcaaacggtgttttacagtttcggggccatttgaacagagaaaggtggggaattttgagggacacggttttgtcggatgggggataaaatcacgccctgtcgtcgtattgccgtcacgaattttttcggccgtctgcacccgtatcggttcacgggttttccacggcaaatcggagaagggaaaaaaaaggtggggcctgttcccttcccgggtctcggacgagtcgacacgccgggtgggacggtcgtggtctcctcggctcgtgccgggaccctccctgtggattcacggtgttccggacccctccaggaaagggtggaaaacgcgtggagcccacggggacgtgcgttcgtaccggggaaaaacccgactgggcctgaaccaacgttgggcgacctgccgggcccatcgtgtggggacagtgattatggaggggcgtactaacggcaattgaggtgtcatggcggcccaccgtcgaccccgagcgcttccggccacacccaacctcaccgccgcatcggccagcacacacgccacagcctagtggggtccgaggcgccgaccccggctgggcggccgatggggggaggggagtggggggaccacgcccagggccagcaagccgcgacggttcgggcggagtttttggggagcagtgggggaggggagcgtcacgggaccggccaacgcccagggtaaggcggaccgagagccgacggctaggccgagggacccccggccacgaccggcgaccggaccctcgagaggggggaggggagcccaaccggagccaccgagagggagccgccgcgagacccggaagccgtcgcggtcgaccccgctcccggagctcctgactgggcccccagcccccaaccctccggggccgactgccgtcgagccggggcgtcgcccgtccccaccaccgtccgcccggcccacctaccgtcgtcgtcggccggccgccgcgacccccagccggaaaaagagcccggagggacccaaaagccagcggggcgagccgggaaggggagctgggtgggggatccccggtcgcccaccgcggaacgagcctaggaaccggggtccgcgacccagccccccgtggggggaggggaagggcgcggaccccgggtcccgtccgttccgcggcgggtggaccgggaagccggcggaggtcgccgggagcagcgagggatcccggaccggagcccggggaggagcggggtggggctgggaagcccccgctcgggtccccccgggccgcggacgggaaccgggaccccggtgcgggggtcccagcccggccgggccgtcggatggggggtcgagcggggggaggggagggacccccggccgaggtccggagcgggccgcgcccggtgcccggcccacggccccggatggtgctccagggcggtgggacgggcccgcggacggaccggcgccgggcctcggccggggagggtggggggtagggcgggaggcaggcgagagcgggcgcagcgtgcggaccgcagcacggccggaaccctgccgcggactgcgccggggggcggcgggcacgccgggttttataggttctcagaggccccgcctaggtgggcggagcggtaattttccaccgccgcggcccatgcccggcacggggctcgcgctccctaggtgcggccgcccagtggaaaaataccggcgcatgcgcacgaagcgcatccaatggaaatttaccgacgcatgcgcactgaccgcctccagtggaaaaataccggcgcatgcgcacgatgcatgcccagtggaattttaccggcgcatgcgcagggcgcgcctcccgcgggtcctggcccgcgcatgcgcaccgggtcccctggtttaaccctctttatatataggctttccatacgacatccccggcgcatgcgcactcgaggccacatcccataatccgcgtggcaacgccctaacaaccgaaaattcgccccgactgcgcatgtgcacggaaacgccgtcccattggaaatcatggttgcccaaatttggtaaaaatttgccccccccggttccggaggagaagggggggggtgaggggggggggttacggtggttcccgttccgccagtccgttttcgtagaacgtttcgttagaagaattatgctatatagggtatgcatcctaggggtggaagctaggctccgcccctacggggcgtcgcctagcatccggtatacgtaaaacggactgatgacgtagctcgcttcgctcgctacgtcatcagagatgatttccgccggagatgacgtacgcatacgtgacgtagctcgctacgctcgctacgtcaccgtatgtccggaattccacaggatgacgtatatccggagtgggtgtggtcacgcgagtgtgacgtgagcttgccaggggtcacgtgagaagcggcggcgttaagtttactaggccaaaacagaggaagggggcggataccctaggtaagggggcgtgcacgtagccctgtagacactcccccctagggtccagtagcttatgacgcgtatccgggagtagcgtctacgtcagcaggtgtatatttccggtagacggagaagcctgtacgtacaccgaggacggtggaaccctaacgggttccacctatctgaaatttccgtacaaggggtggagtctagggagggctcattgtatatccgtttctgtgattggtagataaggtggcgtacctaggggtgtggctgtatacgtaagcggatatagctacacgtaatgggtgtggcttcactagggatcgctgtattctaccgcgcgcgcgtgcgtgcgcgcgcgtgacgtaacaaatcaccttgtgattatgacgttggcatctggcaccgcctcttgggcggttctacgggtctcgcttcctgcgccgatggtcacgtgaccaacaaaagtgctcaccgcctcgccggccacggggtttatgcctgttcttatgcagacaccagatggcgctcgttgatcgggaaagctgtctacgcgggttttacagtgtatttttgcgtcattgtgacgtagagccgacgatcgccacattcgatggtgtacgctcgccgccagatgtcgtcaggttgtacccaaaaccccgttatgattacacgctggcttccgcattcttggacacggcggtttcaggttacattacatcaagccgcgacaacgccccgaacaaaaacaccgggcaccgttatgtatacacgacgtcgatactgatcgccgtagtgacgtcagttgacacacaacaccgttccccatcacggtgtttcatggcaatgggcgagagttactttttacaagacgaaaaatgtgttttttggtaaaaaagaggggggatggggaaataaaaatacacaattttaaagttcggatcttttcctgttttattgactcgtaaactgtaaggtcttcgagtacgtgtcgggggtctgtgccgcgtacgtgttcgggaaaccacgtaacgtggtttgtgtcgtgttgtgacgttgagataatacacgtttggcgcccataggcgcgcgggtttttggggtgtgtagcttgtacggcgttttgtcggcggagcgcagcgaaaattggtggtgatagcggtgattgaggttgcgagatcagatccaccgcgcttgtaccaccgtggtgcggtgtttctgcttgtaaaccgtcaggtggttctttgtgatttaaaaacaccgtgttcgtgaaacgtgacttttcacggtttgttagctgatgtgattttggaggccacaaacaccgtacggtgttttcggggatcgggctcgggatttgcctgtgtggcccggtgacggtaggacagaaaacaccgttttctagggacggtgttttcacgtgccctgtgtggggtttttatgtgctgcttgtgcgactgagtgggaaaacgggttgtgaccggacggtgtgctgaggataaacgacgtgtgcagctaccgacgttagtttgcggtgacgcaaagctgtcccgaacatcacgctattttcgcgggcgggtgcgtcggctagcggtctggctgcgagaggctgcccgaccgtaacggttagcttttctcacgaattgctgggatcgttgcggttgtcgcctttggtggtccgcaaccgcagccagaccgcagtggtggccacggtggtgtctcagacgtcgtgcgtcaaacatgacgtgctgaacttttccttggtataaaattcactcagtggcggcgtagccattgtcttccgttcatccaccatgagccacgaggaactaaccgcgctagcgccggtggggcccgcggcttttctctacttcagcaggttgaacgcagaaacgcaggagattctggccactctctcgctatgcgaccgttcctcgagcgtggtgatcgctcctctgttggcggggctcacggtggaggcggatttcggcgtctctgtgcgcacgcctgtgctttgttacgacggcggggtgctcacgaaagtcacgtccttttgtccttttgcgctctactttcatcatacgcaaggcatcgtggcttttaccgaggatcacggagacgtgcatcggctgtgcgaggacgcccgccagaagtacgcgttggaggcctacacgcccgaggcggatcgcgtgcctaccgatctggcggcgttgtgcgcggcggtgggctgtcaggcgtccgagacgactgtgcacgtggtggtgggcaacggcttgaaggagtttctttttgccggtcagctgattccatgcgtggaggaggcgaccacggtgcgactgcacggcggcgaggcggtgcgcgtgccgttgtacccgcctacgctctttaattcgctgcagcttgacgccgaagccgacgaggtctcgctggatgcgcgcagcgcttttgtggagacgcgagggctctacgtgccggccgtaagcgagacgcttttctactacgtgtacacgtcatggtgtcaatcgctgcgcttctcggagccgcgtgtgctgatcgaggcggcgttgcggcagtttgtgcacgacagtcagcagtcggtgaagctggcgccacataagcgctacttggggtacatgagccagcgactcagcagtctggaaaaggatcatctgatgctgagtgacgcggtggtttgcgagttggccttcagttttgcctcggtatttttcgattcggcctaccaacctgccgagtctatgctcttttccgagtggcctttagtgaccaacgcaaccgatcaccgcgatctgatccgcgcgctgaccgagctcaagttgcatctctcgacgcacgtggccgccttggtcttcagcgctaattcggtgctctaccagcacaggctggtgtatctccagtcgtcggcgcggcatcccagcgccggcggtacggccagtcaggagacgttgctcaaggctattcagttcaccaacgggttgtcggcggcctgcgaagacgtctacaacgacgcgcgcaaggtgctcaagtttcaaggcgcgccgctcaaggacgaacgctatgggccgcagcatttggcgttggtgtgtggcacgtgtccgcagctagtttcgggcttcgtctggtatctaaatcgtgtctcggtgtataatacgggcttgtcgggttcgtcgacgctcacgaatcacctggtgggctgcgccgcggggctgtgcgaggcctgtgggggtacttgttgccacacgtgttatcagacggccttcgtgcgggtgcgcacccgcttgcccgtggtgcccaagcagcccaagaaggagccctgcgtgatcaccgtgcagtcgcgttttctcaacgacgtggatattttgggcagcttcggtcggcgttacaacgtcgacgccaaggacgggggtttggacggcaaaggtgacgacggggttccgggcggcggtgctggcgggggtggtggacgagacgtgagcgggggcccgagcgacggtctgggcggcggtcgtggtggtgggggtggcggggattccgggggaatgatggggcgcggcggtcgcatgctgggcgctagcgtggaccgtacctatcggctcaatcgcatcttggattactgccgcaagatgcggctcatcgaccccgtgacgggcgaggatacctttagcgcgcacggcaaaagcgactttgtggccgtcttttcggcgctcaacaagtttgtggacgacgaggccctgggtttcgtttcggaggtgcgcctcaagagcagccgcgacgaggtggcgggcgccacgcaggccttcaacctggatttgaatccctacgccgtagccttccagccgctgctggcctacgcctatttcagatccgtcttttacgtgatccagaacgtggcgcttattaccgctacctcatacattgtggacaatccgttgaccaccaacttggtatccaaatggatgacgcagcattttcaatccattcacggcgcgttctccactacgtcgtcgcgcaagggctttctcttcaccaagcagatcaagtcgtccaagaattcggatcatgaccgtctgctggactttaggctgtacgcgcagggcacgtacgccgtggtgcccatggagatcaagctctcgcggctgtcggtacccacgttgatcatggtgcgagtgaaaaaccgacccatctaccgcgcgggcaagggcaacgcggggagcgtgttttttcgccgcgatcacgttccgcgtcgcaatccggctaagggctgcttgggattcctgctgtatcgacatcacgagcgactctttcctgaatgtggtctcccctgcttacagttttggcagaaggtctgttccaacgcgttgcccaagaatgtgcccataggtgacatgggcgagttcaatgctttcgtcaaatttctggtggctgtgacggctgactatcaggagcacgatctgctggatgtggcgccagactgtgtgctgagttacgtggaaagccgtttccataacaaattcctctgctactacggcttcaaagactacatcggctcgctgcacgggttaacgacgcgtttaacgacgcagaaccacgcgcagtttcctcacgtgttaggtgctagtccgcgtttctcgtcgcccgccgaatttgcgttgcatgtcaagggcttgaagaccgcaggcgtgccggcgcccatggccgccactgtggcgcgtgaatcgttggtacggagcgtttttgagcatcgttccttggtgaccgtgcccgtgagcgtggaaaaatatgcgggtatcaacaacagcaaggagatctatcagtttgggcagatcggctacttttcgggcaacggtgtggaacgcagccttaacgtgagctctatgagcggccaagattatcgtttcatgcgccagcgctacctcttggctacgcgtctggccgacgtgctcatcaaacgctcgcgccgcgagaacgtgctttttgacgcggatcttataaaaaatcgcgtcatgctggcgctggacgccgagaacttggattgcgatcccgaagtgatggccgtgtacgagattctgagcgtgcgcgaggagatccccgcgtccgacgatgtgctcttcttcgtggacggctgcgaggcgctggccgcgtcgctgatggacaagtttgccgcgttgcaggagcagggcgtggaggacttttcgctggagaacttgcgacgcgtgctggacgccgacgcccagcgattgacggacgccgccgggggggaggtgcacgacctgtcggcgctcttcgcgcccagtggcgtcggcgcggcgtccggcgtcgggggtggcggtcttcttctcggcgagtccgtcgcgggcaactccatttgcttcggcgtgcccggcgagacgggaggtggctgctttctcgtgaacgccggcgaagacgaggctggcggcgtcggcgggagcagcgggggcggcgggggcagcgggttattgccggccaaacgcagccggttgtaaccgccagcaaacgccgcgacaacggccgccgcagccacgagcgttgcaacaacagcagcaacagtcgcagcccccgtggccgcttttcagaccgcaacaacagcagcaacagcagccaccgacacagcagcaccaggcgataccgtatcagctaccgccgcaacagcggcgacagacggcgtcgcatcatcaacagcagcaacagccccgaaggttagcgccgcggcaccagagacagagaccgccgccgcgctggcaaactccgacattcgcgtcggcgcccgggccgcctgaggaaggggaggagtgtcagacacagccggtcatctccgagcccccgtcgcccgaggcggaggagccggcggcggcggtggtggaggaggttgcgccgcaagcggcggcaacagcttcgggagcagaacccgcgtcgtcgacgacgtcgttatatattaacgtcaacgtcagtcggcatagcgagcggcccgcgagttatttgtgcaccgactccatgtctctggccggcgccagaccggacgacagcgtctcgtacgtgagcgagtcgagtcatggagatgaatttgttacagaaactatgcgtagtgtgttcgaaatgcaacgaatacgccatggagctggagtgtctaaagtactgcgatccgaacgtgttactggcggagtccacgccgttcaagagaaacgcggcggctatagtgtatctgtaccggaagatctacccggaggtggtggcgcagaatcgtacgcagagttcgctgctgacgctctatctggagatgctgctgaaggcgctgcacgaggatacggctttgctggatcgggcgctgatggcctactcgcgccagccggaccgggcggccttctaccgtaccgtcctccgtttggatcgctgcgatcgccatcacaccgtggagctccagtttacggacaacgtccgtttcagcgtcagtctggccacactcaacgacatcgagcgcttcctgtgcaaaatgaactacgtgtacgggatcctggcgccggaggccggcctggaggtctgcgcgcagctgctggagctcctccgtcgcctatgcggcatctcgccggtggcgcgtcaggaagtgtacgtcgaagggacgacatgcgcccaatgctacgaggagctgaccatcatcccgaatcagggccgctcgctgaacaagcggctgcagggcttgctgtgcaaccatatagcggtccaccgtccgtcaagccagtccgatgtgaatatccagacggtggagcaggacctgctggacctgacaacgcgcatcccccacttggctggagtcctttcggccctcaaaagcctattctcttcttcatcggcctaccacagctacatccaggaggcggaggaggcgctgagggagtacaacctgtttacggatataccggaacgaatatattccttgtcggattttacctactggtcccgtacctcggaggttatcgtcaagcgggtgggcatcaccatccagcagctaaatgtgtatcaccagctgtgccgggcgctcatgaacggcatcagtcgccatctgtacggggaggacgtggaggacatcttcgtgctcggggaaaaggcgttggacggggaggagcgcatgttcgtggggtcggtctttgccgcccccaacaggatcatcgacctcatcacatccctcagcattcaagctttcgaggacaacccggtgttcaacaagctccacgaaagcaacgagatgtacaccaaaatcaagcatattctcgaggagattcgacgtccgctgcccgatggcacggggggcgacggccccgagggcgaggctattcacctgcgtggacgggaggcgatgtcggggacgggtacgactttgatgacggccagcaacagcagcaacagcagtactcacagtcagaggaataacggtggcggcggccgggctcgtggaggaggcaagaaagtggtagggggaggggtgaatgggcaggacggcgacggcagcgagaacggcttacgggtgcgcaactgcgatgaacacgaggctctcgacttggtggacgcgcgttcccgcatccacaacgtcacccgcgaggtgaacgtgcgcaaacgcgcctacctgcagaaggtctcggaggtgggctatggcaaggtgatccgttgcatcaaaacgcaggagcgtctgactagcaaactcatcgatgtcaacctagtggggcccttgtgtctggactttatctctaagctcatgaatgggtttctataccgcagccaataccaccaggaccaagacgtggtggacgtgggggatcagtttacctatgatgagcacctgtatgtggtcaataacctgatccacaagagtctgcctgtggaatccctcccgctactgggtcagcagatctacgagttgtgtaacgggcctcttttcacccactgcaccgatcgctatcccctctctcacaatgtggacatggcctatgcctgcgacaacgcgggcgtactaccccatgtcaaggacgatttggtcaaatgcgcggaaggtaccgtgtatcccagtgagtggatggtggtgaagtacatgggttttttcaatttttcggactgtcaggacctaaacgtgctgcagaaggagatgtggatgcacgtgcgggagctcgtgctctccgtcgcactatataatgaaactttcgggaaacaactctcgatcgcgtgcctgcgcgacgaactgcacccggacagagatgtgattctcacgtataacaaagagtggccgctgctgcttcgtcacgaaggaagtctttataagtccaaagatctatatctcctcctctacaggcatctgtccagaccggatgagagtggcgacgtgccaacagctcccgtggccaagccctccaccctgacggccgccgcggccgtctcgggcgtcttcagggagccggaccgaccttggctgccaagtccgtatccctcctcctcgaccgcgggcgtttctcgaagggtccgcgcaacacgcaagagaccacgacgcgcctcatcgctgctggatttggcccgcgacgaacatggaatccaggatctggtgcctggtagtctgcgttaacttgtgtatcgtctgtctgggtgctgcggtttcctcttcttctacttcccatgcaacttcttctactcacaatggaagccatgcttctcgtacgacgtctgctcaaacccggtcagtctcttctcaacacgtaacgtcttctaaagccgtcagtcatagagccaacgagactatctacaacactaccctcaagtatggagatgtggtgggggtcaacaccaccaagtacccctatcgcgtgtgttccatggcccagggtacggatcttattcgctttgaacgtaatatcgtctgcaccccgatgaagcccatcaatgaagacctggacgagggcatcatggtagtctacaaacgcaacatcgtcgcgcacacctttaaggtacgggtctaccagaaggttttgacgtttcgtcgtagctacgcttacatccacaccacttatctgctgggcagcaacacggaatacgtggcgcctcctatgtgggagattcatcatatcaacagccacagtcagtgctacagttcttacagccgcgttatagcaggcacggttttcgtggcgtatcatagggacagctatgaaaacaaaaccatgcaattaatgctcgacgattattccaacacccacagcatccgttacgtgacggtcaaggatcagtggcacagccgcggtagcacctggctctatcgtgagacctgtaatctgaactgtatggtgaccatcactactgcgcgttccaagtatccttaccattttttcgccacgtccacgggtgacgtggttgacatttctcctttctacaacggaaccaatcgcaataccagctactttggagaaaacgccgacaagtttttcattttcccgaactacactattgtctctgactttggaagagcgaattctgcgccagagacccacaggttggtggcttttcttgaacgtgcggactcggtgatctcctgggatatacaggacgagaagaatgtcacctgtcagctcaccttctgggaagcctcggaacgtactattcgttccgaagccgaagactcgtaccacttttcttctgctaaaatgactgcaacttttttgtctaagaaacaagaagtgaacatgtccgaccccgtgttggattgtgtgcgtaatcaggctctagataagctacaacagatcttcaacgcctcgtacaatcaaacatacgaaaagtacggtaacgtgtcggtttttgaaaccacaggcggtctggtggtgttctggcaaggtatcaagcaaaaatctttgttggaactggaacgtttggccaatagctccggtgtgaactccacgcgtagaaccaagagaagtacgggcaacacgaccaccctgtcgcctgaaagcgaatctgtacgaaatgtgctctacgctcagctgcagttcacctatgatacgttgcgcagctacatcaatcgggcgttggcgcagatcgccgaggcttggtgtgtggatcaacggcgcaccctagaggtcttcaaggaactcagcaagatcaatccatcagccattctctcggccatctacaacaaaccgattgccgcgcgtttcatgggtgatgttctgggtctggccagctgcgtgaccatcaaccaaacaagcgtcaaggtgctgcgtgatatgaacgtgaaagaatcgccaggacgctgctactcacgacccgtggtcatctttaattttgtcaacagctcgtacgtgcagtacggtcaactgggtgaggacaacgaaatcctgttgggcaaccaccgcactgaggaatgtcagtttcccagcctcaagatcttcatcgccgggaactcggcctatgaatatgtggactacctcttcaaacgcatgattgacctcagcagcatctccaccgtcgacagcatgattgccctggacatcgacccgctggaaaacactgacttcagggtactggaactttactcgcagaaagaactgcgttccagcaacgtttttgacctcgaggagatcatgcgcgagttcaactcgtacaagcagcgggtaaagtacgtggaggacaaggtagtcgacccgctaccgccctacctcaagggtctggacgacctcatgagcggcctgggcgctgcgggaaaggccgttggcgtagccattggggcagtgggtggcgcggtggcctccgtggtcgaaggcgttgctaccttcctcaaaaaccccttcggagccttcaccatcatcctcgtggccatagccgtcgtcattatcatttatttgatctatactcgacagcggcgtctctgcatgcagccgctgcaaaacctctttccctatctggtgtccgccgacgggaccaccgtgacgtcgggcaacaccaaagacacgtcgttacaggctccgccttcctacgaggaaagtgtttataattctggtcgcaaaggaccgggaccaccgtcgtctgatgcatccacggcggctccgccttacaccaacgagcaggcttaccagatgcttctggccctggcccgtctggacgcagagcagcgagcgcagcagaacggtacagattctttggacggacagactggtacgcaggataagggacagaagcccaacctgctagaccgactgcgacatcgcaaaaacggctaccgacacttgaaagactccgacgaagaagagaacgtctgaaccaggagaagaaaaaaaaacagacaaaaaaagtgacacagagacttgtgatatacggggttaaactggatatctaggtgctgcatgtgtattttctttgtgattttgcttcgtaagctgtcagcctctcacggtccgctatgtttttcaacccgtatctgagcggcggcgtgaccggcggtgcggtcgcgggtggccggcgtcagcgttcgcagcccggctccgcgcagggctcgggcaagcggccgccacagaaacagtttttgcagatcgtgccgcgaggcgtcatgttcgacggtcagacggggttgatcaagcataagacgggacggctgcctctcatgttctatcgagagattaaacatttgttgagtcatgacatggtttggccgtgtccttggcgcgagaccctggtgggtcgcgtggtgggacctattcgttttcacacctacgatcagacggacgccgtgctcttcttcgactcgcccgaaaacgtgtcgccgcgctatcgtcagcatctggtgccttcggggaacgtgttgcgtttcttcggggccacagaacacggctacagtatctgcgtcaacgttttcgggcagcgcagctacttttactgtgagtacagcgacaccgataggctgcgtgaggtcattgccagcgtgggcgaactagtgcccgaaccgcggacaccatacgccgtgtctgtcacgccggccaccaagacctccatctacgggtacgggacgcgacccgtgcccgatttgcagtgtgtgtctatcagcaactggaccatggccagaaaaatcggcgagtatctgctggagcagggttttcccgtgtacgaggtccgtgtggatccgctgacgcgtttggtcatcgatcggcggatcaccacgttcggctggtgctccgtgaatcgttacgactggcggcagcagggtcgcgcgtcgacttgtgatatcgaggtcgactgcgatgtctctgacctggtggccgtgcccgacgacagctcgtggccgcgctatcgatgcctgtccttcgatatcgagtgcatgagcggcgagggtggttttccctgcgctgagaagtccgatgacattgtcattcagatctcgtgcgtgtgctacgagacggggggaaacaccgccgtggatcaggggatcccaaacgggaacgatggtcggggctgcacttcggagggtgtgatctttgggcactcgggtcttcatctctttacgatcggcacctgcgggcaggtgggcccagacgtggacgtctacgagttcccttccgaatacgagctgctgctgggctttatgcttttctttcaacggtacgcgccggcctttgtgaccggttacaacatcaactcttttgacttgaagtacatcctcacgcgtctcgagtacctgtataaggtggactcgcagcgcttctgcaagttgcctacggcgcagggcggccgtttctttttacacagccccgccgtgggttttaagcggcagtacgccgccgcctttccctcggcttctcacaacaatccggccagcacggccgccaccaaggtgtatattgcgggttcggtggttatcgacatgtaccccgtatgcatggccaagactaactcgcccaactataaactcaacactatggccgagctttacctgcggcaacgcaaggatgacctgtcctacaaggacatcccacgttgtttcgtggctaatgccgagggccgcgcccaggtaggccgttactgtctgcaggacgccgtattggtgcgcgatctgttcaacaccattaattttcactacgaggccggggccatcgcgcggctggctaaaattccgttgcggcgtgtcatctttgacggacagcagatccgtatctacacctcgctgctggacgagtgcgcctgccgcgattttatcctgcccaaccactacagcaaaggtacgacggtgcccgaaacgaatagcgttgctgtgtcacctaacgctgctatcatctctaccgccgccgtgcccggcgacgcgggttctgtggcggctatgtttcagatgtcgccgcccttgcaatctgcgccgtccagtcaggacggcgtttcacccggctccggcagtaacagtagtagcagcgtcggcgttttcagcgtcggctccggcagtagtggcggcgtcggcgtttccaacgacaatcacggcgccggcggtactgcggcggtttcgtaccagggcgccacggtgtttgagcccgaggtgggttactacaacgaccccgtggccgtgttcgactttgccagcctctacccttccatcatcatggctcacaacctctgctactccaccctgctggtgccgggtggcgagtaccccgtggaccctgccgacgtatacagcgtcacgctagagaacggcgtgacacaccgctttgtgcgtgcttcggtgcgcgtctcggtgctttcggaactgctcaacaagtgggtttcgcagcggcgtgccgtgcgcgaatgcatgcgcgagtgtcaagaccctgtgcgccgtatgctgctcgacaaggaacagatggcgctcaaagtaacgtgcaacgctttctacggttttaccggcgtggtcaacggcatgatgccgtgtctgcccatcgccgccagcattacgcgcatcggtcgcgacatgctagagcgcacggcgcggttcatcaaagacaacttttcagagccgtgttttttgcacaatttttttaatcaggaagactatgtagtaggaacgcgggagggggattcggaggagagcagcacgttaccggaggggctcgaaacatcatcagggggcttggacgaacggcgggtggaggcgcgggtcatctacggggacacggacagcgtgtttgtccgctttcgtggcctgacgccgcaggctctggtggcgcgtgggcccagcctggcgcactacgtgacggcctgtctttttgtggagcccgtcaagctggagtttgaaaaggtcttcgtctctcttatgatgatctgcaagaaacgttacatcggcaaagtggagggcgcctcgggtctgagcatgaagggcgtggatctggtgcgcaagacggcctgcgagttcgtcaagggcgtcacgcgtgacgtcctctcgctgctctttgaggatcgcgaggtctcggaagcagccgtgcgcctgtcgcgcctctcactcgatgaagtcaagaagtacggcgtgccacgcggtttctggcgtatcttacgccgcttggtgcaggcccgcgacgatctgtacctgcaccgtgtgcgtgtcgaggacctggtgctttcgtcggtgctctctaaggacatctcgctgtaccgtcaatctaacctgccgcacattgccgtcattaagcgattggcggcccgttctgaggagctaccctcggtcggggatcgggtcttttacgttctgacggcgcccggtgtccggacggcgccgcagggttcctccgacaacggtgattctgtaaccgccggcgtggtttcccggtcggacgcgattgatggcacggacgacgacgctgacggcggcggggtagaggagagcaacaggagaggaggagagccggcaaagaagagggcgcggaaaccaccgtcggccgtgtgcaactacgaggtagccgaagatccgagctacgtgcgcgagcacggcgtgcccattcacgccgacaagtactttgagcaggttctcaaggctgtaaccaacgtgctgtcgcccgtctttcccggcggcgaaaccgcgcgcaaggacaagtttttgcacatggtgctgccgcggcgcttgcacttggagccggcttttctgccgtacagtgtcaaggcgcacgaatgctgttgagaaacagcggcggcggtggtgactggggacggtgatgatgctgctgagactgagactggtggtgagagtagtggtggggctgcgtcgcctgcgacggcgggtggagatgaggcggcgtggactgggacgaggaggaggggccgcagccgttggtggaaactacgtgcaacggcgacgcggttaagggagaccgtatcgcgtaggacgacgtggcctcctcgtataggttgctgccgctggactgacacagctcctgaatgagctctttgtagcgctcaaaggactcgctcacgtcgttgggaatgtccatctcgtcaatcttgcgttgcaaaatagtcacgtcgatcttgacgctgctggccgagacggcgtgacacagcacgctgataacgacgtggtcgcgcacgatgttgagcgtgacgctgtagtcttcgcgcgccgccgtgagcatctgcgtgatgcagtcgcaggggatgtgcacgtcggggttttcgaagatgacgtgcatgtgcaaccggccgtcctcggcgtgcataaagggcacgatgtcgtggttggcggcgtgcagcaggtaataaatttggaagatgggcggctggttggtggagagcttgagtagctcgctgctcttacagaacccgtaataaaagtttctatttttcatgatgttggacgtctgattgatgaaggccaccatggcgtcggaggcggtgggcaggatgcggttgtcctcgcacgaggtgcaggcgatgcgcgagacctgctcgttgccgtacggcgagatgtcgaggcaggtgtgctgccggtgcgagtggaaattgaagggtaagcagatggactctttgcccgtgatggccatcttcatcatgttgaggtacttgagctccagttcggggtgctcgcggaagatgtcgtgcaggtcgtgcagcgtgaggcgcgggcgcgcgtcggccggcgacggcggttcgccgtggttgttggccgacgtagcgccgttcaccgtcgacgccactttgctggccagttcgcgttggcggcgcttgcggagcagggagcgcaaggccgagcgtcgttcgcgcggcgtgcgcacgccgctcacgctagacatacttgtctatcacgtacgtggggtccaccagcttgatgtcgcaactctccaacagctgcgtgaaatcgcgcataaagtccgccaggtgcactttgcctttgtaggtgcgttttgtaatctgaaaggccttgaagagtgtgatgcagagccacacacgtcgcggaagtcgacttatatagtaattgtcgtgacagatggccagtttcacctcctggacgtggtgggggtgcaggcgtccgaagagcacggcctcgttggtgacgcggatgttgccggcgcactgcgggtcgcagaaaaagtgcttgtagatgcccgtgacgcctgcctgacgcaggacgtggcaaaataccgggtcgggtcgcgccagtgcgccgtcgacgccgctcaggccgtggtagtccgagtcgcctccgggcgaggtgggtgcttcgagtccacagcgcgccacgtcctcgtgtgccgcgccgagcggcgacgtgcattcgcgcaacagatcggccaataccagctgaatgcggtccaccatcttcacattgttctgacaatacgagacgacgcggcggtacagctcgcgcaggacgacgttatcgtaataggagcaggccatgagttcgcacagcagacacacggtactggtttggttcttggtaaaaaaagcgggtacgggacataggtaaatgggacccacgtttttttttagcgtgctctcgctgaaccccccgctggtgccaccgccgttgtgacggcccggatcgtctcctcctttttctccttcttcatcctcctcttcttctatcatcatccttgcgtcttctctttccgaggccgtggataacgcgtctagtcgcgcgaacttagtgtgcgtgagttccgtgagtggcgtggtgctcatgacgccggtgccggcccacatatagaaaagcagctgcacgaagcggtcgcggctaggtgagctgtgttctagaaagttgtcgatcagttcttgcggcacttcgacgtgataagggttggttttttgcttctgttgcgggtggcgccgaggcttgttgtaaggcaccgtgtcttcgcccatgaccatggcccgcaccacggccagatgattcagggtgacattctcgttatcaaccgcgtcgcccacttgtttttcaaagcaacgatttatgaagaagtgcaggtggaaatcgaagaccgtgagaacgtggtgtcggaacaggtcgtcgatgcgcagatcggaaaagtgctgctgcagcagatgcgtaaactcggacatgatgatgagcgtgctgagcgctgcacggggcgcgtaactgcatttgaagcacagcaagctgtactcgaggagccagctctggtcgcagtcttgtttgaggcagatgctgatgatggcgcataggttacagcgcgtgtcgatggccagcggcgcgcacagtcgccgcagttgttcaaagtcggccgccgaggtttcgaggccggccagttctgcatctaggtcgcaggcggccgaagcgccggcgggtcctgcgttgctactgccggcgacggctccgccgcagttagtggtgttggtcgcattggtgagtacggtggattgcgtgccgccgcacgtggtttcttccgcacagcagttgagcagttcgtctacctccgaggtgccgaggctgagcgtctggaattcgtaatgacggtaacggttggcggggtgttgaggattcacctggtatgaggcggccgccgcggcggccagcgcttcgtccataggtacttgacgtgggtgcgcgtgccatagcagctcagttgtcaagtccgagtgccactgggtgtactcggtgctccagccgctgtaacgtgaaacggcctgtcgttgcggactgcacaaggtagcggcggcgacggagctggtggacggggccgggctggtcgggggaagaaacgtggtgtggggcccgtgagggggagtcgttgggccgttactgctcacgtgggtactcggattcatggcgatcggcgccgctgattgaggacgcggaaaaagaatgtcctgggctaagcagcgggtgccgtttctggacgatgacgacggagaggaggaaaacgacgtgcaggatgacgtggattctccggtgccgacgcgaccactggtgatcgacgaggacgcggagcccgcggctggtacgagcggtgggctcgaggggggaggtggtgacgacgaggacggtgaagacgggcacgcgctacccgatcttgacgacgatctgctattacagttcgagccgatgctgccgcgcgtctacgatctgttgctgccctctctggacgcgcgcttaaatttcgtgaacgcgggtcagaagtacgccgccttcctcaagtacgtgcacggcgactgcgcgacctgcagtcacggagagatcctccgcgagaagacgcaactattaacggcgatcgtcagcaagctcatggacattaacggaatcctggagggaaaagacgagccggcgccgggtaaataaatcggcggtggcgtcggtgcgatggagatgaacaaggttctccatcaggatctggtgcaggccacgcggcgtatcctcaagttgggtcccagcgagctgcgcgtcaccgacgccggcctcatctgtaaaaaccccaattactcggtgtgcgacgccatgctcaagacagacacggtctattgtgtcgagtatctgctcagctactgggagagccgcacagaccacgtgccttgttttatctttaaaaacactggctgtgccgtctccctctgctgttttgtgcgagcgcccgtcaagctcgtctcgccggcgcgccacgtaggtgagttcaatgtgcttaaggtgaacgagtcgctcatcgtcacgctcaaggacatcgaggagatcaagccctcggcctacggagtgctgacgaagtgcgtggtgcgcaaatccaattcggcgtcggtcttcaacatcgagctcatcgccttcggacccgaaaacgagggcgagtacgagaatctgctgcgcgagctgtacgccaagaaagccgcgtcgacgtcgttggcggtccggaaccacgtcaccgtaagcagtcacagcggcagcggtccgtccctgtggcgcgcccgcatgtcggccgcgctcacgcgaacggcgggaaagcggtcctctcggaccgcatctccccctcctcctcctcctcgtcatccgagttgctctcccaccatggtcgccgctggcggcgccgctgccgggcctcggccgccgccgccacccatggcggcggggtcgtggcggctgtgtcgttgtgaggcctgtatgggacgatgcggatgcgcaagcgagggagacgctgatgaagaggaggaggagttgctggctctggcgggagaagggaaggcggcagcggcagcggcgggccaggatgtcggagggtccgcgcgtcggcctctggaggagcacgtgagtcgtcggcgaggggtgtcgacccatcaccgtcatccgccgtctccgccgtgcgcgccgtccttggagcggactggttatcgttgggcaccgtcatcgtggtggcgagcgcgctccgggccatcgcgaccgcagtctgggccgtggctgcccgcgcgctttgcgactctgggcccgctggtgctggctctcctgctggtgctggctctgctgtggcgcggtcatggccaatcgccgtctccgacacgctccgcacaccgcgactgaggagttccaccaggctctgcgccgtctcttcgcgcccctctgcgttcacgaggaccatttccatgtgcagctggtgatcggccgcggtgcgctgcagccggaggaagcggcggtagaaacgtcgcagccaccggcgcagtttgcggcgcagacgtcggcggtcctccagcagcagctggtgcatcacgtgccacgttcttgcgtccttcatctcttcgtgacggataagcgctttctgaatcgcgagctgggcgaccgtctctaccaacgcttcctgcgcgaatggctggtgtgtcggcaggccgagcgggaggcggtgacggcgctttttcagcgtatggttatgaccaagccctactttgtgtttctcgcttacgtctacagcatggactgtctgcacaccgtggccgtccgcacgatggcctttctgcgtttcgaacgctacgacaccgactacctgctgcgccgtctgcggctctacccgcccgagcggctgcacgcgttgttggacggtgtcacctcctcgctgctaggtgaccttcaccgattccttttcggggtggaccttcggctgcccgtgcttcaccccaccagctcgccgtgcctagcactactacgcgccaagcgcttcgacgcccgcgctgatttggccgtataccaccgtaaccagtggtgtcaccaacggcagccgcggtcgccgcagctgcggggcctcatcgcagccttgcgccggcacgccgggaaggtaccctgcggaaacccgctctacgtactggcccgacaagcggtgcagacgttttgcgacacgtgtccgcgatacctggtgccgttgcgggcactgggtctgcacgacgagacgcgcggaggaggctcgacggcggcagctgcggcggtaggacacgcgggcgccggacagcaggcgcgtcacgtagagcccaccaagatcgtcctctttgcactcagcgccgcgctgcgcggcggcctcatcggcagcgtcatcgacctgccgctctggtgtctgtgtcgactcaagtgcgagcgccatctggacgcgcgctcgctggtggccgtggtctgtcggcagtgcggacactgcctcaacctgggtaaggaaaagctacactgccagcaaaactttccgctcaactcgatgttctattatcgggaccgtcaagaaaagagcgtcatcttcaacacgcacgccgagctcgtgcactgctcgctctgcggcagtcagcgggtggtgcggcagcgcgtctacgagctcgtctccgagacgctctttggacagcgctgcgtacgcgtgggctggaaagccgtgctgggcctcaacgcggcttgtgccgtgtacgatcaccggctggctttcgacgtcattctgccctgcgcggcacgcacctgcgactccactgtggtggtacgcggcgtgacggtcccgcgtctcctgcgcctcacttcgcacgggcacggcctgctgtgcgcgcgctgtcagacgggcgagtaccgcgacagctgtttggaaagcgaagacggcgccccgctgtgtcggggctgcgcgctggttaaacagaccgcctgccacgtcggcggccacattgtgcagcaggcgcgcggcggtttagcagcgacttcctcctcgtcctccccccacggcctgccccatgtctaacaccgcgccgggacccacggtggccaacaagcgggacgaaaaacaccgtcacgtcgtcaacgtcgttttggagctgccgaccgagatctcagaggccacccacccggtgttggccaccatgctgagcaagtacacgcgcatgtccagcctgtttaacgacaagtgcgcctttaagctggacctgttgcgcatggtagccgtgtcgcgcacccggcgctgacagcccaaggggaaaaagaatagcaagaataaatcaccgtgaaagtgatacgttgttttgtaacataaaaaacgataaaaatcctattgtttttattacccgctactgtcagtgtcggttacaaaagatagagaaaccgcatgtgttgaatagtgtcctgtacggattgcgccagttgtcgcaggtccaatcgcactagccgcagtatttctagagcactgaggacgttctgcgtgagcaccgtgataggcggcgaggcgaaactggtgctggcggcgccgggcgccacggccacaagttcatctcggcatagtggtgtttctcccaatcggttttcttgaaagacggacccgccaaaggcggtagagactaatgcagagtcggctgtccttgatgtatcgtcttgtacgtgatctatctgtccgtcgtcgtctgcggccgcggccgctcgatgacgatgtcggcgcggcggctgctgaactcgcgcgatgggtggcgggttttcacgcagaaactgaatattgactggcacgcggttgaaaggtaccggcggtgtcggagcggcgccagacgcagcgacgttgtccgcggatgagttatcatcttggtcatacagcgggaaggtggggaaggcctcgtccaacaccagccgactgtggtcctgttcgaacgtggagggcggtcgcagcacgcgtacgacggtgtggtcctgtgcgttgtaaatgactaggggaataaactctaagcgggtggggaaacgcaggtaatcgcgtagccgtctgatttgggcttgtagccagcagtgctccagcggcgtttcggtccacgtgtcctggagcagttgactgagattgagatcccgggagcgttggatgcggaggaagtcgcggtctcgcgacgtgtattcgaggtggcgcgctactagtatacgttgacctttcagcaggtcggctacatgcacgccgagacacacgggtatgccgaaaagccaggagcccagcgcgtagtctagggcggtttctgtttgaataaaaacatctaaaagtcccggctccgtggtcgtgtttgtgtctgtggtggttgtgtcctgacgtcgcacgcggatcatctgaagcaccggctctccagtggggagctgcggttgcgtgtacccctcggtcaccatttcgcattgttgcgtgaaaatctgaaacaacgtctgtaccaattcggacaccgaggcgtatgtctcggcgtactggggtttcagttctagccacagacactgcagcatgtcttgtggaaagaccagcgtggccatggcgtagagccatagcttgcctaagggcggtgtgcttttttgcgggcctacctggcacagttgctgtaccagtttattttcccaaaacagtttattgagctgcatggcgggccattgggtgggggtgatacagaaggccttgacctgttcggggaggtggtcggggggcattttgtgtgtgttattgactaccgcgtgtatcacatcctgatgtaggtgagctgtgagggagggtagtgacatttgcaccgggtacttgaggacggtgtagatgtactctgggtacagagctgctatgagtacacaaaactcttgcagacttaggcgcagcacggtaccgcggcccggtctctgttcccctacgtcaccaccctcgccgcttcctacgcgatcggcggccgtcagctcctgctgcgtgtcgatgcgctggtgccaggcggtgctcaccagataacaaaagagcttaaggttatgcaacgtgtgagtctccgcggggtgtgtgtggctctgatgctgcgtgaggtagggtcgtaggtcgtactgcgagatctgcggccagaaagtgcgcaatgtctgacagacggccacggctaccgtgatggctttataacgtgtggtgacgacgttcttgagtcctccgccgctacagcggcgccgccatgccaggggtcggccatcgtctcgcagcgccaagtacttaaaggctacgttgccgtaatcggtgaccaggtgaatgggctcgccggcctgcgtgacgatttgccgcatgccgaagacgtctaccacttcaaggaaggtgtcgtggtgacgcgcgaagcatagacgacgcaggcggtcgcgcatgatcagcgcggggtcggtctcgtgtgttggcggaagcacgctaggaatgtcttccagcctatagactagcgatgagccgttgagcttgttgagcagatactggtgacccagctggacgtgtcgttccagtgcgttcaacccgcgtgtaaaggcgcccagcgaagtcgtcgcctgcggtttccgtgggttgggcagggctccctcgttggagagacgtgtaccgcgttgcttggccagttccgcaaaacgagtccgcaggtcgcggatcttttccaactgcgaccgaaagtccagcccgtagctgaaggtctggatgccgtgtaacagcgcaaagtattccgtcgccaacgtttcctgcagttctaggtcgcctagcgtctgacccaagcgctgcaacagttcctgcactttttgatgacgcgcggcgccgccggctacgcgtccgggttccagtcgctgccagaccgcttccaccgcctggaccatgtcgacccgcggcgtggacgcgccgttggcagttgcctcttgatgctgtgcaataaaattttcacaggccgcgttttgttcgatttgatgcgctagcgtcacggcgctctcgacagcttgctgttgcaggttccggtagtgggtcctgcttccgtgatgcgggtgcgtagggtccgtggtgatttgcgcaagggcttcctccagaaaggccagcatccagcgcaccgtgcgctccgccgacaggtacggcagttgttgcgtggctttgcccaacagctcgcgaagtgtctccagcggcttttccatcagcgccttggcgtcgggggtggtcacgtccagtccgccgctcattttgtggcgcgtgaccagatcagtccacaggttctgcgccgtgctcagctgctcgtcgcgttgtcgcaactgcgtctgtactttctgattcagcagatcggcctcgtcgctgagcgctttccgggccgcgtcggcctgctgatctagcagcgttttgaagacgggccgctggaagtcggcgggcgggggcgtgattcgacccgccagctcctgacccttgaagggtttctcgggtacacgcgtgacggagctgctcccgggatcctggcgcagcgagcgatccagccgctcgctagtctcggtcatctgttgtctagtctcttgtaactgtccctccatcttctgttgactgctgcggtagcgtacaaagtcgccctcgaactcgctgcccgtgatggctgtagttggatcgccctgttgacacttctcgatgaactgcgcttgatggacggcgtgttgcagggcttgctgcgtctcatggatcaggagttgcggacccaaaatttggtccaagtggtttagcgaggcttgggtttgcatagccgcttctcggtgcgggtgacagcgccgctccacatcacccgtcagcacgccgtgcagacactcgttgattcgcccgtctagttttttgctcagctgctgcagcgccgacagcaagtcctggttgaacttgtccagtagcggttgggcgcgttgatctaggcccaagagcagctcgagtgtggcctccagtggttggtgcgggatagtggagagcatctcgcccttaacggcgtccaccacgcgttgcaaatcctgctgcacctttttttggtagccgtccagtagctgccgttgctgttcttcctgtttacgtttctccttgtctaaaaagtcttgcatcttggtggttaacgtttgttgcatttgatgcatgacacgatggctcggtgcccgggccaagacacgctgtacgtcctccacagaagttaccgtgagcttgccggcctcttcttgccattcacgttctagccgttccaggtgctgttcttccatctcgtgttgataccgctcatagagttccgtcacctgaggtccgacgcccagtcgtccgaccatatgttgaaagaaatattcatggttacggaaaaagtaaaccaactctcgtaacgcttggaagcgtttttcggatgcgccggtaccggctttctcgatctgctccagtttcttgaccatctgcgcgtacgtggcgttggcggcacgcagatcctcacgttcatgcgagtcgggtggcagttgctgcaacaacagactgacggcgtcaaaaaacgtcggtcgcggcgactcgtcgcgcgccagtcgcatcactaatgtgtggaacatgctcagtacggcgttgatgagtcgcagacgcgtctgttcgtcgcgacgtaacatctcgcgtaattgtgggtgtcgcttgatggtctgttcggtgggcggatcgtcgtacgaaagtccgtcgaggaaacgctgcgtttcctcttcctcttcgtagaggcggcttagcgcgagttgcgcgttctgtaggcgctgctgcacttcgggtagctgcaggccgcctagtgcttccagctgcgctagctgctcctgtaccaaggccagtgtgagcgccgagccgcggctgcccggatcgcgcaccagcgtctcgatgacatgaagcaggtcgtggatctgcgtgaggcgaccctcgttttgctgcgtggcttgctggtacgcgtgtcgcagctgcaggatctcttgcagtagcggtacgttgtcgcgcacggtgcccgtcatgaggtagctcagttgttcgcgtatgacgacgaagccctcttcgtagctgccgtcacacagtttcaggtcgcgcaggtcgtaaaagagtctcagtacctgctcgacgacgcgttccatctgcttcaggtcctctaccggcaaaaagccgttgagaatgtgattgtgcacgcgcgtcagcagctgcgtgctcagacggtccaggtccatctgcaactctagcattttggcgttgcccaggcgaaagagttcctgcttggcgttgtcgtccaacggctgcagcgctttcagaatttcgcgtcggttcaggtcgctggcgtccaggtcgtgaatgtcgatgctggtgatgagaccggccaagtgctcgtaaacgccgtggtactcttcgcgttgacgttgcaacacccgacgtcgctgttcgatgacctgcgtcagacgctgaaagtctacgggtcgcaggcagatgaagctgtcgctaacaggcatcggtcgcttggttacgaaacgttgcagtcgttgagatagttcgttagtgggtttgctctccacgtagcgcagcatctcctccacccaggcgatgagcgccgggccatgctggcgtccgtagggatcgaagacgacttgcatcttctccagcagcgcgcgatccagcatcgagtacgtgtctttggtggtcttgtggctcaggtagtcgtgcatgcgccgcagatccaggccgtggtgcagccagttgagcagaaaggcatccagtttcttggataggcccagataggcgcgtaccgcctgttgcgccgccgattgcgggccgcaggggcgacgcagacacgagcgttgattgacggcatggatgatgagctgctggagacgatcggtgaggaaagcttcgtcgaaggacggcgccgtggccgttgccgcgttagcgccgttttcggtacccgccgcgtgcaacgtccaggcgctggtgttggcaggcaacggcggcagcgtcagagccttcaactcctgctctacctcgtcgaccagctgttggtagcggcccagggccggcagggccccttcgccgcagctgtaggacggtggtaccgtggacgaagaagaggccgccgctatcgctgagggggaggaggaggaggcggtggccagtgttttggacgtcgtggacgggggtttctttttgcctccgtgtttgctaccgctgaggtccttgcggcgtttctcgggtgtttttttgggtgaggacgagggatcgtagacgggaatgctgggcgccacgccaggagggcagcccgggtcgacgatggggtcgggcagcggaggtaaggaaggtgcggcggtggtcgttgtcgccgccgtgtccacgctttctcggacgacgccggtgaggtcgatatcgcggtcgcgataggtggagaccaaacgcgcggcgatctcagcctctggtacggtcgccacatccagcatgtagagaaaaagggcctcatagtagaaagcgggcgatagctgcacgccgaagcccgtgagcaccatcagcacctgatggagaccctcgcagtgatacacggcggcattgtgacattccgcggagctgtgcggatcaaagaccaacatgtggtcctcggtgaagaccacggcgcgcgccgacgagttgacggtgacgagtacgtaggtgggacgcggtttggcgtgcgcgtaccgcagaaagtcgaagatgcccggacacatgtagccgtccaggtcgcacgtctcggtggtgccgttgaagggccgcgagagcgcgtgcacggtccggccaaaccgcgactccaggcggcgcggcacttcgtcgcccagtcggtagaccggcagccgcccgccggcgggcagcttcttttgcaactcgcgctctagccgcgcgtccagacgcgcgccctcttccatgatggcgtccagcgcctcggtctgcaggacggcgctcgttccacccaggtgcaaggcgtgtaggaacatgatgccgttgcagacgcattgattgcccgctcgcgctccaaagcgggcgatgtcgccctggtggcagctggcctgcgtgactttcatggcgaggccggcggcagggacaccgatgtcgagccggcgggcgggtcgatcgaagacaagatgtcctgctgcgcctggcttacggggacgatgtaccagtttaataggtcgctcgcggccaggtgtgtgggttcgtagcgcgcacccaggacctccggtacggacgtcgcgcccgccgtcgattcttcgtgatcggtgtcgggcgtcatgcggagtcgcggcggttggggcgccgattcccagggcgcctccaagaactcgcgtaaggcgcgatccgcctcggccgccgccgcaacgcccgtgcccgcgggccaggtcatcggcgctagcgcgcgatgtcggtgcagcaggctcgtcgcctccgtcagacagagctgtgcgccgcggcgttccaagttctcgcgacttagtacgtcaaagacggctagcgcgcgctgcaccgcggtaacgacggcgccattggaacgttgcgcctgctcgagcgccaaggtcacgcgcgtttccaacactttgattttggaggccgtctttttgagcgccttgctcatctgggccaccgtgcggtgacccttggcgtgtcggcttacttcctctgtgtcgctgctgatctgacgtacgcgcacgcgaacactcagcaggcgctcgttcaagccgcgcagattctcggccaacagccgatcgcggcgaaccagctcgcgcaactgttctacgaaacgcgtggttggtacgcgcagtccgtactgaccctgtacctccacgtacaccgtcacgccgtcctccgagaggcgcgcccggccgcgcgccagaccgaaacaaagtcgcgtgtgtcgcagatagtttctcagactgccggcgctgctgcgcatcacgtcctcgatcagcgggttgacggtggtgtacaggttatgcgctacggagcgcgccatgagctcggccagcaggtccacattgggcgtgacgggtacaccgctgaggtgctcgagggtcgtggcgatgtcgaagacgcaatcgcgtaccgtcttaaaaaccgcggcgtcgatgtgcttgacaaaggtggtcaggttgtagatggagaccaggttctggtacagcgtcacctgctcgggcaacaatacacgacacagctgaatgagcgcgaaaagacgcggcgaacccacggcttgaaacaggccctgcgggataccaaagatctccgaaaattcagttaccaccaccaactgcgcgaagatgctggggaactcgggatgatggctgaaggctagcagggaggcgtagttgacgcggccttcgttcagattaacgagcgcgcattcgcgtaagatgtcggagcgtgtgacgccgtcaagcggaggcaaaggcgaggccgcgccggccgcgccgcgagacggacgcaaggtaaacaggtgcacgccccacttgctgtgcaggtcccgatacaggtactcgcgctccgcctccgtggcacccttcgtatgtgcctcaaagtcttcttccgtgtactgaaccgcaaagtgcgtattgacgttcagtgtcacgttgctccagacgtgctgtagttcctccttggagccgatcaacgtggatcgatgctgctccaaaatcaaccgccgccggtggtcgaacaggaacgtggggctgtacacatagaggcacatgaaaaacgtgtaaaaattgtagatgatctgtatgagtttctcgcgaatctcgctgacaaagagcgagctcttctgactggccggctggatcagcgccatttgtgcgtaggccgcgcaggtatcgtgattgaaacccagttccaccagtcgcgttaccatctgtgtcagatccagtagccgctgcacgcgtcgcggcgtatgcaagtggtcttccagcacgcgatcgcacacgcgcgcgtaagcgtctaggttggcgcgcggcgaaacttcctcactcaatagacgcgagatcagacccgggtggaaaaacatacgttcgggcgacaggtaaaggttcacggtggagatgcgcgtgctaatgatgggaaacatgaggccgctggcgtcacgcgcctgcagattacccacgaacagtttgtagctgacgtcacgcatgtgttcggcaccgggcttctggtcgccgtcgatatcggaactgacgaaagagctcatgtgccgcacgctgttcttgacgtagttttgaaactccacggccaaatcgccgttaaccgaacggtagtgtgtgtaaaaaaaatgcatcagaagcaccgtgtccagttcggtgtcggtgtcgcgccgaaacaacacgtagggcatgagcgtgcaggcccagtagatgagccgctggtaggtcaggtccaggagttcggccacggcgcgacaattgacgtagggccgcgcctccgtgacagccgtttccagctgcgtgatcacccggcggaccagcggctgctggcccccggaactcgaaccgcccttcttgccgcggcgctcagccgacgcgttgttactggcgatcaagtccgccgccgccgcggcgccgccgctctgttcggctattacggtctggatctcgcgcagggtctgcaacagcttctggaaagccgtcagcgtggccccgttgtggtagaacggcaaccggtcctcgtccccgccgccgtcgtgctggtgtcgtaggaagcggtccagctgttcgtgcaactgctcggcggcgtacagtgggtcgcgcgccgtctgtaccgtggcgtggcttaggaggtaaaagaccacgttctgacgcacgaagccaaagtggtagcccgagctcggcaacgcacccacgaaggcgcgcacggcgctcgcggtcacgtcctgggcatccaccgcgccgatctccaattggctcacggtatttaacgcctccgctttgtccgtggcccgtgcccgcagctgctctatcaactttttgaaatctaccgtgcgcctcgccatcatggacgcgcgcgcggtggccaaacggccgcgcgacccggccgacgaggacaatgaactagtgacggcgctcaaagccaaacgcgaggtaaatactatatcggtgcgctacctctaccacgccgatcaccaggcgctcacggcgcgtttcttcgtgcccgagggcctggtagagttcgaggcgcagccgggcgcgctgctcatccgcatggagacgggttgcgactcgccgcgacacctctacatcagcctctacctgttaggcattcgcgcctccaacgtctcggccagcacgcgctgcctgctcgaaagcgtgtacacggcctcggccgcgcgcgccgcgctgcagtggctggacctgggcccgcatctgctgcaccgccgcctcgagacgctgggctgcgtcaagaccgtctcgctgggcatcacctcgttgctcacctgcgtcatgcgcggctacctttacaacacgctcaaaacggaggtgttcgcgttgatgataccgaaagacatgtacctgacgtgggaagagacccggggacggctgcaatacgtgtatttaatcatcgtctatgactatgacgggcccgaaacacgtcccggcatctacgtgctcacctccagcatcgcacactggcagaccctggtcgacgttgcacgcggaaagttcgcccgcgagcgctgtagctttgtcaaccgtcgcatcacgcgcccgcgccagatccctctgtgtaccggggtcatacaaaagctgggctggtgcctggctgacgacattcacacctcgttcctggtacacaaagaactcaaactgtccgtcgtccgtttggacaactttagcgtcgaattgggagactttcgagaattcgtctgagcggcgctgacagcatacggggaggagacacagaagaaaaaaataaacacatcgcacacagactttataaaccgtagttatcggcgccatctagactcactttattgaaatctacctgatttctttgttattttcctcgtaaacttatgaatccggctgacgcggacgaggaacagcgggtgtcctcggtgcccgcacatcggtgccggccaggtaggattccaagccgcggctcggaaaccgagacggaggaatcgtcggcagaggccgccgctgatactaccgggggagatgacagcgagctcgaggaggggccgctgcccgggggtgacaaggaagcgtccgctggaaataccaacgtatcgagcggcgtagcgtgtgtagcgggctttacgagtggtggcggcgtcgtcagttggcgtcccgagtcgccgtctcccgacggcacgccgtctgtgctgtcgttgacgcgtgacagcggtcccgccgtgcccagtcgcggtggacgcgtgagtagcggtctgagcaccttcaatccggccggcgcgaccagaatggagctggacagtgttgaggaggaggacgatttcggagcttcgctctgcaaagtgtcgccgccgatacaggctacgcgcatgttgatgggcaaaaagtgtcattgtcacggctattggggcaagtttcgcttttgcggcgtacaggagccggcgcgggagctgccgtccgacaggaacgcgctgtggcgcgagatggacaccgtgtcgcggcacagtgccggtttgggcagtttcaggctgtttcagctcatcatgcgccacggtccctgtctgattcgtcactcgccgcgttgcgatctgctgttgggtcgcttttatttcaaagccaactgggcgcgtgaaagccgcacgccactgtgttacgcttcggagctgtgcgatgagtcggtgcgtcgttttgtgctgcgtcacatggaggatctacccaagctggccgaggagacggcgcgttttgtggaattggctggttgctggggtttgtacgcggccattttgtgtttggataaggtgtgccgccaactgcacggacaggacgagagcccgggcggcgtgtttttgcgcatcgccgtggcgttgacggccgctatcgagaacagtaggcactcgcgtatctatcgtttccatttggatgcgcgtttcgagggcgaggtgttggaatcggtgttgaagcgctgtcgcgatgggcagctgtcgctgtccaccttcaccatgtctaccgtgggttttgatcgcgtgccgcagtatgactttctgatctcggccgaccctttttcgcgtgacgccagttgggcggccatgtgcaaatggatgagcaccttgagttgcggtgtttctgtgtcggtgaacgtaacgcgacttaacgccgatgtgaacagcgtgattcgttgcctggggggatactgcgatttgatacgcgagaaggaggtgcatcgacccgtggtacgtgtgtttgtggacatgtgggacgtggccgctatccgcgtgattaactttattctcaaagaaagcacgtcggagttgacgggggtttgctacgctttcaacgtgcctagcgtgttaatgaagcgctaccgtgcgcgtgagcagcgctactcgctgttcgggcggcctgtctcccggcggctctcggacctgggtcaggagtcggctttcgagaaagaatattcgcgctgcgagcaatcgtgccccaaggtggtggtgaacacggacgattttctgaaaaagatgttgctgtgcgcgctcaagggccgtgcctcggtggtctttgtccatcacgtagtcaagtactcgattatggccgacagcgtgtgcctgccgccgtgcttgagtcccgatatggcgtcgtgccactttggcgagtgtgacatgccggtgcagcggctgacggtgaacgtggctcgctgcgtgtttgcgcgtagcgacgagcagaagctgcatctacccgacgtggttttggggaacacgcgacgttactttgatttgagcgtgctgcgcgagttggtgaccgaggcggtggtttggggcaacgcgcgcctggacgcgctaatgtcagcgtcggaatggtgggtagagagcgcgctggaaaaactgcgtccgctgcacatcggcgtggccggcttgcacacggcgctcatgcggttagggttcacgtactttgcctcttgggacttgatcgagcgcatctttgagcacatgtactttgccgcggtgcgcgctagcgtcgatttgtgcaagtcgggtttgccgcgctgcgagtggttcgaacgcaccatctatcaagagggcaaattcattttcgaattgtatcggttgccgcggctctctatcgccagcgcgcgctgggaagcgctgcgcgccgacatgctcgagttcggattgcgcaactgtcagtttctggcggtgggtcccgacgacgaggtggcgcatctgtggggcgtgacgccgtcagtgtgggcttcgcgcggcaccgtgttcgaggaggagacggtgtggtcattgtgcccgcccaaccgtgagtgttacttccccaccgtggtgcggaggccgctgcgcgtgcccgtggtgaattacgcgtggttggagcagcaccaggaggagggcaaggcgacgcagtgtctgttccaggcggcgccggcgatccaaaacgacgtggaaatggcggctgtgaacctgagcgtgtttgtggaccagtgcgtggccctggttttctactatgactcggggatgacgcccgacgtgcttctggccaggatgctcaagtggtaccactggcgctttaaggtcggagtatataagtactgtgcctcttagtcgggggcccgctggctcggcgcggctgtattattagacgccgggcgtcttcgcagcgttcccggtcgtcgtgtgtgctctctataaaactttcgctcgctcgcgcccgctccttagtcgagacttgcacgctgtccgggatggatcgcaagacgcgcctctcggagccgccgacgctggcgctgcggctgaagccgtacaagacggctatccagcagctgcgatctgtgatccgtgcgctcaaggagaacaccacggttaccttcttgcccacgccgtcgcttatcttgcaaacggtacgcagtcactgcgtgtcaaaaatcacttttaacagctcatgcctctacatcactgacaagtcgtttcagcccaagaccattaacaattccacgccgctgctcggtaatttcatgtacctgacttccagcaaggacctgaccaagttctacgtgcaggacatctcggacctttcggccaagatctccatgtgcgcgcccgatttcaatatggagttcagctcggcctgcgtgcacggccaagacattgtgcgcgaaagcgagaattcggccgtgcacgtggatctagatttcggcgtggtggccgacctgcttaagtggatcgggccgcatacccgcgtcaagcgtaacgttaaaaaagcgccctgccctacgggcaccgtgcagattctggtgcacgccggtccaccggccatcaagtttatcctgaccaacggcagcgagctggaattcacggccaataaccgcgtcagtttccacggcgtaaaaaacatgcgtatcaacgtgcagctgaagaacttctatcagacgctgctcaattgcgccgtcaccaaactgccgtgcacgttgcgtatagttacggagcacgacacgctgttgtacgtggccagtcgcaacggtctgttcgccgtggagaattttctcaccgaggaacctttccagcgtggcgatcccttcgataaaaattacgtcgggaacagcggcaagtcgcgtggcggcggcggtggtggcggcagcctctcttcgctggccaatgccggcggtctgcacgacgacggcccgggtctggataatgatctcatgaacgagcccatgggtctcggcggtctgggaggaggtggcggcggtggcggcaagaagcacgaccgcggtggtggcggtggttccggtacgcggaaaatgagcagcggtggcggcggcggtgatcacgaccacggtctttcctccaaggaaaaatacgagcagcacaagatcaccagctacctgacgtccaaaggtggatcgggcggcggcggaggaggaggaggcggcggtttggatcgcaactccggcaattacttcaacgacgcgaaagaggagagcgacagcgaggattctgtaacgttcgagttcgtccctaacaccaagaagcaaaagtgcgggtagagcgtgggccgcgtgcctgggaacgcgcgcacggcgcggtcccgtgatggagaaaacgccggcggagacgacggcggtttcagctggcaacgtgccacgtgactcaattccgtgtataactaacgtgtccgcggacacccgcggccgtacccgtcccagcagaccagccaccgtccctcagcgacgtcccgcgcggatcggacactttaggcggcgcagcgccagccttagctttcttgactggccggacgacagcgtcacagagggcgttcggacgacctccgcgtcggtcgccgcctccgcggcccgtttcgacgaaatccggcggcgccgccagagcatcaacgacgagatgaaggaacgtacgctggaggacgcgctggctgtcgagctggtcaacgagaccttccgctgctctgtcaccgccgacgcccgcaaggacctgcagaagctggttcgtcgcgtcagcggcacggtgctgcgtctcagctggccgaacggttggtttttcacctactgcgacctgttacgcgtcggctactttggacatctcaatattaaaggtttggagaagaccttcctgtgctgcgacaagttcctgctgccggtgggcactgtgagtcgttgcgaagccatcggccgcccaccgctacccgtactcatcggcgagggcggccgcgtctacgtctactcgcccgtggtggaatcgctgtacctggtgtcgcggtccggtttccgcggcttcgtgcaggagggcctgcgcaactacgcgccgctgcgcgaagaactgggctatgttcgcttcgagaccggcggcgacgtgggtcgcgagttcatgttggcgcgcgacctgctggccctgtggcgcctgtgcatgaagcgcgagggttccatcttcagctggcgagacggtaatgaggcgctgacgacggtcgtcttgaacgggagccagacttacgaggatccggcccacggcaactggttaaaagagacgtgctcgctgaacgtgctgcaggtatttgtggtgcgggccgtgccggtggagtcgcagcagcgcctggacatctccatactggtgaacgagagcggcgccgtcttcggcgtgcatcccgagacgcggcaggcgcactttctggcgcgcggactcctgggcttctttcgcgtcgggttcttgcggttctgcaacaactactgcttcgcccgcgactgttttacccaccctgaaagcgtggcacccgcttaccgcgccaccggctgtcccagagaactgttttgccgtcgtttgcgcaaaaagaaggggctctttgctcgaaggtgagccgcggacgccgtcggtaccgtctccaccacagttaccaccgtcgccgtcactgccaccgacatggagcccacgccgatgctccgcgaccgggatcacgacgacgcgccccccacctacgagcaggccatgggtctgtgcccgacgacggtttccacgccaccgccgccaccacccgactgcagcccaccgccctatcgacccccgtactgcctggttagttcgccgtcgccgcgacacacgttcgacatggatatgatggaaatgcccgccaccatgcatcccaccacgggggcgtactttgacaacggctggaaatggacttttgctctcttagtggttgctatattagggatcattttcttggccgtggtgttcaccgtggtgattaaccgggacaattccactacaacgggtacatcatcggggtaacgggaaatagagcatgtgcttgactgtaccatcattgctgctacggaataataactacgctacgacctggcctgtggtgtgtgttgttttttgtgcacgcacgacatgacactcttttgccgcaccgccaacagcaccgccggctacgtcgacatgaacgtctgcatcggcatgatcggcgtggtttgtttcgttttcggggtctttattctcattttttgctccacgttgaaagctttctacgtgcggcaaaagacttaccacctcctgggtaccgagtcggacgacgaggagaccacggtttgggaaaagcgccggatggagtcggatacagacttttaaaagaagccataaaaatatgggaattcccctgcctacgtcttcatgacgggcgcctttttcttcgcctcgggctctgtctcgtcgtcattcgggccaggactttttaatggccaacagcctgtggcaccgcctccgaacgctcgtgagcaacagtcggcagaatgaacaaattcagcaacactcgtatcggcttcacttgcgcggttatggctccgcggactttagttctgacgcttggactcctgtgtatgaggatcaggagtttattgtcttctcctgccgagacgacggtaacaaccgccggcgcgatgtccgctcacggtccgcaatgtccgctcgtgttccagggttgggcgtacgccgtgtaccaccaaggcgacatggccctcatgacgctcgacgtgtactgctgccgccagacctccagcaacaccgtcgtcgcgttctcgcatcatcctgccgataacacgttgctgatcgaagtgggtaacaacacgcgccgccacgtagacggaatctcctgtcaggatcattttcgcgcgcaacaccaggaatgcccggcccagacggtgcacgtgcgcggcgtaaacgaaagcgcttttgggctcacccacctgcagtcctgttgcctgaacgagcattcacaactctcggagcgggtggcctatcatctgaagctgcggcccgccacgttcggtctggagacctgggccatgtacactgtgggcattctggccctgggctcgttctcctccttctattcccagatcgctaggagcctgggggttttacccaacgatcatcactacgccttgaaaaaggcttgataatgataattgcacatcctcacgagtgcccttacctatcatcacactaagaataaagaaaatcgatcggtgtcgtgacgtgtggtgtgtgtttttcactgttatcgggtaccagggaggaggggttaagaggtcacaggtgcgatttaccgtaaggagagtcacacttaagaaaaaggtggaaattcctcacccgtcctattcccgtcagccgtcagtgacgtgaatcgcccctcacgtcagtgttgtcccctatccgcgtgagttgggtggctcaccgtcaggtgctccgagacgcgtgtactcggaaactgcgtcaatgcggtcggtcagccgaccctttgatgtagtacatcgcgtgcgaagatgaaaaacatcttaagaaaccgggtcgcctaaggggaaaaccccacgtgtcttgggcgcgtcatgtccggcatcttcatgtatataagacggtgtttcaagacgacgtgagacccacacgcgggtttcacttctttctttaattatgtctccagtctacgtgaatctgttaggtagcgtgggcctgctggccttttggtactttagctaccgctggatccagcgaaaacgccttgaagatcctctcccgccttggttaagaaggaaaaaagcatgtgcgctcacccggcgttctcggcaccggttacgccgccaacatggcgtaattgacggtgagaactcggagaccgagcggtccgtggacttggtggccgcgctcttggccgaggccggggaggagagcgtaacggaggacacagagcgggaggacacggaggaggaaagggaggatgaagaagaagaaaacgaggctcggacgcccgaggtgaaccccatcgacgccgagggcctctcaggacttgcgcgagaagcctgcgaggccctcaaaaaggccctgcggaggcaccggttcctgtggcaacggcggcgacgagctcagctgctgcagcacaacggcccccagcagtctcaccagtaagcaggggtaaacaaaaaaaaccacagactccgggatagtataagaagggactttaccgctattgctgctattcatagagaaggatagaaaggatgactacggccacgcatagcaccgccgctatcatgagcctgctggacgaggccgagtggcgacagacgcagatggacgtggggggactgatccaggcgtcggcgttgggcaaggtggcgcttcgctacgcggtgaggaaactgatgaagcgcggagccaggctgcggcacgactcgggtctctacgtgtgcatctgcgacccctcttacgagtttctgcagatgaacctgagtaagatcagttggctggagcgacactgccccccgttggaccaggagctcatcatgttcggggtcatcgaggcctgggaggaagcttcgatgcggcccacgcgtcagctggtgttgttcatgacgcccaagtgggacgtgttcggctacgactccggtatcctgtttttcctggcgcccagcatggcgcagttctggcacggtgccatcgtgctggagtattggaacgctttgttcccggtggaggtgcgctcccacgtccgtcagcacgcgcacactatggacgacctggtgatggtcttccaccagctggactacgaaaagcaggtgctggaagcgcgtcgcgacaagaatacggaggggccgcgcacttttgccaagtcggtgaacagctacgtgcgcgccatcctggaatctgagcggcggatccgcgaagggaaaattcctatgaccttcgtggatcgcgactcgctgcgagccaattcgttggcccacatccaggccaccggggctcagccttctcacgccccggcgcaacgggtgctgtccgcgccgccgagcctgccgtcgcccgtgtcggaagaagaccccgctgccgccgccacccctccgtcctccgccgccaccacccccccgtcctctgtcgtcccggcctccgtcgagagcgagttgtcctcgtcgccgccgttgccgccggtcgtggtgaaggatgtgatgtacacggccggggagggcgacgtggtacagatggtggtcgtggtctagaaggagaactttgctgctagatgaccatgttcagctttttttttttgtagtattttttcatagttgctatacctcagttatcccccctattagccccacatgctgcttaataaacatacttgtttcattttctttctagtgccgcggttttttgtcgcgtccacgggctgcgcgggtttcaggtaaaaacaacgtgtgtgataaacgtgggtttttacctatgggaaaggggagggtgtaaacatgagtctccgtcaataaaaagtcccgtgtcgtccccacgtaggtgtctgtgtggctgttgttgacgctgttttggagcacgggatacggtgtttctgttcgatgtacgtaccacggtacggacattaacgtcacttccaacgccacgagtatgaactgcctgttaaactgcacgtgcaatcatacgcaaatctacaacggcccctgcgccggagccgaatccaaactgcccttgaacgtaacgtttcggcaatcacgtcggcagtggcacagcgtcatgctcacgtttggttttcagtaccacctggaaggctggtttcccctgcgcatcctgaacgagagccgcgatatcaacgtcaccgaggtctacggggaggttgcgtgttttacaaatgacactaatattaccatgggacagctgacgcttaaccttaccggccgcagttacgtattgcgagcactggcgcgcacgagtccgtttgagtcatccgtaaattgggaggaaaccaacgtcaccgacaacgtgacttcttcagaaaacaacaccgtcactgtgatgtcaatcttaacggtatatgcggaaagtgattatatttttctacaagacatgtgtccgcgatttctcaagaggagcgttaagcttacaaaaaacaataaaaaaaacacaacgtttacgggaactaacatgacatcgcttcccatgtggacatcggaatgcgaaggatggaggtattggactacgttatccatcatgtggaaaaaccgccgttcggctctgctccgagccaaaagtcgcgcgttgggacactgggcgttgttgagcatatgtactgtggcggcgggcagcatcgcgttgctcagcctcttttgcatcctcctcatcggacttcgtcgcgatttgcttgaagatttccgctacatttgtcgggacgagggaagttccagcacaaaaaacgacgttcatcggatcgtctgacgtcaacgctgatagtgtctataaaggccgtgccgccgcgccgtagttctccgaaggcggacggaggagtctgtcgaccgcagcggtggctggagaagcgcagcgtcggcgagcgaaggtagaggagtccgtcatggacgacctacgggacacgctgatggcctacggctgcatcgccatccgagccggggactttaacggtctcaacgactttctggagcaagaatgcggcacccggctgcacgtggcctggcccgaacgctgcttcatccagctccgttcgcgcagcgccctggggcccttcgtgggcaagatgggcaccgtctgttcgcaaggtaagccccacgtcgttgaagacacctggaaagaggacgttcgctcgggcacgttctttccaggtgttttcaacgtgcgtggatttttttctattatttctctaccaggtgcttacgtctgctgtcaggagtacctgcaccccttcggcttcgtcgagggtccgggctttatgcgctaccaactcatcgtgctcatcgggcagcgcggcggcgtttactgctacgatgacctgcgcgactgcgtctacgagctggcgcccaccatgaaggactttctgcggcatggctttcgtcactgcgaccacttccacactatgcgcgactaccagcggcccatggtgcagtacgacgactactggaacgccgtcatgctctatcgcggtgacgtggagagcctgtcggccgaggtgaccaagcggggctacgcttcctacaccatcgacgaccctttcgatgagtgtcccgacacccatttcgccttctggacccacaacacagaggttatgaagttcaaggaaacatccttcagcgtcatccgcgcaggcgggagcatccagaccatggagctcatgatccgtaccgtgccgcgcatcacctgttaccaccagttgttgggcgcgctgggccacgaggtgccagaacgcaaagagttcctcgtacgccagtatgtcttggtggacactttcggcgtcgtctacggctacgaccccgccatggacgccgtctaccgtttggccgaggacgtggttatgttcacctgcgtcatgggaaagaagggacaccgaaaccaccgtttcagcggccggcgtgaggccatcgtgcgtctggaaaagacacccacctgtcaacatcccaaaaaaacccctgaccccatgatcatgtttgacgaggatgacgacgacgagctgtcgctgcctcgaaacgtgatgacgcacgaggaggctgagagtcgcctgtacgacgccatcaccgagaacctgatgcactgcgtcaaactggtgacgacggactcgcccctggccacgcacctgtggccgcaggagcttcaggccctgtgtgacagcccagcactgtcgctgtgcaccgatgacgtggagggtgttcgccagaagctgcgagctcggacgggctcgttgcaccactttgaactctcctaccgctttcacgacgaggaccccgagacctacatgggcttcctctgggatatcccgtcctgcgaccgctgcgtgcgccgacggcgtttcaaggtgtgcgacgtcggtcgacggcatattattcccggcgccgccaacggcatgccgcccctcaccccgccacacgcctacatgaacaactgattaaggaggggatgacgagcacggtggtcccgtttgtctatgtgcatgtttttgtatataatacagcattttatataacctttccctgtcttttttactcgtaaactgtgtactccgctggtcaataaagaaaaccacactgttagaaaaccacgtcgacggtatttttattgatatcgacgtctcgtcctgagacagacacgtagaaaaagaggaaaaccgcgttcagagatgccgtagattttcggccagatcgtcccgcgggtcttcgacgtcgctgccgtagctagtgctcggcatgctgtcgggtccctggaagcgtgtgtgggccggccctcggggtgcgggtggcgggctgcgtcgtcttcggtgacgtcggtggtggctgtaggctaccgagtagggcgaaaagagggtcacgctgaccatgcggcgtcgttgccggggcggctgctccaggtccgcggagctaatgccgtgcgatcccgacaaggaagaagaggagagcaagagacccgtggtagaagaagtcccggccgaggtgtacgtggacgcgggcgtggtggttcgtgtggatgacgacctggcagacggcagcgaaacagaattcggagatgctgaggacgacgacgaagacgcggacgacgaagaagccgcgtcggtcacaggacggcgaaaaacatcggcaaataaatcgcgatgttctgtgatctcgggttccgactcctggcccagaggcgctctgtcgaggagttccatgaagcgcttgggtgtcaggcccgtctgccgagaggcgccctcgatcatcatgctatagatgcgctggaggtgatacgtctcggtggtgatcttgccttcgtggaagttatagaagatctgcagggtttcgggccgttccacgaacatacgtcggcgcaggtagcggctgggctgttctggcacgcggaaaacctcaccgttgccgtacaggttcttggagaagaaaaagagctcgccctcgcgcgccgtgggatcggcttcgagatcgagctgggcctcgcgcggctcgccgtcgttctcctgctcttcgtcctcgtccccgaactcgccgcgctcgcgggcgtccgagaccgattggatctttttcagcagcttgtacgcgctgaaatgtaaatatcccgggcagaggtacacgttggcctcgtgcagttgcgtcagtagctgcaacagattgtacagcatcggctggaaggccggactgctgtgttgccgcgcaagttccagcccacgcaccagcgtgacgaaagtctgccgcgtctcgggggcttgcgtgtaacaaaagtaaagcgcgtcgcaaagccggttgcagcgttccaccacccagtcctgcatcatttgtagctccagcgcgtgtcgcagctgcaagtgtcgcagcgtcaacaacagatacatgtcgtttagcgcgtcctccagggtgcgtgagcccgggcgtttgatggaggtgaggcagcgcaacggtcggttacgacgttgtgttacgtcggacaggttctcggcgcacagatccaccgcctcgaccgtggtgaagggcggtgggtggaacagcaggttgtaggtggtgaggcgcggatagcgcgcctcggcctcgggagacgcgcgcagccccagcgcgtcgcgtacccggtgcagtcggaccagcgctcgttttagcacgccgaatgtcacatcgtcggcgcccaggtgcacgctgatgtcctcgggcttgacgccggtttgcgcagcgcggcagagccggatgagccctctaagcagccgcgtcttaagcggctccgagtacagcacgtcgagctgcgtgcgcaggtcccgcaacacgtcgcggctgttgcggtagtggttagcgaggatgcagatacggataatctcctgggccacgggctttaccttcataaaagcgttgcgcacctggaagtcaaccagggcctccagcgcgtatacggggctgggcacgccaaagttgagcagccccacaaagttggagcagccctgggtcaacatttcgagcagcaggcgccggtgctcgtccccaaacaggtcaacccgaaagttgagccagtcgtccacggggagaacgggcagtggcgggcccgatggggctcgcgatccttgggccatgatggggctccctttgaaaacgaaaccaaaaccagagcggaacttgagaaatcaacgctttattgttctccagtgacgttaaatacacaacggggttatgggggacgtgacgggggtaagggctggggtgactgaaggtgagggggtcgcggcgacccgcacagcggtctggctggctagaggtccgtcttcttcgtcggcgcaatgccgcagggcggtcgctagcgtgtcgcagcgttcgccgccgttgccgtcgtcgttggagacggagggttctgcccgcaggaatgctgcggttgccttgcaggagggaaacagctcctcttcttcctcctcgttttcttcgggcttttgctcgtgaggcggcatgcgtgtgcggggacgacgggcgttgcggggcttcttggactcgtgaagcggcgccgggtcgctgtgacggagctcgtcgtcgtcctcctctccctcgtcgttgttctcatcggcctcgggcggcccggccgccgcgctgtgtgagaattccagggctgccgacaccgagtccgtatgaccgatctggaagagcatgcggtaggcctcgctgtggtaacagccgtcgaaaacttgtgcgatatccaaacctgagttcatcaacaggtgtaggaagctgttctgcaggtagtggcgcaggtgtccgatgagacggatggagcgcgcccacatgtgcggcgtctggtgcaacaagccgatgaggacgtggcacagttcgcggtggcgctcgtgtggcagcagggctaccagttgatgcacttccacgcccagcgccgatttttcgccgcagcgtttagtcagttcgtcgcgcgcgtagctcaccaccttgtcctggtgctcgcagtagtggcgcagctgggccgtgaaaaccagctggttgaagagcgcgcacacgcgcgacacagccgtctgcagctcgtcggccggcgtgggcggctcgcggagactgggctgcaggcggcagcggatactggccgtgacttgctggatctcgtgggggtccagttcggccggcgcgcgcttgagctgtgcgatgccctggtggaacttgcggtaatcgcgctcggtgcagaaaacgaagaggttgctgttgcggcgcgagcagccgccgggcggtacgggcaagtgcttcagcagcagcttcttcttgccttcggcgcgtaccgtgcccttgtacgctttggaaatcgagcctgccacgttgtcacgcatctcggcggctcgcaggactgaatcgtcgttggagaagtctcgggtggtgatgatgaagttcatgacgacgacggcggtggggcggtaatagtataggtccgtgcgagcaggccgccgccgtgggggccgcggagggaggagagggacgggaacgatcaccgctcggagaaaacaacgtcgacgggggacgtcgtttttatcgtaccgtgccgagacagaagttgcgccggacggcgttgtggcgcgcaggggctccgacgtggcgttataatgaagccggggcgccactcctacgccacgcgattggccgtcggcgtccgcaatcgggcgaaatctgtgtaccgtgatgacagatcagggggacgtgtaccgtatatgaggggaaatggcgacgggttctggtgctttctgaataaagtaacaggaaagctcataccccgctgaggttatgatgcgattgtgagagtcgatgggggatttttgtggatgtgtcgttggacgcggttttctggccgcctttccacgtaccgctgggaaaattgaaagacacgctgcgtttggcgtgctgattgcagtttttgctattggggtctaatgacgtagccactgattgtgaattgttgccagccgctagatttgtctccgctgtagctcgctgattctgctgcgatctcaggaaagcgcggcggtccagcaactggccgcggaaacactgccgcatacgctgcagaaagtcatgacccagcagtgcgtacaggatgggattaatgaggcagtgcaaatggggaaccaggcgtgccagcgtgccaatggtgcgtcgcagtgtgaggtgttcacatttcgtggaccaggcggttgtggcgtaactgttgaagatcatgagagagatgtaaggtgtctgtagcgctacgaaggagatgagcaacacgctgacaaaagttaaggtgcgactcctttgtttttgtgacgtgcgttgtacggtcgagtagaagaaggcgtagaaccacgtcatcatgatcacgggtgcggcgccccacaccagcgtcagaagcaccttccacgaaagtagtactgtgtgcacctcgtcggccacaaagtacagtacgcaggtggcgtgcccagtggcattagtggtatcattggcttcatgatgcattactaccgtagtgtagacagccgcgggcatggaaaaaattagcccggcgagccatgtcaatatcaaaattgtataggtggagcggtacgattggcgtgcgtaaattcgcttgtgaaggacgcgatagcggtcggcggcgatcaaggctacggtggcaaagcccactgtgcaacttgagtagtagatcaccgacaggaatttgcacgaggccacgccggccggtagcagccactgattgctgagcacgataaagggtaacacggtaagcgtgagaaagttagtggaatagaggttggtcatgtagatggtgggcgtcgaatagccaagcacgcgattggtgagcagttgcgtgaccaacactatagcgttgagcggaccgcccacgaagatgataagcgtattgagcacggcttcggtggtgcggatggcgaacagcggccccgtcatgttgcaagtgtcattgatgtgcggagtagtggtgttgcgggtctgggcgaaacagcacacggtgcaaaaaacagaagaaacaagtcagcggcgcttaaaagaaaaccgcgtatccgcctccgctattaaactaccccccctccctttgggtgggacgctcaccgagttgtggatgatggtgtccatcgcgggcgaatagcagaccgcgggcgcagtccggggcgacgacgcttccgggttctggagaaaagccagcatgagtttgcagtttatcggtctacagcggcgcgatgtggtgtccctggtcaactttctgcgccatctcacgcaaaagcccgacgtggatctcgaggcacaccccaagatcctgaaaaaatgtggcgaaaaacgcctgcaccggcgtacggtgctgttcaacgagctcatgctttggttgggatactaccgcgagctgcgtttccacaaccccgacctctcctcggtgctcgaggagttcgaggtgcgttgcgcggccgtggcgcgtcgcggctacacttacccgttcggtgatcgtggtaaggcgcgtgaccacctggctgtgctagaccgtaccgaattcgatacggacgtgcgccacgatgctgagattgtggagcgcgcgctcgtaagcgcggtcattctggccaagatgtcggtgcgcgagacgctggtcacagccatcggccagacggaacccatcgcttttgtgcacctcaaggatacggaggtgcagcgcattgaagaaaacctggagggtgtgcgccgtaacatgttctgcgtgaaaccgctcgaccttaacctggaccggcacgccaacacggcgctggtcaacgccgtcaacaagctcgtgtacacgggccgtctcatcatgaacgtgcgaaggtcttgggaggagctggagcgcaaatgtctggcgcgcattcaggagcgctgcaagctgctggtcaaggagctgcgcatgtgcctttcctttgattccaactactgtcgcaatatcctcaagcacgccgtggaaaacggcgactcggccgacacgctgctggagctgctcatcgaggactttgacatctacgtggacagcttcccgcagtcggcgcacacctttttgggcgcgcgctcgccgtcgttggagtttgatgatgacgccaatctcctctcgctcggcggcggttcagccttctcgtcggtacccaagaaacatgtccccacgcagccgctggacggctggagctggatcgccagtccctggaagggacacaaaccgttccgcttcgaggcccatggttctctggcaccggccgccgaagcccacgctgcccgttcggcggccgtcggctattacgacgaagaggaaaagcgtcgcgagcggcagaaacgggtggacgacgaggtagtgcagcgtgagaaacagcagctgaaggcttgggaggagaggcagcagaacctgcagcaacgtcagcagcaaccaccgcccccggcacgtaaaccaagcgcctcccggaggctctttggctccagtgccgacgaggacgacgacgacgatgatgatgatgacgagaaaaacatctttacgcccatcaagaaaccgggaactagcggcaagggcgccgctagtggtggcggtgtttccagcattttcagcggcctgttatcctcgggcagtcagaaaccgaccagcggtcccttgaacatcccgcagcaacaacagcgtcacgcggctttcagtctcgtctccccgcaggtgaccaaggccagcccgggaagggtccgtcgggacagcgcgtgggacgtgaggccgctcacggagaccagaggggatcttttctcgggcgacgaggattccgacagctcggatggctatccccccaaccgtcaggatccgcgtttcaccgacacgctggtggatatcacggataccgagacgaacgtcaaaccgcccgtcaccaccgcgtacaagttcgagcaaccgacgttgacgttcggcgccggagttaacgtccctgctggcgccggcgctgccatcctcacgccgacgcctgtcaatccttctacggcccccgctccggccccgacacctaccttcgcgggtacccaaaccccggtcaacggtaactcgccctgggctccgacggcgccgttgcccggggatatgaaccccgccaactggccgcgcgaacgcgcgtgggccctcaggaatcctcacctggctcacaatcccttcaggatgcctacgacttccacggcttctcaaaacaccgtgtccaccacccctcggaggccgtcgactccacgcgccgcggtgacacaaacagcgtctcagaacaccgctgatgaggtttgggctttaagggaccaaactgcagagtcaccggtcgaagacagcgaggaggaagacgacgactcctcggacaccggctccgtcgtcagcctgggacacacaacaccgtcgtccgattacaacgacgtcatttcgcctcccagtcagacgcccgagcagtcgacgccgtccagaatacgtaaagctaagttatcgtctccaatgacgacgacatccacgaaccagaaaccggtgctgggcaagcgagtcgcgacgccgcacgcgtccgcccgagcgcagacggtgacgtcgacaccggttcagggaaaggtagagaaacaggtgtcgggcacgccgtcgacggtacccgccacgctgttgcaacctcaaccggcttcgtctaaaacgacgtcatcaaggaacgtggcttctggcgcgggaacctcttccgcttcggctcgacagccgtcagcttcggcgtccgttttgtcgcccacggaggatgatatcgtgtctcccgccacatcgccgctgcccatgctttcgtcagcctctccgtccccggccaagagtgcccccccgtctccggtgaaaggccggggcagccgcgtcggtgttgttccttccttgaaacctactttgggcggcaaggcggtggtaggtcgaccgccctcggtccccgtgagcggtagcgcgccgggtcgcctgtccggcaccagccgggccgcctcgaccacgccgacgtatcccgcggtaaccaccgtttacccaccgtcgtctacggccaaaagcagcgtatcgaatgcgccgcctgtggcctccccctccatcctgaaaccgggggcgagcgcggctttgcaatcacgccgctcgacggggaccgccgccgtaggttcccccgtcaagagcacgacgggcatgaaaacggtggctttcgacctatcgtcgccccagaagagcggtacggggccgcaaccgggttctgccggcatggggggcgccaaaacgccgtcggacgccgtgcagaacatcctccaaaagatcgagaagattaagaacacggaggaatagttaagaaacacacacgcagacgtactttttaatgaaaccatcggatagtgacgtgtcgggaaaggaggacggacggagggtcagggatggggagacgtgagaaagttgtccgcgggcaattgcatgtcgcccagaaagaacgtggttgctccggcggcgtgcatctgccgaaacaccgtgtggtgattgtacgagtacacgttaccgtcgccctcggtgatttgatacaacgtggcgatgggggtgccctgcgggatcacgatggaacgcgtgcgcgtccacagcgtgactttgagcggctcgccgccgcgccacacgctgagccccgtgtaaaaggcgtcctcgtgtggcaagttggccaccaagaaacaccggtctgtgatctgcacgtagcgcaagtccaactccaccgtctgccgcggttgcaccccgaagtggatatcgtaaggcgcgtgcaccgtgagcgaaaacacgttgggctcattgagaagcggacagttgagcgcgtcgccgctaaaaaagagtgacgggttgcggctgaatcgcaggtcgtacccgcgctgcgcgctcgtcagcaggtagaaggaaaaggcgcgcggcatgttgcgcgccgtgatcttgtccgagacgcggtgacagaaggaggtggccacggtgcccagcagttggcgctgttccgcgtccacgcatagtgaatccacgttgacggtgaaaatgagacccatgaattcgtactgcacgtttttggacgcgatccacgcctcgtcctcgccgggtagcgccgcctcgtcgtcgtccatcgtgccgcggaactgcgcgaggtagcgcgtaatttttttgtgtccgtacgtggttacgcgcttgctgatccaggtcagatggtccacgcgacacagcagcgtcgcgccatgccgcgtgacgctgacccgtccaaagggcgccgcctcctccaaccccgcaacgccgctcggagcaccgccgcagcccggctttcccggcgtcgtgaaaggcacggcgtaatgcgggcaggcgtgcggcacgaagggcaccatgaccagttgtgtgtgaagaaaaccgatctgcaccgcctgcgactgccgcatggtttcctcgtcgtaaaccgccatggacgagcagagcccgcccttggtgatgagcggttgtagcaccacggagctctcgctggtggagcagagcagaaagaagagctcggcgtacgccgccttgggcgtcaccacgttggaccagtcgtacttgtagccgcagccctgcgtgttgttgtaaatgacgggaaacgagagaaagatgcagccctgcacgtacgaagctttctccgtcacgtttgaggccgtgttgtactgctcggtgatggacaccaagtacgactcgtaggccgtcaggtgcgaggccgaacggtgaatcttggcgtggcgcacgcagcgaccgtagttgtcgcggtccgcgtcgcgtagcgcttcgatccacgaggtcaccacgtcctgcgccggcagacgatagtcctgctcggggtccatgtggcggcacagccgcaggcgctctgccagttggcgagggataccgtcgtgcgaccttttgaccgcggtggtgcctgtcgttcttgtctcccctccttcgttctccctgttttctcttctctcattcccggtctccggacccgcagccgctacctcttgctccgcggttttctcgcccacctcgctcgtcgctgtcgccgccaccgcagcggcggcgacggacggcggcggtaacagcagctccgtgaagctgacgagcggcagcggcgacgacggtggcggcgacgacacggcgacggtcaacagggtcacaagcgcgggtttgtcccccataatctggtcgccgccaccgccgtcgttgccggtccccgtttcctccggcgccgcggtttccgccgtctccggatgagcggccgcggcgcgggctcggcgtcccgccgtccgagacggtgtatataaaccgcgtcggcctcgccggcccgagcgcgccggggagaagaacctcttcccgggccccgcgttcaagacggcgtgccgtgacgctcgatgggtccgcttcatcagactgcgtacgctttggagcgtcagacccagggcgcatgtagccgacttggaggactttgccgccttttatcgcaccctctcggacagtgagcagcaggagttcgagcaagaagccgaactcgcctcccgctcacaacgcgtgcgacacctgcgcgaggcccggcgccagctcaagatggacctgatgtgtcacggcggttgaaaacgcgcatgatctcgcggagccatctacgcgcctgtcagggcgatgacgacatcagcgatgacggctcctgatacgcgccggcagctgcagcatgtggagacgctgcgtcggtttctgcgcggcgacagctgctttgtgcacgatctccggggcatgatggactatcacgacgggctctcgcgccgtcaacagcgtgccttttgccgcgcgggtcgcgtgttgacggacccggagcccatccagagcgaagcggagggggagaataaacagtttacggagcacacacacaaagtagtctcgttttttattaaaagtgtctttgtatttccctatcttgtgttgcccaactgctgtcaggtctccgtagatcgctcccgggtgcccgagacggggggcagatggctataaaaacccaagtagcggcgcgccccggcgttcagtcgcggctgagcgtgtggaggacggggtggagcgggtcgccgaggctactgctgcttctgcttttttgtctcctgtggatcgtcgcggactgccggcatgtccggccgtcgcaagggctgctcggcggccacggcgtcttcctcctcgtcgtcgccgccgtcgcgccttcctcctctgcccgggcacgcacgtcggccgcgtcgcaaacgctgcttggtacccgaggtcttttgcacgcgcgacttggccgacctgtgcgtgcgacgcgactatgagggcctgcggcgttacttgcggcgcttcgagggctcgtgcgtgtcgctgggctggccctcgcagtgcatctacgtggtcgggggcgagcattcgccgcactcgctgaccgagatcgatctggagcactgccagaacgactttttcggcgaattccgagctctacatctcattggcacggtctcgcacgccacctgccggtaccaggtgttcgtggacgcgtacggcgccgtgttcgcctacgacgcgcaagaggactgcctgtacgagttggcctcggatctggccggattttttgccaagggcatgatccgctgcgacccggtgcacgaatccatctgcgcgcgtctgcaacccaacgtgcccttggtgcatcccgatcatcgggccgagctgtgccgccgctcgcgcgcctccgctcgcggccgctacctacgttcgctgctggctttccgcgagttgctggcttgcgaggacaccgccgctcgctgcgcctacgtagaggcgcatcgcgaggcgcagctgaccctcatctggcccgagaagcattccctggtgctgcgcacggcgcgcgatctggggctctcggcctcgatgctgcgccgctttcaacgttcgttgtacacgcgcgagcccgtcatgccgctgggcgagatcgagggcgccgaggacaagaccttctttcaccgcgtgcggattctctgcggcgacacgggcaccgtgtacgcagcgctggtggggcaggataagttggtgcggctggcgcgcgacctcaggggcttcgtgcgcgtggggctggcgctgctcatcgacgactttcgctacgagagcatcggccccgtggaccgcagctcgctgtacgaggccaatcccgagctgagactgccgttcaaaaagcgtaggtgagtcatcagtgtacacacgcccagaaatagagcgacggtgtttttataaccgaaagtagcgtgtttgagacacgcgcttataatcggttttttcaccgtcgtcgctctaggtttgattttcgcgctcttgtgtctcccgacaggctcgtcgtgggctactttgactcgctctcgtcgctctatctgcgcgggcagcccaagttcagcagcatctggcgcggtctgcgtgatgcctggacccacaagcgcccgaagccgcgcgagcgtgcgagcggggttcacctgcagcgctacgtgcgcgccacggcgggtcgttggctcccgctgtgctggccgccgctgcacggcatcatgctgggcgacactcagtactttggggtggtgcgcgatcacaagacctaccggcgcttctcgtgcctgcgccaggctggccgcttgtactttatcggcctcgtcagtgtgtacgaatgcgtgccggatgcaaacacggcgcccgagatctgggtctccgggcacgggcacgcctttgcgtacctgcccggcgaggacaaggtgtacgtgctggggctctcgttcggcgagttttttgagaacggcctctttgccgtgtacagcttctttgagcgcgactacgtggatgagatcgtagagggcgcgtggtttaagcacaccttcgcgggcatgtacgaactctcccagatactgcacgaccgcaccaatctgctgcgcgtatgtcagctccacgccggtagcaagatccgcctgggcggctcgcccgcttgtactttcactttcggctcgtggaacgtggccgaggccgacgaggccaacaattttgtgatcggcgtgctagaacaggcccactttgtagtcatcggatggatggaacccgtgaacaaagccgtatttatggacgcgcacggcggcattcacgtactgctgtacggtacgatgctggttaagttggccgagacgttgcgcggttttatccgtcagggctccttctggtttcgttgcccacggcgtttttgcttctcgccgttggactcgagcgcaaccgtcgccgcgaaaccggtgagcagccatacatcgcccgcgtacgacgtcagcgagtacgtgttttcgggccgtagcgtgctggatagcgtgagcggcacgggggcgtcgtgaaggaggagactgtgatgactagctatatagccgctgtctggctttaccgccgtcgctccgcgtcgcttcgtcgccaccttcttcttcctctcagtcatgaaccccgtggatcagccgccgcctccactgccaacccagcagccggaggagcaggctaaagaagaccatgacgacggtgacgagcgcctatttcgcgatccgctcaccacgtacgagtatctcgacgactgtcgtgatgatgaggagttttgtcaccagttcctgcgcgcctacctgacgccgattcgtaatcgacaggaggctgtgcgcgccggcctgttgtgtcgcacgcccgaggatctggtggccgccggcggtcagaaaaagaaaacgccggcgcccaaacaccccaagcacgccatggtgtacattcgccgcagctgtctggtccattcggcctgcgctacggcgcacggcaagtacgacatccgcggtctgacgctcgagtcggacctcgctgtctgggccgcgcttcgaggcgtgcccttgccgcccgatccgcagcattttcgctggctcaacgccggcgctttccgccgtctggtgcacgaggcgcagtacttgccagagatcagtcgcgccgccaaacgcatcgctctggccgtggccacggggcaatacgtggtgtgcacgttgctcgattacaagacctttgggacgcgcacccattacttgcggcagctatgctcgatgaccgaggagctgtacctgcgcctggacggcaccctgtgcctgtttctggaccccgaggagcgcgaactcatcggccgttgcctgccggcggccctgtgccgcgggttgcccgtcaagtaccggacgcaccgcgccgccgtttttttccacgccacgtttatggcgcgggccgaagcggcgttaaaggacctctacgcggccttttgcgagtgcggcgacgggcgcgacgacggcggtaatcacaacggtaaccacggcggcggcgaccactcctctttgtcgctttccgcggcggcgtctcaccattcccgtttggagcacgccgagctgaggctggagcgcaaccgacacctgggtgcgtttcacctgccggcgattcgccacctcacggccggcgacgtggcccgcgtccagaacagcgtatcacgtgacctgggcttcgccgactggtcgcagacgctggtcgacgactactttctgctccccgcgggctgggcctgtgccaacccgcgtcgcggctacgccatgtacctggcctccaacgccgtactggccctgcgtatcattcggctgctgcgcgccagtatacgtcacgagtacacggcgtgtatacgtatgttgagcggggacgtgcagcggctcatcaggctgtttaaaggcgaggctgcgctgctgcgcaagggactcgctcagaaccccgtgcaacgtcgagaactgtcgcggttccgcaaacacgtccacgatctgaagcgcattcgcttcaccgaggacacgttcgtggagaccttctgcgactttctcgagctggtgcagcggattcccgactaccgcagcgtgtcgctgcgcatcaagcgcgagctgctgtgcctgcacgttttcaagctgcgccggggctgtcgcgcgccgccgacgcccgagacggcgcgcgtccagcgcctgctctggcactcgctgcgacacggggacgcgccgcaggatcgcacgcggctgccgcagttcagctcggcgctctcggacgccgagctgagcaaccacgccaaccgctgccgccgcaaggccccgctggaactcggacccgccgtcgtcgccgccccggggccctcggtgcgctaccgggcccacattcaaaagtttgagcgtcttcatgtacgccgttttcggcctcacgaggtcggaggtcacgccacatgaagccgcggcggcgcgttataagcaccgtggggtcatcgaccgacgaggcgcggcgatgacgagcaggcgcgcacccgacggcggtttgaatttagacgattttatgcgccgccagcgcggtcgccacctggatctgccctatccgcgcggctacacgttgtttgtctgcgacgtggaggagaccatcctcaccccgcgcgacgtagaatactggaagctgctggtggtgacccagggtcagttgcgcgtcatcggcaccatcggactcgccaaccttttcagttgggaccgcagcgtggccggcgtggcggccgacggcagcgtgctgtgctacgagatcagccgtgagaactttgtggtgcgcgccgccgactcgctgccgcagctgctggagcgcggcctgctacacagctactttgaagacgtggagcgcgctgcgcagggcagactgcgtcacggcaaccgctcgggcctgcgacgcgacgccgacggccaggtcatccgcgagtcggcctgctacgtgagccgcgcgctgctgcgtcaccgtgtgacgccgggcaagcaagaaatcaccgacgcgatgttcgaagccggcaacgtgccatcagcgctgttgccgtaacaaaataggaaggaaaaaaaccacacgtgaaaaaaaaaacccggagaagacagagaggacgagcgtccacacaccgctttggtcgtagacgcatttttattcttggtacattaaaaaaaaaaacaacacacatactttcctgtgactttctatcataaactgttccgtcctgctgcttcgtcccaccatcagcaacagtattccccgctgtcgcggcggtcgcgacggtgacggtcccgctcgtcgcgttgaggatagtcgcgcggcggcagcgggggtggtggggatcggcagatttgttcggggtgattaccgttcgcttccataaacgctttaagagccatctcgcgtaacgtgtcttcttcgcgttcgtcgggggggacctggctaaagattttgagcagggtgacggaggagacacccgtgtgttcgaccggaatgtgtcgactcgagggctgcgcttgcaaccgcgccacgcatatgtcgcgggtgatgagtttctggcgcaggtgggtggcgcgcgggtcgcgcaacagcggatcacgcaccataaactcgcctacgaggcgttgggagctactgctgccgccggtgtcaccgataataggtctgtcgggacaggccagcagacgcagggcgcagtacacgtagtcggtgcaaatgaaggcgtcctgctgacgcacgacgcgtaaaaagtcaaacaacgccggcgtgctcgcgtagagcgcgtagtcgtagttttgactgacggcccagtagagcacgtcactaagctgcgcgtagtcttcgcgcaacgacggcagttgtacatagatgaggtaacacagctccgagatgctctgcagctggtgctggagatagcagcgcagcacgcgaatggtgcgttgaaagtgcgtgatcataagctcgacgcctactaggaacgccagatcgttgagcgtgtgctcttcgcatatctcttcgaccgaaagcagccggagcatgccccggtggttctcgttgagacgctgcaggttttgccgatagaggtagagcgcgccgcgcgaggtgtagtgggcggtatagaagagcacgttgtaatcgcgtagcgtctggtagacctcggtgagccgcggcgattcgggcgtgccgcgatgccgcagctcttcgtccagccgtcgcagagacgtggcgtactggccgtccgtcactcctttgcgtgacgtgagaaagtgaagcgctagcgcggccgcacgccccgaacggctctggttgttgacctgcgtggctacccggcgtaccgtgtcgcttcgcacggtggtccgtatggcctccatcatgtggcgcgctttcttttgcgccacgtagtaatagttgatgatcaccgcgtgcgtgattatccgacgcgtgagatcgcgctcgccaggcgctacgttgtttaagacggggtcgacgaggctggtgagcgcgaaggccggcatgggtatgcagtcgttgaggcggcggaggtgctgcacgtcaaagtcttgtagcacgaattttagatactcaacgtgctgcggcgcgaccacgctgggctcgaagcccagattgtcagccacgctgacccggtaacattcgcgctcaaagtcttcgatgtcgctgtcacagaaggaaaactcatcgccctcgacagcggacggttcgcctggcgccacgggactggtgcttctgctactgttactggtggtgcggctgctgctgccgccgctgctgctgttatcgtcgccaccgtcgccggcgccgttctcgggcagcgagggtacactaggcggtcgcgagactttaggcgacttgccggccttgggtgtcgccggcgagccccgaggcgcgcccgctgcgatctgcggttgccgacgcgacgacgatcgtttcttgtcgctcggtttcttggcggcgccggcggcgccggtctcgcgcacgagctcgaaggacgacggggcgtccgaggagacactgtagggcgacaaaccggcctccatgcgatccagatcttctgtggcgctgcgcgcccgcgtgttcgtgaaaacgctgtcctccgcctcctcatccgccggcgtgtcctcgttgctcgaggggatataaatcaccgtcgagggttcgccagagcgacgtgacgagctgcggcgccgcgacgacatcctctcgtctgctgaggtgcgttcggctcagttgcttacctgcatacatggaggagacccgggcgggacgttatatagtgagggccggctccggcgggcaaaccgaagatacagcctcgggcgcggaaagtgtcctcgccacgctggccgcggtgaggacaagaagacggagcgtggtgtgcgacgggcccccgggctcgcccaccgactcggcgcgtcacatgagcgatctggctagcctggcgctcacggccgagttcggcctgggctgtctggaagcttacgtgcgcatcaacgcaggccaggtgttgcccgtggtctggccgccgggctggaacctagtgctgcaggagatcgagacggacgaggacttcaaaccggaggacgtgaaagcttggagtcactacctgtgctgccagacgcgcctggccttcgtgggtcgcttcgtgaacgagggcgtgttgtcgccggatcagcagaagaagaccgccgtgtgcctcatctcggacgagggctatgtcttttgctatgtacgcgaggacaccgccgtctactacctggcccgcaacctcatggagtttgcgcgcgtcgggctgcgcgccgtcgagaccctgcactgcatgcgctacctgacctcgtcgttggttaagcgctactttcgtccgctgttgcgcgcctggagcctcggtttggataccatggcgcgattcatcatccgtcaccacgggcagttcatgccgctgacgtacccgccgggaacggaactgcgtctatgcaacctcaggtgtttcgaaaacagcgtggaaggcggtcacttgctgcgcaacatcaaaaccgctttcggaatgcgcgttctcggcttgggaaccgtcagcctcaagggcgagaacgcgccctttcctcacttgcgctggcccgtcgaccttatccccatcgtcgtcgcctataccggggccgtctacgcctgcgacgtgcgcgacgaccgctacatccggctgggagataatctcaacacgttcatgtgtctgggacttaacctgctgtttgaaaaccgacgtttcagcggccacaacggcatctacgatcgcgtgcccgactgccccaaaggacgtcagcaccgttgactgtgacgccacgagtgacgacgacgctgcttggggcataaaacaccgacgctacttcccgtttgactcgcgtgccaattttttcgctgccaacgccgtcaaggccgcctcttctggccctccgccacccttcgctcgagcacggcggtgttttgccgtcgttttttttttctggatcggcccgatttctttttgtccaccggcgcgcaaccgcgatgtcggtaatcaaggactgttttctcaatctgctcgaccgctggaggcctcctaagacgtcgcgaccgtggaaacccgggcaacgcgtggccctggtctggcccaaagaccgctgcctcgttatccggcgtcgctggcgcttggtgcgcgacgaaggacgggatgcacagcgtctggccagctacctctgctgccccgagccgctgcgtttcgtcggcagcatctgcacctacaactttctcaaacacaagggcgatcacaacgtgccgtctgaactgtacctgggcgcctcgggcgccatgtacctgtggaccgaccacatctactctgactcgttgacctttgtggccgagagcatcactgaatttctcaacatcggtttgcgacgctgcaacttcatcaccgtcccagaggagctgccgcacaccgcctcgcttagagcgctggccggctgcatgcacatccacgcgttcgcgcagtggcgtgctatgtatcgcggccgaatcatggtcgtaggtgattacagcgtcattcgcgtctccacgattcggctgtacgactggagcgagattaacgactggagggtcatggtcggcagtaaccacgtggaacctttaggctggttggtgagcccctacgacgtgatcaacctcttcgtggacgactgtatgcgcgtctttgctgccaacaatcagcacgtttgcatcgtggccgacagtttgatggagtttgtgactcgcggcatgacacgctgccacgaaaacggcatttattacggaaccaggagcatgcggaagctaaatcagcctacctgtccttacggagtggaccaccaactttttgacaacgcgtgaacccgcgtctcccacggaccgtgtgccttttttttttttcccgttcctgtaaataaaaagctgttttttatttttcatacgaaccgctcgagtcgcgtgtgttttgacggggctgggtggggagggaaggtcgcgccgccgcagcatcccgcatagcctctacaaactagcattctggtgagatacatgttcataaactctcacgggaaggctagttagacaggctatgggaagaaaccgtgtttcgcgtgccgaatacgaaagaaaaaagaccggaggcggggtgtttttagagcagaaccttacagctttttaataaaaaataaaatagtcaacatggtctttaacccttgggatctgctgctgctactgggtcttttcattttctttggtgtgttcttccttgtgttcgtcggtcttctcttgtggttgctgatggttacctccatctgtatccgtaatcaaaacgtcatagtctcccccggagtaatcttcatctccgtcggtggtggaccccccctgactgagagttacgtccttgttacgagtggtattaccatcggagttagtgctggtactgggttgttccaccgtcacgctgcaaaaacacgataaccgcgttcacaatcacgtcattttttgtatctcttacctgtgttgagttccctagattccgtttacctgcgcttcgatttctgagaaggtgccgccaaagccaccgtcaaggtcacggctagtacgctcaagatccatagcctccgagccatgctgaggtcttgtcggcgtcgctgatgacgaacgcgtctggctgtgtgccgttaaataccttgggtgacgacatcttgaggtcatgtggccgcttctgaaaaacaacgtagtccggacgaatcgcagatacgcggtttttcaacctcgacggtttacgcctcgcccccaacatgacgcgttcgggacgaaagacgacgtcaggggattcacggtatttagccatgcagcgtgcggcgcctctctcatggatccactgtcaccgtcgcaatgggaggtagccctgttccccagctcaccaccgtcactcaaggactcatgccatctgtgcgcatggactttcgggctcgccggcctttgcgccgcttggctttctacgcgccgcgagctcgtcggaggcttttccagaatcatatacatccagaacagcgtcgagtgctggttcatgagggagacgaagagatgttgccggatctgccgatggagatcgacatcgtcatcgaccgacctccgcaacagcccctgcccaatccactggtgctactgctggacgatgttcccccccatgtgcccggttttgctccctaccgcgtcccccgtccccaccccatgattcccgaagaacattgggaccagttttaaataaaaacattttatttacatctgtacagggatcatataaaagtctatatatccagtccattgtcagtatttttgtgctcaagttcagtgtagacttgtggaaaatatatagtccgtaccgcttggggctcagtccaaagtccgtcatgatggtatgcagattaccatgtgcgtgggctcaggcgacgacggaggagacggtgggaattctattaagtgaggaggtcgtggaggaagtggaggtggtaatgtccacattttgctttcccggatccaagggacgagcagtcgccgcgtgcggataggcacctggacttcaatgtccttgtgcgttaacaagttttctttttcctcctcttcctcagtgaattctggcaagcgttcaaagccgcgtgggcatatcagaagtcggtcacagcgatagtaacagatgaggataagcagcgataaggaagcgagtatgatggatattatacttgtgattcctatgcaggacatggagaacaagtacgtggttctacgagtcatgtcgaatatataagcttcatgaagtccgcatgtaagcaccgccacggaattcaggatagcataactcatgaattcctttggtacgtcaccttcagatttgttgtaccattccaccgtggtgttgagggtatactgtttagcgggcagcgtgcagcgtgtttcattttttaacaactcgattctggtggtgttatgagaagtatcattatcgacccactttttccatagttcgcacatgcccaaaagatatcccgagactgtacttccacaggtgttatttgtatagttgtaggcatttccagagtaccaataagtatcgttttgagtacagttcaaaagccagagggtaatcaggtaagactcaccgcggttgatgcagttttttgtcaggttagctacgctccaattatctccactggacgcattagctgatatgttgccttggatgaaattgaatgtcccggttaggtcggtgtagtttgaatacaaacctccaacggctgtgcgggtgactccgttgggcccggtaaggagagatacaaagatggtatttgtattattatttcgggcgtcattgttcgttgtcacctgcatccagtggtaattcagcatcaccagcatagcatgtatcccgagcatcttgccggacagagcataacggcgtttgtatatataaagaccgttccaacgcaacattgaggtgtcattgacgtctttattgacgtggttttaccgcaacttcctcttttcgcaggttgaatgaggaacccgcgtagatccccaacgccggtttcatcataaaccaccgtgagaaccgggcgcgggtttcaacacgaaaccgcgtcactcacggacgtaggttatttcgaaaacctacgttaatcctgaacgcgtttcgtgtcacgcgtccctgcgactcacatctagctcgtcttctgacgctacccacgaatttcgtaaccgaatccgcttcagcgtttccattaaactggcgcaatccacttctgactgactcggtcgctcgatgcgcacggatccgtgatctaacacgaacatagtgtagtgggaattcgtggcgatggacgtcaaccgaccgcagaacccatcacgagtgcgtcgcgtgagaaacatgaccgtgttgacgggggcacgcggtaaccgacgtcgaaacaactcatacagggcgttgctggtcatgacgaccggaccttgcgatagcgccacgcaaaggccaggttacgtaggtattgtttcaaagtggtaaagtagtgcaggaacgcgaatagcaaagcgcacaaaagcagggctaggaggacactgctgatggtcatggtgttatagcgtttgctagctgtggggtgatcagggacctcccccgaggaactgtcgtcaggtgaggtaatgctgatggggatttccaccgtccaattaccgtgtgtaacgcggcaggtgtagttttgattgcaaaagatggctacgtaacatccctgatggaaagtcccatcgaaggtgggaagtagcggattgcattgaggctcgctatcctcgggcaccttatcaccgtaatgaataaaagtaatattaatttcccctggaaagaacccgtaagatgtacagaacgcttcagctctgttgtcattgtggtttcggacaccgcctttcaccactgggtgggtgacgggggtctgaaacccgctatagatgacggaccactcggtgcagttgcccataagatagttcctttgtattgtagtatccccctcgctgatgtttttaattttaccgtcgatgtacgttttgttttgcttcaaccaactaatttcgtaattggggcccgtccatagtgtcaggttatccttgagctccattaaagtttccccgtcccacccaaatccctcgtaaccggctacaaaactaccgttttccgtggtattacactcgtgcgtccacgtcagcacgctctgtgattggtaacccaacgcaatttccagctctaacaggttttgctcggtttggttaaaaataaggtcacctttggctctttccccgtccaggtaggtggggtaggccgccgagacgttagccatccaagaaatggtaccgttggcccgacttgacgctttatcgctggaattaacgtgataggtaaaaaagtgttgcccgtcaaaaatccccacaacggtcaacgtcatatgcgatgtatcatcgaaaatccccgtgtacccgtaacgcaacacgtgcattcccaccactctcaacatccacagcacaaacaacgtcagacaccacgttgtcatcatggcgttttattaacagttcctcggacatgatcagcgttatatactttcagtccgcgttttgacccctcctatcttctttgatgatgtatcctcttagccgtgtgttgtttactcctcctcttcgggagaccgtgccggatccgacatcagtggctccgagtcctcccgaggaaagaaaagtcgtcgaaacagccagcacaaatcgtgccaaaatagaaggacggccgcctttgttcttcttttgggaatctcggcgggcctctgggggccgcacggagcgcgacgtcgaggtagatgtttgcggcgcctgtggtaaaccgtggtgtcccaggatctcttagacacctgttcgtccagaatcaacatttccaaccgacagtgacggggccggccgacgaagtgtgtgaggagcgcgtgatccatgctcgtggcaacggcgtgccgcgctcgtgtcaaagagacccgtccacggaggacatggccttcttatagcagcgtgaacgttgcacgtggcctttgcggttatccgttcagtcctcggtgcgtaaccgctggtatcgatgcggcaggcgaatgcgcagccgctgacacagtcgctgggggatccgtagggccaacaagaagaagaacagagtgatggccgagaccaacacgatgtctctcgctaaggtcgcggacagttcctcgtcggcgcttacggaggggtgtttggcgagcccggatccgggcggtctcggatatagcgagcccaatcggacgtagaggcgctcgattattttcgtcgtaccgttctcgcagcgtaaacagtcatagcggcccacggtaagattagtgactatgcggctggtgtacagtttagtcacagggacggttcgcattttcagtccgtcttgcaagatgttggtggtgatgtcgctgaaattgcggatcaccgtgtcgttctggtacaaccacaggtcaaccaccgactcgttatgctgccaagtaaaagccacgccgatgatctcgtcctcggtcacattttcatagtagcagatagagatacacatcccgtgtaacgtccacgtttctccaggacggatcgaggccaactccgtcacattcaagcggcaggtcgagttggaagacttgctacccaggtcaacagcacacggggaagaggcagacaagcaaagaacaaaaaacccccatcccagcggtaccgtacctcggcgacgctccatgccggcgcctaacggtcctttgtgcgcgctcctcataagtacccaggcttttgaccccagtcggtacctacgtcagcatggagcccggtgtccgaggaagaaggaggaggagaggacaacgaggtccccggtaagattaagggtaaacatccaaaaccggtttatccccgccaatattcccaataaaatacaaaacgcgcgttccttgacatcgattcaaaatttattgtgcgcgataccgcatcgccaaccacgaacacagtccaaaaaccagaaacatgaaccacagcccaatgtccgccttctggtgatcggtccgcgtacaggcggacgtttcattcgccgaaccgcgtctggtaccgctactgtgggcgatgggaccgacgtcggagtcgcggcgttcgttggcgccgctgccgcgtcgggtaccgctgccgcagatgagcgcaccgacggcggagccgcgtcgctcgccggcgcccgtcatctgacattccgttttcctgccgtgactgcgaatcatccgcttcatggctctcctcgtttactcccgctgctgctcttcctcagagacggccgccgccgctaccgcagaggcttctcccgcggcagtttcctccgccgcctcgttttcctcttcggtgttcagacgccggtacgattcggaacaccagtagcacagcaggtggcagagggaggtcagggccaccgatcccgcggccagcagcccgatcttcggatccgtcagccagtaatccctccgcagatgatagcgccgcctagcgccgtctacccgatgccggcggctgcagttgttgtccgcgatgctctggctgatgaagggcacgcacagttcgcgctcgtcctcctcgcacgagggcagcagacccgaggtgccggggatgtagtggaccacgcggtgccgttcaccctcccaaccacagtttatactgcgcaacctggagggatcgggcgtccacaggtaccgcgtctgtgagcgagatccgaaagctaggtcgcaggagcggtccgagtggcgcaggtcgtgcacgtcggccaccaacgccgtggtctcggtcgccaggctgtgagtctcgttgcccagcacgcaggtgtaggtgcccgcggtctcggtgatgagccgaaacgagaggcttagccgctgcgccgcgccgccgtcctcgaagcgccagcgcccgccggcgatgtaacagctagcgtcgttgtgtaacacttgaccgctgcgtgcgtccaccaccagcgaacgcacgatctcgggccagtagcagaggtggactcggatagagacctctggccagtcgtgcgcggggaagatgcaggccacctccagacggtcgccgtaaggcagcaactgcggtgagcccgggttccgctcgcggttgcggtcgcgcaccggctgcagacagggcgaacgcaccaccggaggcgcatcgaggcagcagttgccccactcgctccaggcgatcagtagcggcagccacagcggcggcagccgaccaccgcccatacctgtctgtgtttcagagctccttaaaaagaccacacgcgaccacatattatatataaggtgcgattggcaaattatctttattggtagtgtttgacacgcataagcgaccggggatggggggaaataaaggaatggctcggtgtattctaaatcgtcatgggtcgtcgaaccaggtagctcgagacccacagtcctaagcatagacgaaacagggcacgatgcgggggttctcggggcggacaggccacggtcagcgtatttgtcgtcattggcggcgattcacacggtccaccttcctcgttctcctcctgtgacctcctattcagttctccttgtcccgctggataagtgacctgcggctcttgaacctcatgatcatcatcatatcttcccgcattattccttctctcgtcgtttccacttgctcggctcccatcattcccttctctcgcgccctctctcgaaacgtcctccacttcttcacgttgagtgtgcgttgaatttcttgttttctcttccgtaagctgttgacgtggttcctcgttttgccggagcaccgtgggtgccggcggtatgacggccagttcttgcgcttcggccgctgggttctgtcctggaacccacgtgcgacgccacaacgtggttctttccacaaaccacgtacgtattcgcgtggccgtttggctcacgacgttgctttcctcccagcgggttctgatctggctagagacttgctgtgtccaaccgtggcaccgtaggcggaacagctgccagcggaccgtcagttgttggcgtagttgacggagtcccgcaccgccgggtcgcggtccgccggtgttgggaccgcttcccgcgggatgtctcagacgcccgcgtccgaaacaccgttggttggagaagcgtattcgcgtcaggagcagcgagtcccggctgcggaccgtcagagcgttatagcgccgtctttcgtgccgtcgccgcattacgttttcactcgcgtcgtgcctgacggtgctttctgcactatgtggtgattcggcacgttctgcgtccgcgtctcgtgcatcctctgccggctgcgatggtggatccggaggggggaacgagggtctcggaatcgcattgcgcgactgatttcgccgccgttgttcttccaccagatactgcagctcttgatactgccaacgtatcccgtctcgcgatggcagttcgggtgatacggcgtgatgctgtgatgacggcggtctcaacggccgcggggaacgcacatcgtagacgggcaaatgcgggagcgatcccgaccaaagtggcggtcggtccaggtcaacggcgtttcgccgcgtcatgaccgacgctgctctgacttggaatccggcgtgctgcatggcttggcgcactatggacagctggtacgtcgctccttgtatctcccgtagccactcgtcctcctcgacaatgtccaagccgtgggcccactgcggccgctggaaaaggagtaagaatggcagtctacacagcagcagcgggagcagatgataacgcaagaagcgaccgcagtgggcccacagcatgctcttggtctttctagggccggtcaacagctttatgaagggaatcagggacgtcggctttggaaagccccctcggatcctttcggtatcgagagcgcgcctggcttcaaatacgtcaaaggcctgtccgccgcgccagctggcacggagttggcgtttcacagtgatttcatgcaatcatttcctacgcgacttgctcacagatcggtttgagggatgagcacgatgccgtgcttgtcatgctgccagagcaaccacagcttttgcggtattcgaaagtagaaaatgataatgatgataataacgattacggccgctaaaacccagagggcgtgtgtggccacgtgttggtgctgtgggcttggttgtaacggtgtttccgctgctgtggcttcaaaaccaacgtgatgttctacgtgactgttaggggtgctggattttttgggactggagtgtttatgatgggtagtgcttatcgtcgtcttcttggcggcggtggttgttctcgtggtggttgttctttgtgttgtagtagttgtcgttctcgtagtcgtagtgggctttttggtggtggtagtggggaatgtaccgttttcgttcactgtcagattgtaacatgtgtctaaagtccatcgaaaaccatggctatgttgttggtgacgccaatcgtctagcgatgtcatagtacgataggtagtactatactgcgcggtaacgttaatgaggaggaggctgtaattactcaaacatgaaaaattaaagcgcgtgttgttgaacgttgttgttgatgtgccagtgaaaatgcataacatgtagccttgcccgcctggaccgtatgaccaacgaacttgatcgcgagggggaataacatctaccgcgttcaacgtaacgttggtacctatcttgccaaccaccggtatgcaggcatcatggaggctgatgtagacaccaaagatgcatgcagccgttaggtaaagtaccttttcgcgatgaaaggtaatgtacctgagcagcattctaccacaggtgatttccacatgttctcaggttccgtagggactgtccctatattcaaacagtgagtttgaaaccggagatatccgtccgctcacgataagtagtccgtagtgggcagaccgtcggttcctttgtaaaggtatcctctggtgtcccatttctctcggagtctttgaggaatcttgaagaaaaatagaatgacgactatgataatgatgatgataatgagaatccatgcgctgtgtgcggcatctttggttcgatgtgcctctacgttaccggtaaacgagtccgcaaagcctttcggaagacccgttacattgtaatctttaggtgacgttctccgcgtggatcttttgtgctgcgtatgtttattcggcgtggtttttaatcgcaacaacgtagttttttgtccgggttttctggtcgttgtcgttctggaaatcagcgataatgtaaaacatgttggaaactcacagttaccctttggtggacattttcgcctgcaatagtttttgggatctgagacgtttacatgaagaatgcttaatgtggaattgtgacattcatacaacagtggtgatggcaacggagtggttttcattgtcttttgtctaccaggtttaggagggtcgtaggtgcagataggatgcgtattttcgccgttgccgatgccgacgcatgactggttataccagtgtactttttgtcctggatgataaccatgtccactaccgagggtaactggatcacctactctgacagtgacctccatacaggtttcggaatatctgtaaaatatcattgcggtcacgacggaccatcggaaaagatcatggttcacgatatggttaatcagtcgccgcataacacaaacacctgttgtataaccacgtatatgtacgtcattatgtttacggtattcaaacagtgagctgaaaaataaacgtacatatctattctttttacgttttggtttccttggcgttgattctttaagcggcggcgagcataccgctgtatctgtattgtgtgaatttattccaagctttctgggggaatttgaaacaagttaaaacgatgattgttataacgataactaggggtatgatccacattgtatgtggagtggtagtgtcgtgttgtgcttcaacgttaccggtggcgtagtggaccgcggtatgtgtgaagttggttgaggtgaatgactgtgatatttctaatgaatcgtgtacagatgtaggtggatacagggatgatgtagttgtatggcaatgtgtttggtgggtaaagtgtacactaacgttataacacaagttattcggttttggtactcctcgtccgagatatttaaaggattgaaaataatagtttctactgtatgttgtggttaagttcatgagaattagtgtacgattatctgtgcattgccacacaatatttggagagtctagattggattttgtgcgttcattactttgataaagacataacttgtaaccattggtttgtctatgtaccattcaaaaacatcgtcttgaaataatgagttattaagcggatgcaagctaatattatgactgccgtatccaactgtaggggtacatggtattgccatatagttccaatactgggattttgatgtgtaaaataaaattgttatccatggaaatacctgcaaacgcttagacatcactgtcacagttccgtgtctgtcataaacacttgtccgtactgtttactgtctttccagtgatggtagatttttcgaggtgctcgtagacagatgataataaaaatgatgagaatgatgacaatgattagcatccaagaataatgcgttgccgttctttgatattgtacttccccagccgggtattctacaggttgtgggatgaccgtagtcgcgttgctgaggttcactgcagtctccgtgtttttcaatagcaatgcactggtttctaacgttgtccagtcacttctatttgtacgcgttgtattggcggtttccgtgaattcataatttccgtcataattttctgacgcagatagtcccgggctagtcattgttggcacaaaaccttctccctgataaaaagcacattactataactctggtttaccacacaacaatttccaccaccccataatgcaaacaactatcagaactaaaaacacaacaacacctaccaaggccaggtgcgtgttgttttccaaaggcgtctgattggagaatccagcgacggcacgtaattgtggtgctaaactggcgttccctgtaacgttacttttcgcgtcgatcatcgtcgatgtcgtcgtgacgatggttgttacgttactagctggagtagtttccaaaggtttgggtttcacggtcaaattataccacaggaacgtttcattttcgccgcttctcgtaaaaccttctgctccgtaacgaccggagtcgttcaacgtgaggttgaagatggtgatttggttagccgcacaacttaggcttaaacccacatagggcgtagaaagaccctctccacgtttgtaaaagcaaatgagatggctatcgttgccgtcccagcggaaccaccgtgcgctgatgtttgaagtgaagttggataccagggtaacgttccctccctgtggcccggacacgtagatgacggattccagaatcacgggggcaaacaaagttaaaatcaacagtttattgtacacataatgcactctgcagcgaaatcgtgtaaccgtcagaggatgagaacccacgtcggaagccatgatttatttaccacgttacggtttggaaacagtcatgctcaaactgccttttatttcctacattaacaaaccacgttcttcatcgtccacgtggcttcgccagcgtcgccaagccgattgaggcaaacccaaatcaacgagcaccatcacggcggcaaacagcagcatcgcaacgccccagctgccataggtgaatgccaagttagttatgttcttggataacgtcccgttttcaacacgctgttgtcgttgataaatagcgtgtccaaacgcgctggaatttgtcgtcagtctcaacggaacaagtgacacactgaatgtggagtttgtaaccagcgtgggtgtcattacggtggttgtgctttgaaccgctcgaggaaccaccgttaagttgaaacaagatagtgttatatgtttgtcggtgcagttgtaacctttttgatagtaagtgccaccgctactttcagaaacgttataaataaaaaatgttttccaagaacagccaaacgctacacggtgtcctaatgagactcgcatgcttgatccccgtaaagtgcaccataacacgggtgtgcttccattctcgtaacgtccccactgggtcacattacagcttaacggtgccggaccgtgcaattcagcgtcttgacccgctgttctagttaccgtgctacagttaggcagtccattggatgtcacggcccagctcgtagagctttcagaggcacaaaccatcaaaatcagaaccagcgcgtatctggaaacccagactttattaaaaaggcagctcggcacgccccggggcgtgcgggcaaaagctaacatgttgagtgctacatatgtgcgtgagcgcgtattcaaacagtgagttatcaagcacaccccagcccacccgttcatcttagcatgcactacccgcaaaagtccctcccaccccgtttcagactctctgactgaaaacaaatatgcaaaagcaaaacactacacacagctggctaactagctacacggtagcgacaagacgttgatagcggtatttcagaggacgggcgatgtcccggagacggtctatgcagaaacgacagatggattgcggtacgcgaaacaggctggcgaaaagcgtcaagagtcctagcaggacgaagccggtgacccaggtggtgtggaaaatcaggcctccgtagaactgcttagtgatgatgagacgactccacggaacgagttcttcctctcgcgacaacagcatcgatcggtcaggaggaggcgcgatcgccagggacggtgtacgggtgctcacgctggaggtgaatgctgcttcgtcccttgatatagccttgttactctccgcctcggtgatgtcgtaacagcaggactcgaacgcggcacaatcatagaaacgcaaaccgaccaaccacacaaaagacaacatgagctttaagcgtgatctagatacacgatacacagcaaggccgggatctacacagtcagagtagcctagaaacatgttagcgccgtagggacgcttaacatttcaaaagcaacgtaaacacaatagctacagccacgcggctctgtgaaacttcacgtgcgatctttaggacacggtcaagttgtaacaagagtaatagaaggtgaaattcgcatcttcccttttgaaatagtactttccgctgttttccgtcgtcagattcagcaacgtcaagcggttataggtgcagttatacgtcaggttcgctacttcatatctgtaatgttgttcgtcatagttaccctggagtttcgggaagaacgaacaaatggacttatgaccccatcctaacaaccagtacaaaaagtcttccgttttgttctgaagacctcgaaatgtaacgttgccgttgacggtccctgagtaattagcgcaggtaatattcttgggaatctgacggtcgggagacttccattccacaggagcagtcgtcgtgctgattgaacaagtcgcaaaaacataataacagtacgcggcaagcagtaccatctgtaataatctccacgttctaagcatcataacgatactctttcagccttacaatcaaaatattgcactagtagtgacgataaacgatgcaaaaacaaaaaaaaaggacgttctacaatccgggtcacttttaccgtactcgggcaacggtgctttatagactcatcgcttaaggcgggatgtatttgcaagtcagcaaagacgacagtttcttcgccgagagaaccagcggctgcatcacgaggctggcatctgattccctgtgcctatttcactcttcatttatacatatccagacctcatgtgatacgaggatcatcttacggggaaaaacccttctcttatccagtcattgggtcccgtatcccttgagaattcctcactatcccccgagctggagcagaacaattccaaaccggatacgctacataccagccacacagggtgacgtttaccatggccgaagactcggtcgcgatccttatagtcgaagatgacaacgacgcatatccgtcgttcggcaccctacccgcctcgcacgctcagtacggctttcgaatactgcgcggcatatttttaattacgctcgtcatctggaccgtagtgtggctcaagctgcttcgagacgctcttttataaaacacgcagaaaatctgtgtgttatgtgataacatgttggtatgaatgtatactttccctgaattacgttatcataaactgtaccgtccaggggtacgctatgtgtcacgcgtgttctcatgcagcgcactgtatgccaatacacgggggtaacgagggaaattccactcgcagatctgctttgtctggagacggagtaaaaacacaacgacgtttaaagtaaatacaaatgaggcacataatgcaaataaagatgatacatagcagtattctattgcgatccttcatgacggagtggaaaagcggggccttacagtttttgagaactgcacggagtaatcaaattttatcttggagaaattagcgtcgatactttataatcacgctatgcgatttacgttgtttctagttcgtagtttgtgtctcagagttgccgggacgttaaagtggatcagaacgtagatcataattaccgtcaccacggcgactgcccaaccagcgtgagtggatacgtgggaatttgtttgtttagaatgacgtgaagacaccacggtgataatatgcttggtgctatttatggtgtagttacagttatcaaaataattgagtatttcatattcgttattagtagtaatgttacacgaaaggtcacattcgtaaacgtgttcagtataagcgcctgaatcgtttaatgttacattatataactgcagacctttagtttcgtttatgcagatgaattgcggggaacacgatgtgtttgtgtagtaatgtgtaacattgcgtagatatccgttccatccacaaagttcgcaattaccgtggtaccaaaagctggaataattacagggattattgctagcgtctaggtagactgtgtctccctgcgttactgtaatgggtgcttctacatgttgactttgcagaaaaagtcgccagtaaaacgcctttttttgttcatgtaaaagtatcggcactagagtaccaattaggatgattgcaaccggtattagtgcgactggcaataacaatttagtgttgcattgcatgcccatgtttttttgtttagtaacgactgaatataacgctttatatcataggttgttaacaaaaaaaaacggagacatgttattggttaaaaaaagtttattgatcagcatgttaagccttagtccaaaattcatctggatcatatttgggaagtttggtgtaatgcggctttttgggaatgcgatggctacccatgtacaacgctataagcgccactgataccactacgcctgcccatacagcatgaattcccaggggaatgttagctttctcaatggtttctatgatgctacttccaatggtgttttcagtgttcgtagattctttatatcttacagggcatgtgccaagagtgaataacgttgtgtctccaattaacaccgttacgtagtaattttcttcttgaccgttatcacggtgacgcctggtatattttccagcgttttttgtggttaagttgtagatagttagggaggtgtcgttgcagtcaaaacatatgtcgtgccgtggtgtggtttggtgatagttgcctaattcgcacattttatgcgtggggtactcataatgaatccagtctacattgtgccatttctcagtctgattgcatttttttagagttatgttgctaccaacgtatcctgttacgttgattacctcgtaactgcgatcgcatcttttatggactgtataattgaaaccatcacaagtaacggtccacgtaaccgtaaatcgccagtccattgcaatattagttttcgctcaatgggcattaatattcctttgaacgctgagtcttacagaatgttttagtttattgttcagcttcataagatgtctgcccggaaacgtagctcaatcttcatgttctgggtgatatcgaacaatgaattctgattcactgacggtgtcttgtaacatatgatactttttgttaaaggctcgtcgtgcaaaaaacagaactatgcaggccatacaaaccaacacgatggtccatacggtgcggcttctttgcgagctatgatagagattacgtttgtggtgatgtgtattgttagtatgttgacttcctttctctctatcttcattttcgatatcggtgttgtatctagggcaaacgaaagtagcattaatagcttcagtatgattttttggtgttactaataggtagaaattttcatcttcgtgatgtcctgtgaagtaattttctttaaaacaacgtctgctgtacctgccggaattggtgatatttagatcgtacagatgtaattctgtgttgttgcacgaacgacataagtcatggtacagtgaaggtctttcatgttgagaatgacatacagtgtgagaggtaaggatgcgtagccaataccaagattgggtatgtgcgttcttacgataacctagatgatgtccgtgtgtggatctattgtaatgtcgtatccaggcgactgaaagacagtcccacgtagaattaccctttatggtgacattactcccttctattcctgttgtattggtttccttgaaacgtatgattgttgtctctgtgtgacaagcgttggaagagttagtaaggttgtacgtggtgtatgttgtggcgctgcaatttgtaggccatggtgtgcttataagtgcattattagtggatacgttgtgcgaagtttcatctgacgtgacagttacggtgattgttgtgttataagatgatgtagcgtttgctgttacgttggtaaaagatgagatagtgttggtatttgttgaaatcaattctgtagtgacagccgtattagatatattggcaaatgatgtattgaatgtagaatatacggttgtgaaagtactcaagtcggaggtaacgttggtgatgttgccaatggttgacgcttgtgaggtgacagatgtgtgtggcgtcgttgatgtgttgttattcggagttgaatatatgttggttacaaaagtggtagaggcagtgttggatagcgtaatggatgcagtactgttagcagtactgttgcatgtaactttatgcaacatacaaaatactataattgtatacactgtttgcctgtatgtaaagttatcgcatcttcgacaggtgttacgcatcttttattccaaattcccgtccaccgtcaacaacaaaggttccgtatccaggtccgtccgcagatgttcaacgtcctgttctccgattcgttgcgatcgcagaaagcagatgaccagtgcgccaacaaagatcatcagtcccgaaacccaggcgcaatggagtgagaggccggaccactggcgttttaaatccgagataattgctcggtctgcctcttgggaatccgtgaccacaccgactctgcctggtcccggataaaagcatcgacgcgtttccaaggctcggcagaagctgcgtgggtggatgatgaggtagaaagcttcgacatcgccggtatactgatcctgtagaaggtagactcccgtatctttaaccgtaagattgtacagcgtgagattttggcgcgtgcacgtgaaagttgcgccaccctgacgcgtggtttctttataggcgtctgtaatgatgcaaagtggcggcatacgacgcatgtatctgctgtagatatcataacgttgccagactacgctgtgatggctagtgttaagcctggtaaccagcgtgcgtgtacggttttcgcaagtggcgcggtagttggcgagctttaggggttttttgattggttcgacggcattcgataaacttccctgagctgtgaataaaaacagcgacgtgactatgacaagcgtgagggagttgctgtaggtctgcatggtgcaaaacacgttctcgtcttcctcgttaaacgtcgtcgtcctcgtcctcttcgtcgtctgtgcccgtcggttcgatcaacggggagttatctttctgtctggagggtcggtatggaatccgttcgtagatgttctgctttttagccgcgtgttgttccagctttttgcgtgtcaggctccgataggccagacattgatctacctcggtgcccgtgttgtttttctcctcctcgcgcgcgtaaattacgaagaagaccaccagcaggactatcagcgtggccacgaacgagcccgcgccccaggccgagtatgcgcctagcatggtaatgggttctgtgacccggcatttgcacatcgcgtggcacttgctgccattggtagatgtactattcggattgcacttacatgctaggtgggtattttctgttttcacgagacagttggtggcgaccatggtttcagcgcagacggtcacgtagcttatcaagccgagtgctaaaaagcacaccgcgtgcattacacgcggatacatattaaaacaccgtgttccacaagcaccgcacacgtcgatcctccccgcacggtcttcagcccgcccatgacatgatctccctcacgttacccttcaacaccctgtagtactctgtctcggcttccggtccccatgtcctaatcataacaaaacaccgtggcactgtccatctccctgtctttttgcgccgccggtcccccccccaaatcatgtctctagatgccgccggccaccaaccggaggcacggcggctattggattctgcattggtgcgccgcgtcttggcctgcatgatcatcgtcatcatgattgccattagcatctggatcctgacctacgtgctgtttctctaataagaaccccggcccctgacggtaattttcctttcttctccgtttctcctcagctgccgtacgtgatgcctcacggtcatctccgacaggccctctccccgacctcctggacatgtgagggcttgttgctcctcctgggattgctggtgctcttctttcaccaccacaaccagtcggccgtagaaaggcgtcgccgcgtctcgttcatcgaggctgatcgactgccgcatgagagcgggtggtattcttccgatgatgacggagaccaagacggcgatgaggaaactggagagagccacaacagaaacagcgtgggactgtccgctgtttttagctgagactggcgtgcgacctgtaaaccgttactcgggtctcaagatggtttggaagttgtgattcatcttcctgtgggtgatacccaaccggacgcgagtgttccataaaagccgggcgctccggcgagaccatgccatcctcgccttcggacgccccgctcctcttctctctcctctcctccccgctgccgcggccaccgccgccgccgcccataccatcggcatgtcggccgacaaatcgcagctgtcgtcgccgccgcagctgtagcagttaacgccgccggcctccaggaggagatggcgctctgcgtcgtctcttcgtcccgtctccccctgtggtcgtgggtggtgcgagagtacacgatgggtggctctcgcctcggggggaccacagggggagggggtaatttattattcgtatcactgtaattttgtatcgcttaatttgtttagagccgcacgcttgacaacgccttgtatagccttatttatcccgatgacttttttctccgtacaagaaatggacgtcacttgagcagacacagtttcatcgaccacgacagtctcatgatctgactacctctgacccgccaacgagaaaaccgaaaagtaaaagatgaccgcgccctcggagtccttttttccttttcaatcatgaaaacaagaggcagccgagagaatgccagtaagagacgaccatcgcagacacagtacgatactcatcttagaacgaaccagcgaataaccatcacacgtacagcagaatctcatgaactagtcaaccaacgtcataatcttcacacaatcgtttttgcgaacttttaggaaccagcaagtcaacaaaagactaacaaagaaaaaccatcttggaattaaaaaaagtagcatcgttaccttatgaaccagcagcattcagtatatacaccagatataatatatttattaatgtatcctctctttctcctgatgtaattttgtttttgtaaattcaattgttgaaagtctctccctgggggaattgcatatcttattgatgaagaagaaatccctgccatatgtgttgtcaaactatcattatttctctatatgggtattttttttctaagaagcaaaagactagcagcagccaaaataaacctgatgaaatctttaactgaactcccggtggtctgtgtgtatatttctgttggtggtcggttgtctgaacccgggtgggttgttcggaaacggcgggacggggaaacgggtggaaacagcgtcgctatatacgtgacttttgatctaaacggacgtcgctaggctgacagtttacgaattgctaaacaagatggtcaggaacaaaacaagcggggctttgcctggtaggatttcctgtggaaacaataaccggatgtgattgtggctggtacataagctggttctggctgcaagcgcttttcactgcattaggtttggcgtttgcttttgcctgggaacgctatggctataacgggaaagaaccggtttggcaacattccattgtggggggggggtacttatagcgtgcctagctatgacgttgatatatgtggatgcggataatactcgtaatgagctaaaagcgacgactggtagtaatttgaccattacgcatgggaaagatccgttgacaactaagtggaaaaccgtttttggtaacaatggtgatcagtggttgtgcaacgttacgggtataggtaatgctactgtgaatagtaacgcaactatttgtgtgtcgagctgtggtcataatacgttggatttatgtaatttaaagtcgggagattctggcttcttcgatctgtctcgttggttcggtgaaaacatggatgaatacagtggtgatgtgtggcacttggaagtcagctaaatgttgtatcgcttagtgaattggtgttcttacagttttcatgtaataaactacgtgtaattcgttaaatttgtgtgtttgtttgttagtattctgcgtaacggtggaataaaattgcgttgacctagttagatttcctgtgtagaacaatgaccggacgtgcttggactggtacatacgcaggggctggacgtggttaccggtcactggactcggtttcgctgtagctgtggttcaacctgaacatggctcccagagctgctaggaaccggtccagtcacattttttggtgggtgggggggtactaaaaaagtgtttaatattggggtttaatgataaaatccaggttatggatatggggaaactgaatacctcgcagggtcgaaatcttaccatagttgatgatagaagacggttttccatcgggtgggaaagatgggatgacggtggatggtctctatgcaatgtgactagtaatggtacaacggtcgtcaatacaacagcccgtgtttcaagttgtttgcatacgtcgctagtagtttgcagtgtgacacagcagactgattcgttgtacggagtgggtcatcggttgaatgacgaagaagatggtgaactgtggagagtttcggtttcttaataatcccatacgacatgtgttcatttatatctgaattttaggatgatgactatagtataactctggggaacaaatatcatacgttaatcactttaagttacgccgttaggaaaagaaaatcagtccgaatgaagcatagtcagccgaatgatacagcaatagcttgtttacaacgtgttcttttttacattatgaacgtgccttgctttttatacacacatggagacagaggtccctcagcccttgtcacgacaactccctttttctaaaccgtatgtgctccaaaccgcatctcctcatcgtcacgtgaaataccatgggaccccttttcgtcacacacgtctttccgcttactcaacgcgtcagcccgcgctcggcagagctaccatataaaaacgcaggggtttagcggcttccccagatcgctgctgccccggcgttctccagaagccccggcgggcgaatcggccggctggtcggtcggcgctcggacggatggggagaacggcggtgacttagccgcccgtggccgggagaagacgggggagccgagatgacaacagcagtcgtggaagggtcgccaagccccggtccttctcttctgtctggtcgaatctcgttttcttttttcaaccgctctttttgtcacctttttatgtgagtttctcttccgcgtctcccggccgtaccatccacccatgcagcatgcacgcgtgtatgtatgcatcgcctctcctccgtcccgactaccatcagcagtaccactgccgccacccccagcgccaccaccgctgccgtcgccaccgcgttatccattcctcgtaggctggtcctggggaacgggtcggcggccggtcggcttctgttttattattttttttttattttttatcttctcctttccttaatctcggattatcatttccctctcctacctaccacgaatcgcagatgataaacaagagggtaaaaagaaaaaagctacagacatttgggtacctcagctttccgataactcgaagaattcaaagtcgacgattcccaacaagagaaaacagaacaaaaacaaggtcatttttatttatcctcatcgtcaacaacaactaccgacaacaacgaaacaccaccaagaatgtcaatccgcaagggtgttcctgccccctcgacgcgcctgtcgcgatcctcatggcgaggaccgcgatctccgtataggtagatgaaattatcccgtgtccggtcctgattccccgcatgccctgcacatcctgacgcgtcggtcagcagccaaacaatcataggaaatgaaccagaagaacaaaaagatcatctctctcggtgtatagcaacaccaacaacaaccgcatcgcaacatcttcatccgcaagacggaaagaaaacaacaataatgagaatgaaatcaccacaaccaagccagatttcacgtccatgagtttttattatattattatcaaaacgaaaaacagaaaaactgtcatagataaatataaaaaaaatagaaaccacaaacgactactagtactccaatcttagatgtatatgctcctagataagatttagtattaccataatcatcgaagaatgaaagacgacgatgattccttaccgctcctgccacccggtctgtatgtagagagagaagagagaaaacggtgaatccaagatccccgggtcggcgtcggcatgccgctgatcgcagtggccccacctcggcatgccggcgccgggcgaggaattgctcatgaaaaaagtatctttctgtaaaaaaagaaaacaatacatgattaaccgaaaagaaaccaacaaaaagaacccgagatcagtcgatttcgatcactacgataaacacatggaagatttcttgaaaaaagaaaagagaaagagaccaccttcccggcggcggacacgctcctctccgtcgccgttctgcaccatgattcgatcaataacaacatcatcatcggagaccatcttttaatcaatcagcgttgcagtagtcgactccctggacacgaaggagtcatccatttttatcctcgcacttcttcgctctcaaagccgcctttaaagttgaaatgaaaggatggaaacatggaatacagttttaattgcacgtatcaccattttactacaaaaagaaaaaaaaacaacttacacatagtattaccttaggtttacggataagtagagtgtaggcgtttttgaaacagttcagccaatgcaatcttgtctcggcataatcactctttctgcatataatagtagtagtagatttattcacatcaacacagcgaaaaactccagcatcaaagtacacctagagacagcccttaaaatatagtttgcagcttttagatgtacttacaccaaagaagattaccgtccttacgagaaaacagatactcggatataggaatcaagacagctctgcactgaaaacacactctcctgtcacgacaccgcgccacaccagaggcgtacgcgtgacttcatcgcaacgatccatcgtgatgtccctcgcagaacctaaaaagaccaaaaaaaaatcttggaccacagttgtcgattcttgaagacaatattctcgtgagaactttgagattcgcacttgaaacctcttaggatccacaaaaacaacaacctctgtatggaaaatgcgctattttatctcagcttttctcccaaacctcggtttcttcctattcttaagttttccctagtatatttgcctccttataagaaaagaagcacaagctcggtcgcacggattattccttctgctaatctattattttgttccttttttttttctttgccttcacccccttcactccctgtagcaacacagagtagtagacacaataaatgagaagtttgcatgcatttgccgtgtccgtggtctgttatagcgtgtggagtgctcgggatggatggacgtggggacggattcctgaggctacaaagatacgcggagacgtcgtggcgaggggatgggtttattggatatcggtgaagcagcgtggcggcgaaatacgcgatccctgggctggtagatccccctaccccgtctaccagggacgtttatccttgggacatgtaaatgtctcggccggcatccacgcgccacgttcaccgcgtcgtgcccagcgccatgtgcgggtcgtttcggcgtgaagttggacggcgtagtttcggggattgtgaaccgtggctgagggtgtagaagggataggaaagagcgtgtgatgtgggcgagtcgtagcatgtgggtgcgatgcggtggatatggtgggctggggtggttttgggcgtggagatgtggagatgggggtgatccggatgcgtggcaataggcctcgagcttgggcttctcccgcggatggacgttctaactgtacacggcggccgtggcctccgagtaaaaaaaccaagtgctgacgccagacagagacgccgtcctcggaatcgtgtgcgcgaaagcctgtgccgcggcagcgtacgacgttccagtcagcgaggccgtcgcgttggcgcgccaacagtaaggtcacgataggttggcggcccatggttccgaagcgtccccacatgcaccagcagtcggcgtcgaagtcgctcgcgctgtcggcccagtcgccaccgccgcggcggatttccgcgcgggggacggggtagccgagcgctgcgccttcgccaatgttgtgaagtagatgcgtgagttgatgttgattttctgtggaaaaatgagcgctttcctgagggttggcgttggggtatgcgtgtagttggggttgtgtttgagcgtagaggtgttggcgggcctgcgcgcaagcagcgtaatccgcggcgtcgagctccatctgcgtgcggtgttcttcgttggcgtgtttgtccgaggtttggataggcggttgtgtgttgctgtggtgtaagggtaacgtgtgttggtactctgggtgaagcggcgtggtgtgggtgctgtttgtgtctgtggctggcatgattgtgcggcatgtgtgtgttgaagtgggtggaggttaaataggcgagggtgagtccccgtccccgccgcaaaaggcccccgtcctcgccgcaaacacccccgccacccccgtccctcagcccgggtccgcgagtccccgttcccagcgtaatccccgtacccgcaacgccccggccccaccgccgtcccgcacaccccccgtcccccagcccggtgcccagcgtgcgaaaaaagctccgtccctcacacccgcagaaagatccctcagcgcggtgaaaccccgtccccagcgccgtgccgctgacaaagaccatgggacgacacgcacaggcagcgcgcacaaagcgctggtcgaaacacgccgcaaacgccgccccgcgctgacgcaccgcaaacctcccttagtccggtctcgcgaacaaatagcgtgggacgccacgcaccggtagtgtgtacaaagggaggcgtgctcacggcccgcaaacctccgtgagccctgtcccgcaccggcgccgttcggggtgtgtcgggggcgcggctgggtgggtgggtgtgtgccgggtgtgtcgcgggcgtgtgtcgggtgtgtcgggggtgtgttggcggggcgggtgcggctgggtgtgttggcggggtgtgtcagggtgtgtcggtcgggtgtgtcgcgggcgtgtgtcgggcgtgtggcgggtgtgtcgcgggtgtgtcaggggtgtgtcggcggtgtgcgcggcttcggggtgcgtgtcggcggccggagggaacaacaagtgtgccccggggcccgcgagtcccccccccccccctcccctgggcggccgcttctgcgtgtgtcctcgacgcgggttgcggcgtacttcgtctgttcctgcccccgcggtcccctaggcgcttcctcttttccgcccgtccccctggggacttcctcttttccgcgtcgtttccgcgtccctggccgtcgtcgtccccccctgggactcgctcgtcgtgtgtcccctgggactcgcttttccgcgtgtgttccgccgcggtcaaagacacacaacacagacgcgcgtctgcttttcgccgtgcgcgccgcacgccgcttttattcgccgccgccgtcccaaccgcaccgcagcacactcttaccaccgtcaccgtcctccacagcacacgcggctccaagactccaaatttcacccccccgctaaaaacacccccccgcccctcggggacccagcacacggcccggaatggatgtcggccgtccacctaggtgggtgcgcgctcgggaggcggctttgctttgcactccggggctgtcgcgcgtgttccttcgggtggctgggctgccgggtggttttccacggccttttagactgcgcggcgccaaggcggcgctagcaagcgccgtgcacgccgctgcctataaaagccaggtgcgtggcgaccgtagcacacggacaacggagacgtccccgtgtgtaaacggcgtggtcgcggacgcgggttgtgttgctatatagtggacgtcggctcgacgtcggaggtgtccggcggccatggcccagcgcaacggcatgtcgccgcgccccccgcccctcggtcgcggccgcggtgccggagggccttcgggggttggttcctccccttcttcttcttgtgtgccgatggcagcgacgtcaacagcggggactggtgcgagtactgcgggttcggcgacgccggcccacggcgtccaccgcgtagaaccccgcgggccgccgggcgcccctccgggtagcggcaacaacagcaacttttggcacggcccggagcgcctgttgctgtctcagattcctgtggagcgccaggcgctgacggagctggaataccaggccatgggcgccgtgtggcgcgcggcgtttctggccaacagcacgggccgcgccatgcgcaagtggtcgcagcgcgacgcgggcacactgctgccgctcggacggccgtacggattctacgcgcgggtgacgccgcgcagccagatgaacggcgtgggcgcgacggacctgcgtcaattgtcgccgcgtgacgcgtggatcgtgttggtggcgaccgtggtgcacgaggtggaccccgcggccgacccgacggtgggcgacaaggccggccatcccgagggtctgtgcgcgcaggacggactgtacctggcgctgggcgccgggttccgcgtgttcgtgtacgacctggcgaacaacacgctgatcctggcggcgcgcgacgcggacgagtggtttcggcacggcgcgggcgaggtggtgcggctgtaccgctgcaaccggctgggcgtggggacaccgcgcgcgacgctgctgcctcagccggcgctccgacagacgttgctgcgcgccgaggaggcgacggcgctcggacgggagctgcgccggcggtgggcaggcacgacggtggcactacagacgccgggaaggcgactgcagccgatggtgctgctgggcgcgtggcaggagctggcgcagtacgaaccgttcgcgtcggccccgcaccccgcgtcgctgctgacggccgtgcgtcggcacctgaaccaacggttgtgctgcggctggctggcgctgggcgcggtgctgcccgcgcggtggctgggctgcgcggcggggccggcggggccggcgacagggacggcggcggggacgacgacgatgacggcggggacgacgttgccggcgggggcgagcggcacggagacggaggccgccggcggggacgcgccgtgcgcgatggcgggagccgtggggtccgctgtacctgtgcctccgcagccatacggcgcctccgccggcgggaacgcggtgtgcgtgccaaacgcggacgcgcacgcggtggtcggggcggatgcggcggcagcagtggcggcgccgacggtgttggtgggtccgacggcgatggcgggtccggcggcgtcagggaccgtgccgcgcgccatgctggtggtggtgctggacgagctgggcgccgtgttcgggtactgcccgctggacgggcacgtgtacccgctggcggcggagctgtcgcactttctgcgcgcgggcgtgctgggcgcgctggcgctggggcgcgagtcggcgcccgccgccgaggccgcgcggcggctgctgcccgagctggaccgcgagcagtgggagcggccgcgctgggacgcgctgcacctgcacccgcgcgccgcgctgtgggcgcgcgagccgcacgggcagtgggagttcatgtttcgcgaacaacgcggtgaccccataaatgatcccgtcgcatttcgtgtttcggacgctcgaactctcggtctcgacctcaccaccgtcatgacagagcgtcaaagtcaattgcccgaaaagtatatcggtttctatcagattaggaaacctccttggctcatggaacaacctccacccccatctcgccaaaccaaaccggacgctgcaacgatgcccccaccgctcagtgctcaggcaagcgtcagctatgcgctccgatacgatgacgagtcctggcgcccgctcagcacagttgacgaccacaaagcctggttggatctcgacgaatcacattgggtcctcggggacagccgacccgacgatataaaacaacgcagactgctgaaggccactcaacgacgaggcgccgaaatcgacagaccgatgcctgtcgtgcccgaagaatgttacgaccaacggttcactaccgaaggccaccaggtcatcccgttgtgcgcgtccgaacccgaggatgacgacgaagatcctacctacgacgaattgccgtcgcgcccaccccagaaacataagccgccagacaaacctccgcgcttatgcaaaacgggccccggcccacctccgctgccgccaaagcaacggcacggttccaccgacggaaaagtttctgcgccccgacagtcggagcatcataaaagacagacccgaccgccaaggccgccaccgcccaaattcggggatagaaccgcggcccatctctcacaaaatatgcgagacatgtacctcgatatgtgtacatcttcgggccacaggccacggccgccagcacctccgcggccgaaaaaatgtcaaacacacgcccctcaccacgttcatcattgaaagtctctccagtccatatgttgtcaggacgtactgtcgttctccgcttgctgcgaagcccgttcttccgagtcgtgtcgctgcgtccagcgtcgcgcccaagatgggaatttgggtctcttcacgcgtagcctcctccaccacggctgctgatcgccgtcactaaggaccgacacggaggatgacgaggagcttctccccgactccgcggtccgcgaccggctacgtagcgcgtgtccctgccagtctccgcagttacaccatacgtcgtgagcagcgtgcacctgctgccgccactgggcctcggcgtgctcaggccacccgccggagcccggtctgagctccgacgcaggatgcgcgtactcaacgtgcgccttccagtccatacagcaacaccataggtcgtgcgagtcgtcggctacccgccgccaggccagttcccgcatgggaaggctggacacgccaaccgagaggtcaccgagcccggacgccatttcttcttcctctccgtcgctgtcatcaagcagccaggtcacctcctccgctccgcggtccgccggtctcgacggaccgcgccgccgtcggcaacacggaaaacagcacgccagcccgagccgctaaggccgcatgcccctgccgcccaactgaacacgcataccccgctcaactgcgttttgccacccctgccagtgctctcgctcgagcaccaccccgcatctcccaacc

SEQ ID NO: 7 - DNA, 234881 bp, Human cytomegalovirus
gaagctaggcgcgcctgtttaaacatggatccagacatgataagatacattgatgagtttggacaaaccacaactagaatgcagtgaaaaaaatgctttatttgtgaaatttgtgatgctattgctttatttgtaaccattataagctgcaataaacaagttaacgtcgacccgggtacctctagatccgctagcgctttagcgaccggagattggcgggacgaatacgacgcccatatcccacggctgttcaatccaggtatcttgcgggatatcaacaacatagtcatcaaccagcggacgaccagccggttttgcgaagatggtgacaaagtgcgcttttggatacatttcacgaatcgcaaccgcagtaccaccggtatccaccaggtcatcaataacgatgaagccttcgccatcgccttctgcgcgtttcagcactttaagctcgcgctggttgtcgtgatcgtagctggaaatacaaacggtatcgacatgacgaatacccagttcacgcgccagtaacgcacccggtaccagaccgccacggcttacggcaataatgcctttccattgttcagaaggcatcagtcggcttgcgagtttacgtgcatggatctgcaacatgtcccaggtgacgatgtatttttcgctcatggcctgcagctgtgttcgaggccgcgcgtgtcaccttaatatgcgaagtggacctgggaccgcgccgccccgactgcatctgcgtgttcgagttcgccaatgacaagacgctgggcggggagatccataacttcgtataatgtatgctatacgaagttatctaggaagctgatgcggccggcccttaattaatctttttcgccgcctgcaagcattggtgcgcaaagtcctcacccagctgtttccagctatcatctgcatctgtgcagtcccctgtatcgttgtaacaaacgggtctgtgcgactttgttctcggaacataagcttgttgtcgcggtgacagagagagaagggttttcgggtcacgcgaagaccgctcaccgggggtcggcaacgcacacatcaacagaaaaccgagacggatcaagaggtccatagtgaagaaggagcgatatcgacgtacttacgaaacggcgattatatatgttctcaacaataccgccctacgttgtatgatgtaacgtgtgacgtgagtctgatccaacactgaacgctttcgtcgtgtttttcatgcaacttttacggaccatgacaagcctgacgagagcgttcatcggggcatgaagtacgcattacataaactctatatatttgttacgatagaatacggaacggaggaggctttcgccacacctatcctgaaagcgttgcattctttatgataggtgtgacgatgtctttaccattcccacggctgctttgcgtgacgatgacattcatcatgtatttccattcacacataccttttgtgcatacggtttatatatgatcatccacgcttataacaagcctaacagtttattagcccttgacaggataggtcaaaagattatatgtaggttttccggtaaaccgaattgtgatgtttctctgcaggaaataaaacagcctggtacctatgaaacggacaatgcagtactgtagcagcgtaaccaagtaggtccacatgaacacgtacaaaattatggtaagccatcgtttttcgtgccacagcctgtagctgtcgtacatgaatgaggacggtctagggatccagggtacttgtaattgggggcgacattcgtaccgtccagaagacagtcgcacgggtttcagtgagatgagcactttaacgatgtccgcggtgacgctacgttttaccgtgacggtgagaatttgaccgtcgttttgtacttcatgaggcacgttatacaagccactggtatcatgaaggatgacctctgatgcgatgtgaggattaaattgtccctcaaaccgccaaacgctggtcatgttaccaccgtcaattacgcagctgacggtgtgaaatactacgatgttggacttaggtttgggggctaattgccttttcacaaattttattctgtattgcaggtcctgctgccactgcttttccgtgcggaaagtcggcacgtcttccgcacgtttagcgacgatagacgccaccaaggtagataccagaagcagctggatccgcatggtattaccgtatgtcaattagaaagttgaacggacacggttatcgttcctggcggatataagtatataaacgcgagttagcctttcccgtccgttttgtacacccgttccccacacaaatgacgaatacggcctttttttttataaaaataaaccacgtgtattatataaaaacatttacatagaaaagagacacacggatcaacataaggacttttcacacttttggggtacacaggcgtgccaccgcagataataagcgctggatacacggtacacagtcctggccagcacgtatcccaacagcagcaccatcgccatctgtatggcgatcacgaccccgagctctaagtgtctgtattcatagtgtagtcgtcgcaggttatccactgaattcccgtagctgaaataacgtatatggtaccgaggctggcaccacatgggtttgcatttggagcacggcaccaaatgcagagtgagatggtccaagtccgtgggcacccactggcgcaaacggaatacggcttcggtggtctccacgaggcactccggggcttgcagacggccccactttcgtccgtgacggcccgaccagccgacccgagccactatccctttctcgggatagaacgtaccctgtacacgccatacagcgtccaacacgccgtctttgacgacgcagctggcctgatagctggacacgttgttaagcggcggaaagcgaaactgacgtgccggcggagccacatagttcggttcaccgtgttgtcgcggttcgtcctccctatagtaatagtagtcgtcgtcctcataggggttgccggcgtgagccagcgttacccaacagcagcccaggccgacgaggaggcgcagccaccgcctcatggcggcttcgccagtcaatcgtctttagcctcttcttcccgtgaggtccttccggtggcgcggtgccgacctcggacccagggacgtatccacctcaggtacacacagtaggctacctggacaccgaagctgaacaaggctacatgtttcacaaactgcaccagtaccacatagaggaatgtcaggtagcgtctctccgcaaacagccgttccaagtctgagggcgttacccgcagcggcaaccagggcagcctggacgccggccggcaatggagcacgctccggttacaggcactgcaggggtaaacggttaacatcacgtaagagagtcgtgcgtccacctgtgggagctcagtttcgtaacgtagagccccgtcattttccagctggggtgcgccgaccttgaaatgggtcgcgctccgttcgttaccccaggtgccgtaggctctcggggccgtatcggagaagttgccgtgcacaagccaggcggccacgagtaccccgtgctggacgtaacattcggacacggaactggagacacggtagccggacacgtccccaaacccgcgagggtactggggcagacggacggacttgctatttgacaacggacagatacgagacgacgaggacgcagacgactcgtcgctggaccacgacaaccggagcgactccttggagcggctcgagagtacacttactgcgatcagacaccagtgccagaagaaggaacaggtggacggggaccacaggatcatagccgccggcaccgcggccggccgcaggaagccgcccggcgcgtcgtctgtgtgcgggagccgaaacaccgtgcctctttatatcgtcccgacgtgacgcgagtattacgtgtcaggggaaaaccccgtcatgacgaacgtgattcgtaagtgacgcggggtgctgacggggttcggctcgagaagtgacggagcgcctcacgtcagtatgatgtccgatccgcgtcagccccgacgtggttatggtcaccgaaacccacgtttatatggacgttgagaacagcgcctgaccacatgattcatcataccatttctcggaatcgggcccatgccgggaaagcacattccttttcagtaaacaacaatgacatcataacaaatcattttattcgcgaggtggataataaccgcatatcaggaggagggatcgggtgatgacgcaggccccgcaaaacagtccgaaataaatttttagtatcgccccgtagtcgcctagataccagaggtacgtcaagttcatcaaaacgcccatcggcgtcccggaatcgtataccgggcacacgaagcgttcataacaatcccgggaggcgagtgttagggtagcagaatagtttcggggtcggtttccttccggcgacgacagctccgtgggcagcagaatgtagagcgcctcggtagccgtcgcggtgccttccacgaggatgggctgccggtgcctttcgtgattttctccgtcgtgtagccaagccgaggcccgcaaagtcttaggcgaggggaattgtccatagactttcaccgcacccttcagtacatggttctgaataacacagccgcacgtgaagtaggtcggttctctcgtctcctccgtggctgccgccaccactcccagccaccacaacaggcaggtcgcgagagggttccggaggcttccccggcgtagcatggtttcgggttaaagcaaaaagtctggtgagtcgtttccgagcgactcgagatgcactccgcttcagtctatatatcaccactggtccgaaaacatccagggaaaatgtcggtgcagccaacctttcacatacagcccccaaaacacttgaatcactgccaccatcatcagcgtatactgcgccgacttaatcgtgagcgcgtagtacgccattagacggcgatcttcgaacaatagtcgttcgatgtcctctaacgagctccacagaggaacccaaggcacgaggcaccggggttcgcactctacataataagtttggcattggtggcagggggaaaagtagaacaacacgagttttgtgcgttggggaacacgatagtcccggagccagtagcgttttgcgacgaggctttcggagacgtcctccaccggcgtcggcactcgatccgcgtagccctccagcgtctggtagtacacccggggtgtcggcgtgggcacggacaggttcccgcgcagggtccacagagcctccagtcgaccgcccgatcggagcacgcagcgcgcctcggaatactctactcggtactccgaaacatcgggcagaggcggtaacggctccgtctccaccaagggcggaggttcatcgaaaagagtcaaggataattcaggcatactacctgcgaccggggcccagagggctaggataagcattacaagattcattctgtcttacaagggaaggctgttcccctgtctagactcaaaagctgtaaggctgtcttatagcatgtagtcttgcacgtcacggggaacagggtggtgatctagtgacgtcgggagaacacggtgttttagggtgcgggggacaaaggacagtacgacagattaggtgatagaaacgtttttttttatttatgaaaaagccagtgtgccgtgcggcctagggccccggcgtagtttggataccagatgggggccgtcaggggtactaccacgagcagaaacataataacttggtccatgtatagcagcatagcggtgcgtagcaggtcgccgtccgtgtagcaatttgacggtgagcgataaagcaccgttaatgtgtcgcggataagcacgatcttgaggccgtagatgaagctcacagtcagtgctaaaatgatgcgttggtatggttcccaggactgcacggcgatgaagagccagagtatgggaagcatgaagcttagcaaacagaggatggctaaccgtcgttgcatgttccaggccatgagccaggctaggcccgtacaccagacgcagagcatggatgacaggacataggcctggattaccacggtgcgatcgaaacacagcccgatggtggacacggatatcgtagtgagggtggtatataccatgaccagcatcagggtcccgggtaggcgccgacgttccagccagtacgcgtggcaacgcagagcgcagggtagcagtgtgctccagaagggcagtgtatcgcgcaggtagggggtcgtcacgcgccacggtatgagcatgaaaaggatggtagtggctatggtggcgctggtctggaacacgacggtgccgtagagacgtaccatccagagaaagtgttgaacgctccgcagggtgtcttcatctttggtgattacggtgactcgacggatcggcggtggtgacggcggcgacacgggtgggggtttctctttcttatggccgagtggctcgccttggtgaaactggatctgtaccatgacgggtgctcgacgaacagtcgtcggggctttaggtacccggcaagttttatagagaaagggggacgatgggtggtggctacgagccaccgccaccttcgcaatacgaggatctgaaggcggcaaagacggtcgtccagggcaggtgccagaggttgggactgagcacgatcagcgtgattttaaacatggtcaccagtcctacgtagatcagcagcgagccacgtaacgtctgagcagccggcagttcgtcgcggatgtaacgcgtgccgtagaaagtcacggtcatcataaggaagacgatggcgccgtagccgtagagtagaatacgctgatgatggaacacggtctggtcgccgataacccagagcgtgatgaaaaaaacgctggtgagcacccgtgtgcatatgagctcccaacgcttagcgcgaaagctgtccccaaccatgacagcgccggtgcaagctatccacagcgtgaggaccagtgtgtagtcgatgaggatggcgggcaggtcggagcaccaggtgtagaaaaccgtggtaacggagaggaggcctacgtagcccatggtcaataccacgtcgtcggggtgcctttcgccctgtatcaagaccaaacaccagagaagggagggggcaaaaaccagcagcagaggggaagattcatgttgacatatgttgtgggaatcggggatgcccagccaaatcattccgcagaaagccgtactgatggcgatgtgaaagaccactagggcgtagacccggacgaggacagcaaaacggcgcagccacataaggccgtggtgcagctgcaggagagaagcccattgcggcgaatgtagcgacggcagcggcgggtccatgaggcgggtgatgcacccgagtgaacgggtgagcgtctcggtggagtcttcttataaaccagcggagctcaggcagtcttgctctggagcgtcgcagtggtggtgttgaggatgacgctgagcgtgccgttgtcaatccggtaatgatgataggtgccaagcttggccaggtagctgaacatttggtcccagcgtgccgaccacaccacgggcgtgagcatcaggagtgtggtgtgataaatgagtgtttcggtggcgtaaagtatcagcgagctgcggatgatgtggctcacgggcattttggtggcgatgtagcgcacgtcttggaaaagaacggccaggatgcagcccacgaacacggtatagagacacagcagagtcttatgcaaccaggtgtaagtagaagccaggacgctgaccatcaccgtcaaaagtgtggaggtaaaaagcgcgtcacgccacacggagctgagacggtgctcccaagccacgccgttgcaggccacgaacaacgtccacgttaagatgaggctggaaacgccaatgggcgctgtggcgcacaggttgagcccggcggtggtgaacgacagaagcgccacatacagcgcaaacaccaggccgttgctggggtgtctatgatcggtaagctccagcgcgcccagaaccaacaccggtgtgcagctaagcaataacggcgaaggatcgtcgcggcactcgtagcccagcgaggggtaacccagccaaaccagcgcgctaatgagcacgctaaaagcggtttccagcgtcagcaatccgtagacacgcatgacgatcgcggtccgccgtagccaacacaccgcatcttcggaagctgtggacgctgtttccgaataccgggaggagatcgtgcttccctcttccaaggatcggaaagtagcgtccgtcgtttccgcagacgcggcttccctggtacgctccgtttccgacgacgcggtttcccgctgcgtggaaactgtctccatgtcgggaccgcagcgcccggcggcgtatccgcaaggtctcgaagctacagcttgtcagaggaaaagtaggtttgcaaaaaggtgcgcagggtcatgattctcagcaccatcagcagagtgaaaaccaggctgagaaacaccttgacggccgccaaaagcgcgcgttccagcggcgtctcgtagcgtacagccagggccgcttcgtggaaatgcgagacggctagacaggtaatgagcacgctgaaggacaagacgatcttaaagcaccaggaccaaccacgcctcaagatgaccaccacgattgccgtgaaggtcaacgtgatcaaagcatggatgaccacgatctgacggcggacggtacgttcgggagccaacaacgctacgccggtgcagctgagaaaggccagtaaggtgaacaacgcggccgagatgaccaacgtaccgtccaggcagagacatatcacgatcaacggcggcacgtgaagcagcgtgtaaaagagcagaacgccgatattgctgggatgcgatgtttcgtaacagtgaatgaagatcaccgacgtgacgggtatgataaagacgaggctgggcgaggactccgtgagacacagacgggaatggtgaaaccacgtcgcgggcgccgcgtagcagaaggcgctcaacaacgcggtcaagccggccagctgccaacccacggcgccataggtgtgcagcgccacgcggcaacagtcgacccaagccagactgcgggtcgccagccgggtctcttggatcccggggggcacgtagatgaccgtgccatcggtgggtacctgaaaccctttttctcttctcatggtgcgctgcgttctctggaaacggctgctctgtccgaaaaccagttccgaacgaaaatctagggcgagagggtggacaacggcgtcgacgacgaagcatgggacaggtcgttcggcgttaacgtcatcgcgtcggacgacggtagttctaagagacgtagatcgctcagcaggtcctgacagttgcggattcgcaagatcagaaaaaaaagggaaatgaacgtaataaagagctgtagcgacgtatgcgctacatcgcgtggcataagaacgtgacggacgaaaaggacctgctgcgaaaagtggccggcaaagataaggcccaccgtgctgtagaagcccaaaagcagccgcaggggccaagtccagggccgcgtaaagacgatgagaacgttaaccagaaagaccacgacccagacgccgttgatgagggtaaattgatcggacagggtgcagttgtcgcgacagatgaagactacttccgcgcagagcaaggtgatgaccaatgtgagcacaaacgacgtcaacacctcgcggggctcctggcaggcacacgtgacacctagcgccgggatgtgcgccaggaggccggcgagtaatagcaccagctgtcggaacggacgacggcagcgcgggtgccggtttcgctgagcgagaaccggtcgctcataacggaaatacacgaagagcgcggaggccacaggcaccaggaggagcacctcgggcgcccagacgacgtgacaaggaaagcctggacgcgacttaagagtcgctgtagggaagaccagagagaagctacccaagacggccaccgccgcggagatttggaagaggagcaagccggcgattcggacgacaacctcgaagcgatgcacccagcccagcacggccaccacggccgcttcatcatagtcgtcgttgttgccgctgtcgaacagccgccgaaacacgatctgtcgctgggtcgcggtgggaaagcgcagacccatgacagccggaggctatatgaccgcgcgtctaaggcgcgagatccgtggggggacttttagatgtttgggcggcccgcggttctaacaggcttgattggtggagacggccggcgcggcgggtgggggaaacgacgagtttttccgttacgccatggttcgcgtgaggtttctctgtacctcccgcaaaaggtcacagcccgaaatggaggccgcgttggtggccccggtggcgcgtgacgataaccaggtcatccaagtgatgagtttgtctaatgagtcctcggtggtgaagaggataagaatgagcaggtacaagtacaccaggttctcatagagacacaaggtgagcaggtcggcctcggaccacgcgatctcaaacaggcgtgtggtgtcaaagaccgtaacgaccagcatgaagctgagcgccatggcgtaatagcccaaaaaaagtttgtgccccaacggtacgggctgcaggtaaagtgcgatcaagaacgcgataacgccgatcacaaacagcgtgacgatgacctgccatcgacggcgattatggccggctagacccgtgacgcagctgcagaggctaaaaagcacgcaagccaagaggcccgagaaggtcaccagcgtagaggaggagcaggcgctggccacgatcaccgaaagcgtcgtgagcacgctataaatggtgagcaggcccgggctcggcggcgacgtaaacgatccttcatcgcgtttgccatgcagcagggccaaacagatggtgggcaccatcaaactcaagggcggcataaagccggtgcaacagagaaagacggtgcctttaagatgcggaaaagccagcaccaggcccagacagagcaagaaggtgcaggtgccctgcacggccacggtgctgtagacccgcatacaaagtaaaaagcgacgtacgtcgttcgtcgagacggaggaaatcataatgactccgcgcgagggtcgcgggggtgggggcgcccaggccgtcccggtggcctctgagttcggagacatgacggcggtggctatcaaaaggcgcgtatgagaaaccgtttatagagtgtaatagaatcaccgtcattcccacacggcgttcccccataaagtcacgtcacactcgagtaagcgtgaaaaagctttattattgaataaaaaacacgagtacaacaccgagttgcggtgtcctgtctactgggtgggggaggtttatcgtctgtctctagagggaaggtggggaacgtctaagcgagcgggagcgtgtcatctcccccatctttttacaacaagctgaggagactcacgccgtcgatgcgtccgccgtgtttctcggcgtactgctgcacccagacgtggccgctaaagatggcgacgctcatgtttaggagactcatgacgatggtgtacaacacgacgctgacacagacgctgtttttagacagcgttccacgctggtagatgagatccagggtctcgtaaataagcacggccgaagcggcggtcaccaccaggacgtagagtccgctgtagatcttgctgacccacagcacgggcgaaaagtaaagcaataggtaaaagacgatgacggaccagccgtagccaatcccgatgactttccagcgcgtgggattgttgccggccaggtaggtgagaccgctgcagagaacgaaaaagaccatcaccagggcaaacgacagaccgatgacgcgcctttctccgcaaaagcccgtgcacacggtgatgccggtgttgatcagcaggcatgccaccgtgagatgagcaaaattggtggtgtgtgggcgaaactcggcgaaaccgcgtagcatggccagcgtggacacgggcacgatggaggacagggctggcactatgccgttggcgcactgtccctgcacatcggggaaggcgagccaagccagcaggcagaccgtgagggtacaagccagctgccacacgagcccgtgatagacctccatgagcagcttgaagcgtttcaaccactggaagagctgctgttcggccaccagcgcgtggctgcgatggagcggcacgatggtgaccgtcggcgactcatggtgttcggaaaccgaggcggtgtcgcccatgctgccgcttacgaccgctgtcggtctaaggtaggcgtcgatgaaacagtccgtcttatcagcacccggttaccgcggatttgattgacgtcacgagtgtggtcaaaccgtggcggcaccctgtatccgacccgtcgtcatgggctccacaaccagagcctcagaagatggtacatgccgatgaataaagccacattttcgacatagaggcgtagcgagggctgaaaactctccgggaaagaactctgacaggtgatcagggacagatcgtgaattagcatcagcgtcaccgtcaacagcgtcgtcgcgtgtaaaccgagaaagaacggggtcgcggcccgcagcagccaaagtcccagcgccgtagcgcagagcagagacaggaccgacggtagccacagccgccggagagacgcgccaggatcgcaacccaaaagcgaggcccccaggcagccgagatctaccgccagggcgagaagagccgcgccgagaaaggcctgcggcgacggctggcacatcagcaaggtcagaaaggctagcgcgtgcggcaggcagtaagccaacaggagtgggagtttgcggggacaacggtcgatagacggaccgcgtagcagcaggaacaggcagccgacgggcacgacgaggctgagatgagaaagcggcggtgggtcgtcgtcccgtccccgctcgcatagctcggccaccggtggcggcatgagccaccagctgagcacgctgagggcgacggtggcggtaagctggaaggcgacgaggacggaggcgcgcagccataccgccagcctctctaagtaggggactacctcctcgacggtccattctagcgggacgacatgaagcatggcgacaagcgcggctgctgtgaaaatgagcgcggttttataggcattaggacttcccgatcgtactggcggctgtcaaagtcccgttgtccaaagacgcgccgtccgaaagactaatccaacggggacccgagagcatgagcaacaacgtgagaaagatggccatgctgtccaggtagagacagacggcatgacggatgcactggttaggtgggcagaaaaagatgaccatgagactgtcgtaggccagaatacccaaaaagaagctgatggagaaggcgcacaacgtcaccactatcttctgcagccagtcggcgtcgcttagcagagcgagcgtgaggaacgaaagcagcatcaccacgtagacgcagctgatgcatttccaacgacgtcggtcacggccacctagaaacgccagccccgtaaaggagataaacaacgccagggtcatcacgtaggaacctactagtacgcggctttcagagcacatttggaagatggccgccgtcaggctgttggccaacagatagatgaaaagcaccgtggcgttactagggtgctcgttgcccaaagtgtacgtgatgaacatgcagacgatgggcacgagcacggtgagaaagaagctgtagttctcgacgcaaaagttgcggttttgtgggaaccccaaccaaaaaacgcttcccaagccgaagctgaaagccaactgaaagatgaagatggcgtacacacgcagccatacggtgaactttttgaaccactcgagagcctccatgcgggagagcagcagcgcgttagcctcctgcgcctgcatggtggcgacggtctcggcacaaagccgctgcggcgcacctacccttctcttatacacaagcgagcgagtggggcacggtgacgtggtcacgccgcggacacgtcgattaggagacgaactggggcgacgccgctgctgtggcagcgaccgtcgtagcgaccgtcgtctgagcagtgtgggcgctgccgggctcggagggcatgaagtagagcacggagacaaagaggtacatgaggtccatgtacaagcagagcgcgcccgggatataactctcatactcgatgtcgtgcaggatgtcctgcgtatcgcacaccaccgaggtcacgatgacggccaaaccggctatcatcaccaggatctcacttaccgcctcgggaaaaagagaaaatacggcgaacagtaagagaatcagcgtggatgcgcccgtcaatagggaacgctgtaattccacgtcgcgggcaaacagatacgtagcgagcgtaaggaaacaaaatagcgttactgtggccaccatggcataaatgactgaacgatgactaaaatggaagcctgacgccgtgacagccacgctggtaagcaacgtgtacgtcagtaagatccatacgtttttgggaaagttgggctcggcccaacgcaacagacctaggcacacgatggagatcattaagcaagacagcgtcagacgcacgctggaaaagagctgctccagccggtgcggcaacaccagccagcaaaaggcgcagacgctcataaggatgaggcattgcacccagataaggatgtagatgcgcagcaggaagaccgaccgggctatctggacctgaccgcggagcgacatggcggcaacgccggcggttatcgccgagattcgtctaaatacacgaagcgaactagaaaacgcacacacgttatttgcaaaaagaaagcagctgccggcttattattttattaaaaatttatctgtgcagaatcataagtttatgatgaataaaaacggggaaagggaatctgcttttagggacccgggtctggtccgtcgtctcccatctggtcgggttcggggatggggacctgtttcagcgtgtgtccgcgggcgtgcatggcttttgctcgccggccgcgctgtaaccaggcctctttctctgtggtcggcgagtcttccgacgggtagggagtctgggagtccatcgcttcaggcccaccgctcgttccctcgaccgtcgtgtcgtcctcgttttcgctattacacggggtttctggagtatcgcctatacggttggcgattctccgggggtggccgctctcgtcctcgtcgctgctatcgccgcccggtaattcgacgccgcattcgttgtacggagcgcggcacatgggcggcggaaagaacttgggcatgcgaaagcagcgttgtccatccacggtctgcgtggtttcatcattatcctcccataatcccccctgtagcgccggcagcgtttcgacgctgtgagaggggaaggcccagttctggttgtcttgcagcgcgcccgtgggcagtaggtccgtgcggccccaggcgctgctgttgttgggtaccttgtcagtgccgcgagtaggtcgcagaaaccagtccagagcgctctctagctgcgagcgtgtgatggtgcccagtgcgccgtgccagcgcagcacgtctcttttcagcgtgtggtgacagacgggcagctcctccaaccgacactcgccgcgcaatccgcggtcgaagcggcagagaccacgcaatttaagcagaccgcacttgagaaacatgtgaaaattatcggcaatgcgatacaggtctgagtcctcgatcttgtgtaggtagaccacgccaaacttgtcgagcagcaccaggccgctgggcacaaaaggcccgtaggccaggtaatagcccacgaggccgacgacgtaccactcgcagcacaagcgttgacgaataaagttcagaagatcgcgaaagtccgcggccggcatgtggtcaaaaggccggcaggcgcgcaggccctcgatggagcccagcatgagcaacggctccacctcggtgcgacccggcgtgcggatgaccaggttgagaccgctcatttcgcgggccgtcttggccacggccgcagcgtcagtggggtcggtgcagaggaatttttgcacatgatagcgcggttcggtggtggcgaacggcgtttgtgggtgccgatacacatattcgcaccagagtaggccgttcttggaaaaggctttgatatcactggccacctcgtagagcccgtcggtctcccagtcgtagacgtagacggtgccgtaatgacttagcatgagcacgcagggcagttcctgcgcctgcttggtgtttcgtgttagatcgctgtcgggtggacgcacggctagtacaccgacggcttccagggtgtcatcgcagcagagatagtcggcggccagagaacgtgcgtaaatctgcgggatggcggcctgttcgcgcatcactaggaaccagttggcggggttgcgcagtgctacggtggttccttggtggcgctgcacgtaggttctcagcgccggaggatcgtactggcgcagatagaggccttgcagcatcgataacgtcttttgaaagacggtgtttctaaattggaaaacgccgtagtcgcagcggatagcatcttcgcagcgctcgtcgcgctgtcggagataggtgccccaggcttcggcggcggctttggtgagtagggacatgccggcggagccgtctcgacagcgagtcggataaagcgcgctgcgcgaaagcttaatataggagcagcgtcagacgaatcgcggctggtggcccggggggtgggacgcgccgcctacacaaaatgctcccgaaaatcgaaactcttgacccactccggagacaaatccgtattcagattgatgcgtcgcgcttccacttcggcttccgaaacctcggcctccgtccggtaggcgttaacaatacgctgacccaggtgccaacgctctttctctgccaaacgccgttgctcaaaccactcgtctacgtccttgaggtcaaagacagtgtcctcctcaaggtcaaagcctaggtcttcccactcgtcgtcatcgctctcgtggccggcggccatacgcgcggcaaccgcgtcttcccctcctcttctttcaacgttgggtaccacgttgttttcttcgggttccatgggttctgcgccactatcgtcatcgtcctctccctgctcctcatcgtccgccaaggcgtcgtggatcacctccaggttctgattgtcgggtacgacgtggttatcttcgtcgtcgtcgcgtggcatgggcggcggccgacggcggacgaccggcatggcgcggccgtcgtttccttcgtcttcctcttcaccgtctcccaaggaacgcggtcgacgacgttccgcgaagtcgccgcggaccacgcgcgcctgccaaatggtaaacgcgtcccaaccgtcccagttattgagcatttcggcgcgaaaacggtcgcctcgacagagccagcgaaactgccgcgcgtagtcgcggtctacgccgctgtcgaacatggtaaagtgcagacgcgccgcctcgcccatgtgtacgcagcctccattgcgttccagcctggccgcgcgccgcagaccgtgttcgtagcggcgacgcacgtacaccttcatgaggccggcgcgaaaaagttcctctaggctgtcggccagacggtagatttcaccggctagacgctgcaggggcggcgagcggtccagatgcgacttgacaatcaccacgtaaaaacgacagaaacggtcgaagatgatgaggaaggacgtgtcaaagaaaccaccggcgcggtaggagcccacggcgcctagcaggtaccagcggcaacgcagttgcagcgtgacgtacatttcgcactcggccaagcgggcggctggcgctacctcgaagggccagcaatccgtcaagcagccgaaactggtcaggagtttcaacgttttggcatggcgcccaggtgtgtgaaagttcacgtcgcgtccgtggtgttcgccaacgcaggcggccaacgcgtcggcgtcatgagcgtgacgcagcagcatcgctaccacgtcgtgcggtacccgcgtagcaaacggcgtctgtggctgacggtatacggcttcggtgtacatcataccgtaacgtgccagctcgtccagatgacgcgcgcacagcagcagaatctcttgcgagggttcgtagatgtagaggcgcgtaccgccccccatgcagagcaccagctccgtctcttcgtagtgatcttccaccatgatcacgcacttgcctagcacgataaggcgttcggggcaacaaatcacgtcgtccagcagttggtcgcgcagctccggcatggtgctgccaggccgcacctgcaggaaccagttgtgcggaatgccgagcgacaacacctggtcgacgtggttacggacccagtcgcgaagcacgtcggcgctgtactggcactcaaagatgccctgaaagtcgctcatgacccgcagaaaagtttcgtagcgcgtgtggcaatagaggaattcatcgtttcgcgtgaacgtgggagctccgtcttcccaacgtgtacgccacatgtcaaaagaggccgccagctagacaccccagaaaagaagcagagaaagagagttctttgtgcgacacgttttattccgcgtcctccgctcgacgctcaaatctggatgtactcgcgcacacccgtcaggctctttaagggaaaagggtccgagtacgtcactaaccgcgactgatgcaccagggcggtaatcacccgctctgcgccctcgcgcgtcgacgaacgcgtcgtcaccaggcagtgcagccgcgggcccgtatcgtcctgatgaccagcggcctcgcgctcggctgcttccacaccgacaatgtcgggatccaacacgtagctctgcgagttggtgtcgtagcggtgtaacaccaacgtgttggggtccagacgctcccacgcgccctcgtgcgggtcaaaacgctccgttaaacagagccagtcatactgctgctgcagaatacgccgctcgcgctcgcgtcgctcatcgggcaacgcagcgtcttcgttgaagagaatgtcccgcttgtggtctacggcacgctcgtggtggtgcgggcacagatgacggtgttccatacgcgtctgacgctgacgctcgcgttcgaagcgccggtgtcgaaagaccattttcagcaaccccatgcggaaaaactccgtgatggtgttggcaacgcgccgcacatagtggttggggtcgtccatctggatggcgtacacggcaccgaaccagtccagcagtaccagcacttcggccacaaagttgcgtcccggtcgcggacgtcccgtcacgcctagcacataccacggcgtggccagattagcacggacagcccaccaccaacgacggctctccacctcggtgagcgcacagaagggccaaatgcggtgtaactgctgcaccgttttcatcagccgcataatcaccgtaccgtaacccggtgtatgcaacttcacgtcgcaacccaggattcgttcggccgtggcgtacgagccctcgggcgtggtgtcattgagaaacaaaacatgcatggtacgcgcgcccttagggtatcgtcgcggaacaggtaccgtcattctccgcagagtggtgtgaatcacgtcgcgatacgcaatctccgaacgcgacacaccgtaacgtgccagttcatccaagttgtgcgatactaacaccatgtacttttcacgagtgtcgtaggcgtagacgcgagaaaagcgacccataaaaaccacgtacggggtagccaccatgccatcatggtgatcgcgacgtggctcgggcaacaaaataacagcgtatcccaacggcgtcagcggctcgcggcaacagatgagctttgacgccgcctgtctggcggcggtaatgatcccgtcctccgtacgtaacatcacatgccagcccttggggggacccaaggacagacaacgtccctcgttacgatgaacgtaacgcgtgatttccattggctccaggcaaaagaacagttccttaaaatcccgcaacacttgtcggtataacgccatgggatcctcggccgccacaggcagcgcggggagctccggcggcacaactgcagcgccgtcagggccagaacccgcagccggatccatcattacgcgacactctcagccggacaaccggcgtcactgacagaagccgagccaaatacagagaaagcaacgctacaccgtcaccccgctcccaagcgccgcggaaagtgctccgatttttcaccgtcgttcgcgacgttgatttgcctcggtctgagaaccgacctagcgttcggaccggtgcgcagaaacagccggcggtccgagccactgagcggttcacagccccggccgccgatagttaccggagagacgttcgagctgcaggtacatcggcgctccccgcttcgccaccccgcgcccgccccagtttatactctccgacgccccgtccaacgcgcctgtggagggccaatcggaccgcgggagctctccaagtggatgacaggcacagccgggtgcccgaccgtgaagagccctcatccacctgaacagaccgctaaccgaaggaccccgagtcgcgtccgtcggtcccgacgtccgtcgccatctggctccctgctgttggctacctctcggatttcaaaaaagagcacgtgccgatgacggtgcacaggaaagagccaaagtgtcacggcgtctttttttatttgtattcctttcctgttttgtactcgtaaactgttgacgttgtttttacatccaaaagggcaagtaagaaacaggatgaggcatggtaggtttgggcgtggggcggccctccagcacggcggcccgggccgcccggcgggtgagcacccggcgttgcgccgtatctatcttgtgtttcttctgtgtctttttcctatcttgttccgcgacggcctctttcatcacgttcagcatgcgttcctcgacgccctccagggatcctggggaggagggagtcctagtgaggcttccaatgttgttttgtggattttcggtttcctcttcttggtcgtcatcgtcggacgtgtcgtcttcctcttgatcctcttcttcgtccgagtagtagacgcatagtccctggttcatcaggctgggattcatcaggttctgacggggaatccgctgttgtagacgtttaaccgcccgttccaggcgagagctcatgccgcaccagacgctgtaacgccgcacgggcccgtagcgggctgtttgttcgcgtacatgatcgttgagctcttgccaatattgtttggcacactccagatcggaggtttgtggatagtcgggtcggatccgcggatcccaactgacatcggcggtgccagagacttcgtccagactgttacgcatagagcaccagtcgggtcggacgataaacctgtccttgcggattaaccatttataacgtagttcgtgatggcgtgtagaggcccgtacacgctccacggtcccaaagcggtcccagaagggaaagttttcgtgggggcagcgacccggcacttccaaacgttcggcgtcgtccacggcgtagtggaaacgccggccggcctggtaaattttgagcagacccacggttaacaacatatccacgctgtcagccaaccgccagatctcgcgccgagatacgtcaaaatagaaaaattcgcaggctcggtcgaccaggatcacgaaatcggcgtgaaaaacgccggagggtagcgactcgcccaccacacccattatcatggtttcacagcataagcggtccacaaagaacttcaacaggtcgttgaattgctccgtctccatacagatgaagggccagacgcctttgaggttctcggcctggccgcagagcagcaacggacgcgtcatctcgcctggagtgcgcagaggcacgcattcgccgcgataacgacaggtcacacgctgcagttcgctgatgctgttgtcgtgcaggcgaaggtcgcagataatatgatccggttgcgtggttagcagcggcgtgcgcatttgctcgccgtagatggcctcgcagtgcaatagcccgtgtcgtgcaaaatcgtccagactgtgcgccaggtagtaaagcaccccgcgatcgcggtctagacaccacacggtttcgtaacgtcctagcagaagcaccagacgggcctggctaggtggctcaatttcctctacatacacgaaaaagtcgtcatcgtccgagtcctcgtcctcagaagaggaccgcggcccgtgtactctgggcaacacggtggtagagaactgcaggacgcccagagactcgagcgactcttcgcagcagatgagctgaccccagggcgtttctggcccgtcggtgacagccgcgctgccaaagatgtcctcaaactctacaaaatctagacgccatccgggtggcgctgaaacgggaaggctaatgttcatatcagcatagctacgaactaagtggcggatgtcctgccgcaagtcttggcagagaatgagctttcgtaaacccttgagggtcctccgaacaacggccccagacgcgtagcgataggactggcgcatggtgccgcggcgtggagcggcacttggcagcctattttatggagtttcttcagtgacgtggcttgttcacgtcgttcgtgggctgcggttggcagctccggtctgtaaaccacccgaaaagactgacatcgacgtcaaagacccacgtaatttggaacatgtgcgaccgcaaagtgcgtcagaataacacgtggctttaggacataaaaagtaccgtgaggtccagacgtggtttttgtgattgacacttacaccaggtaagccaagggacggtgaaactgtatgtgaggaacctgggtgcttagacgactaacgtgtaatgctttttacaggactgttcgacaggtgatagtacctgtaaggtgatgaccacctctacaaataatcaaaccttaacacaggtgagcaacatgacaaaccacaccttaaacagcaccgaaatttatcagttgttcgagtacactcggctcggagtatggttgatgtgcatcgtgggcacgtttctgaacgtgctggtgattaccaccatcctgtactaccgtcgtaagaaaaaatctccgagcgatacttacatctgcaacctggctgtagccgatctgttgattgtcgtcggcctgccgttttttctagaatatgccaagcatcaccccaaactcagccgagaggtggtttgttcgggactcaatgcttgtttctacatctgtctttttgccggcgtttgttttctcatcaacctgtcgatggatcgctactgcgtcatcgtctggggtgtagaattgaaccgcgtccgaaataacaagcgggctacctgttgggtggtgattttttggatactagccgtgcttatggggatgccacattacctgatgtacagccataccaacaacgagtgtgttggtgaattcgctaacgagacttcgggttggttccccgtgtttttgaataccaaagttaacatttgcggctacctggcgcccattgcgctgatggcgtacacgtacaaccgtatggtgcggtttatcattaactacgttggtaaatggcacatgcagacgctccacgttcttttggttgtggttgtgtcttttgccagtttttggtttcctttcaacctggcgctatttttagaatccatccgtcttctggcgggagtgtacaatgacacacttcaaaacgttattatcttctgtctatacgtcggtcagtttttggcctacgttcgcgcttgtctgaatcctgggatctacatcctagtaggcactcaaatgaggaaggacatgtggacaaccctaagggtattcgcctgttgctgcgtgaagcaggagataccttaccaggacattgatattgagctacaaaaggacatacaaagaagggccaaaaacaccaaacgtacccattatgacagaaaacatgcacctatggagtccggggaggaggaatttctgttgtaattcgatcctctctcacgcgtccgccgcacatctatttttgctaattgcacgtttcttcgtggtcacgtcggctcgaagaggttggtgtgaaaacgtcatctcgccgacgtggtgaaccgctcatatagaccaaaccggacgctgcctcagtctctcggtgcgtggaccagacggcgtccatgcaccgagggcagaactggtgctaccatgacgccgacgacgacgaccgcggaactcacgacggagtttgactacgatgaagccgcgactccttgtgttttcaccgacgtgcttaatcagtcaaagccggtcacgttgtttctgtacggcgttgtctttatcttcggttccatcggcaactttttggtgatcttcaccatcacctggcgacgtcggattcaatgctccggcgatgtttactttatcaacctcgcggccgccgatttgcttttcgtttgtacactacctctgtggatgcaatacctcctagatcacaactccctagccagcgtgccgtgtacgttactcactgcctgtttctacgtggctatgtttgccagtttgtgttttattacggagattgcactcgatcgctactacgctattgtttacatgagatatcggcctgtaaaacaggcctgccttttcagtattttttggtggatctttgccgtgatcatcgccattccacactttatggtggtgaccaaaaaaaacaatcaatgtatgaccgactacgactacttagaggtcagttacccgatcatcctcaacgtagaactcatgctcggtgctttcgtgatcccgctcagtgtcatcagctactgctactaccgcatttccagaatcgttgcggtgtctcagtcacgccacaaaggtcgcattgtacgggtacttatagcggtcgtgcttgtctttatcatcttttggctgccgtaccacctgacgctgtttgtggacacgttgaaactgctcaaatggatctccagcagctgcgagttcgaaaaatcactcaagcgcgcgctcatcttgaccgagtcactcgccttttgtcactgttgtctcaatccgctgctgtacgtcttcgtgggcaccaagtttcggcaagaactgcactgtctgctggccgagtttcgccagcgactcttttcccgcgatgtatcctggtaccacagcatgagcttttcgcgtcggagctcgccgagccgaagagagacgtcttccgacacgctgtccgacgaggtgtgtcgcgtctcacaaattataccgtaataaaaaagcgctacctcggccttttcatacaaaccccgtgtccgccccttttttccccgtgcccgatatacacgatattaaacccacgaccatttccgttcgattagcgaaccggaaaagtttatggggaaaaagacgtaggaaaggatcatgtagaaaaaacatgcggtgtttccgatggtggctctacagtgggtggtggtggctcacgtttggatgtgctcggaccgtgacggtgggtttcgtcgcgcccacggtccgggcacaatcaaccgtggtccgctctgagccggctccgccgtcggaaacccgacgagacaacaatgacacgtcttacttcagcggcacctctttccattcttccgtgtcccctgccacctcagtggaccgtcaatttcgacggaccacgtacgaccgttgggacggtcgacgttggctgcgcacccgctacgggaacgccagcgcctgcgtgacgggcacccaatggagcaccaacttttttttctctcagtgtgagcactaccctagtttcgtgaaactcaacggggtgcagcgctggacacctgttcggagacctatgggcgaggttgcctactacgggggttgttgtatggtgggcgggggtaatcgtgcgtatgtgatactcgtgagcggttacgggaccgccagctacggcaacgctttacgcgtggattttgggcgcggcaactgcacggcgccgaaacgcacctaccctcggcgcctggaactgcacgatggccgcacagaccctagccgttgcgatccctaccaagtgtatttctacggtctgcagtgtcctgagcaactggttatcaccgcccacggcggcgtgggtatgcgccgctgtcctaccggctctcgtcccaccccgtcccggccccaccggcatgacttggagaacgagctacatggtctgtgtgtggatcttctggtgtgcgtccttttattagctctgctgctgttggagctcgttcccatggaagccgtgcgtcacccgctgcttttctggcgacgcgtggcgttatcgtcgtccacttccaaggtggaccgcgccgtcaagctgtgtcttcggcgcatgctgggtctgccgccgccaccgtcagtcgcaccacctggggaaaagaaggagctaccggctcaggcggccttgtcgccgccactgaccacctggtcactaccgccgtttccgtccacgcggatacctgacagtccgccgccaccgtaccagcttcgtcacgccacgtcactagtgacggtacccacgttgctgttatatacgtcatccgacatcggtgacacagcttcagaaacaacgtgtgtggcgcacgctacttatggggaacccccggagcccgctcgatcgacggctacggttcaggaatgtaccgttcttaccgctccaaattgcggcatcgtcaacaacgacggcgcggtctctgaaggccaagaccatggagatgcggttcaccatagcctggatgtggtttcccagtgtgctgctgatactggggttgttgacgcctccgagtaacggctgcactgttgatgtcggacgaaacatgtccattcgagaacagtgccgccttcgaaacggtgcgacgttctccaagggagacatcgaaggtaacttcagtgggcccgtcgtcgtggagttggactacgaagacatcgatattactggcgaacggcagcgacttcggttccacctcagcggactcgggtgtcctacaagggagaaaataagaaaagataatgaaagcgacgtcaacggtggaattcgctgggctctatatatacaaaccggcgacgccaagtacggtattcgtaatcagcatttgagtatacggttaatgtatcctggggaaaaaaatacacaacagctgttgggttctgatttcagttgcgaacgtcaccggagaccgtccacgccgttgggaaagaacgccgaagtgcctcccgcgacccgcacgtcttctacatacagcgtcctcagcgcttttgtagtgtggatcggatccggcctcaatatcatctggtggaccggcatcgtgcttctggcggtggacgctctcggacttggcgagcgttggctgaggttagcactgtcccaccgggacaaacatcacgcatcgcgaaccgcggcgctccagtgtcaacgcgacatgttacttcggcaacgtcgacgggctcggcggctgcatgccgtttctgaaggcaaactgcaggaagagaagaaacgacagtctgctctggtctggaacgttgaggcgcgaccctttccgtccacacatcagctgattgtgctgccccctcctgtagcgtcagctcctcctgcagttccctcgcagccccccgagtattcgtctgtgtttccgcctgtataaaaataaagagacgggaggctgatcgcggccttcagcgtctcatttgtctttactctcgagtgcggtcggtgtctcgtcggtgagacgaggccgccgcccgacaagttcgatctcatgtcgctcttggagcgcgaagagagttggcgtcgcgtagtcgactactcgcacaacctgtggtgtacgtgcggtaactggcagagccacgttgagattcaggacgaagagcccaactgcgagcagccggagcccgcacactggctggaatacgtggcggtccagtggcaggcccgggttcgcgattctcacgatcgctggtgtctctgcaacgcctggcgtgatcacgctttgcgcggccgttggggtacggcgtattcctcgggttcctcggcctcttcctccggtttcgtcgcggagagcaagttcacctggtggaaacgactgcgccacagtacccggcgctggttgtttcgccgccggcgagctcgatacactccatctaactgtggggaaagtagcactagcagcggccagagtagcggtgacgagagtaactgcagtctacgcacccacggcgtgtacacacggggtgaacaacactaatcgataagtcgcgtgtaggcgactggctacatcaaccggatatctgcggggatttaaaaagacgacccgttgtcatccggcttagagcaaaccgtccttttatcatcttccgtcgccatggctatgtacacatccgaatccgaacgcgactggcgtcgtgtaatccacgactcgcacggcctgtggtgcgactgcggcgactggcgagagcacctctattgtgtgtacgacagccattttcagcgacgacccacgacccgagccgaacggagggccgccaattggcggcgacagatgcggcggttacaccgtctgtggtgtttttgtcaggactggaagtgtcacgcgttatacgccgagtgggacggcaaagaatccgacgacgagtcgtcggcgtcttcctcgggcgaagcgccagagcaacaggtccccgcttggaagaccgtgcgggccttctcgcgggcctaccaccaccgcattaaccggggtctgcggggcacgcccccaccgcgcaacttgccgggatacgagcacgcctccgagggctggcggttttgcagtcgacgggaacggcgagaggacgatcttcgcacgcgggctgagccggaccgcgtggtgttccagttagggggagtacctcctcgtcgtcaccgagaaacttacgtgtaagaacacggcgtgacaataaacaacatagcgtaaatccccgtgtgatgtgtgtgattgacgttcgggaaacatgtccccatcatcagcgtcacaactgacgtgggttggtcactgacgtgcaggatgttgcgcgagtcagagaatcgcataagaacggggtggtgagcgggttcccacaggagtctctggcgcaaaagcaccatgagcctcaggttccccgagagggcgggttacgagaaactgggataccgcccgcatgccaaacgcgtgcgggtgcatgacccgttgggattgacgcggtttatcatgaggcaactcatgatgtacccgctggtgttgccgttcacctttccgttttacgtgccgcggtcctagcacgtcagtggtgatgctgataattgcaacatggcccatgacgaacccgcttgggacgaacgtcaataccacgtcaaaccaccgtgacttggctgaacgttgaaacataaagccaaagcgccgtcggcacttggcttcagagcagcgcctcggggcgatgcgacggcgatgaacttagagcaactcatcaacgtccttggtctgctcgtctggattgccgctcgtgctgtcagccgcgttggtccgcatggctccggactcgtttatcgtgagcttcatgatttctacgggtatctgcagctggaccttctgggaccagtggtggcggggaatcgctcagtccggacctggaaagagcaggcggaccgagccagagggaccttcgttcggcgttcaggccttaatactagctacatcttacctgtcggcggcctgtctgggggctccggtaccttacccgtcggcctgtatcgtcccgaagaagaggtgttcctcctcttgaaccgctgccatgggccactgtcaacgccgaaaaatgcttgtctggctgaggtcggtgtcgctaatgccacttttttgtctcgcttcaatgtcggtgattttcacggagcgtcatgggaaaacggtaccgctcccgatggagagcccggggtatgctgaaattcctcttaagattccgtaaacgacgttgtccagtcgttgtgccgcgattcgtacggttcatcgtctacgtcgttttgttcaccgtcgctgtgcaacgcgtgaaacaagagcgtgatgcgcaccttcggcggtatgaagaacggttacggaaaaaccgcgcacggcgtcggcagtcttttccgtgacttggggcgatgggtccgagctgcggtatgggtcacggcggcgtgtgttttattgacgaagatgccgatgtgtgactaaaaacgtcccagccctagagcgatgtgtttcaataaaaattatgtcgtatcatagtatgcgtgtcctggtttttcatttttggatgtatttgtgacataaaaggcgatagaatgtggggacgaaacatatccagatacacagttttgttattcgaacaaaacccgtgtgatgcagaaaacagtactgcaggatgaaagtcccatgggggggggggggcagacagtagtcgtttttgccgctgggcgtacgctatgcttgtatttatgactataatatgtgcactcgtgtgtcgatgttcctattgggaagggtgtcaatgtaggaggtataaagaatggtgggatgcggagaggcatcgctagacacaggttgatcgctgtgctagccccacctgatcagcgtcatgggtaaagcggtgattaagcgtgaaaacaccgtaagggggggggggcagacaggaagcttggtggcagtggccgttagatgcattacgtgtctgtattggtacatttgcaaaccgtcgggtgtggcggtatagtttagcgatgattatattatgtatgtgccgtatagaatggcctaaaacattgtaacacgaaacgttacaatgatgggaaagatgccgataaaaaacacataaaaggcatatacacgaattactagttacacgtttgtctatgtgcgagtttaaggacgcttgtataatgcgtatgacggcaaacggccgcggaaacgatggggggggggggtagtaactgtattaattatacgtcttgcagtacacggtattgtgtgctggtgcgcgtattacgacacgaacggcatagcgctataaccgggtgtatggtatttatatgtgcgtctagcatccttgcgagattctgaaagtcttcttgtaagcgtaattaaaacggtgtatgttctgcgtaaagtgcattcaaacaacgtaacagtatgggatgaatgccaataaataacatataaaagcgagaagtatacatataagggttgctagacacaggtttgtttctgtgctagcccaatggcacttgtacaatccatgcaagcaaaaaaaggatgcgaaaccaacatcgtggggtggggggggggtaaaagcaatgttaatcattggtctcgcggtgcaagttgctgcgttttacgtgtattgttacacgggttgcgtatcggtataatcggatgtgtgttactcattcgtggcgttgttatagtattgtgaaaaagaattctcgtaagcatgttgacaactgcaaaataaaaccattttattgagcattgtaatggtagtgtgtcgctacattagaaaacgtgacgcgtcgcatgtcgcggcacaatctggcagcggggtcggggtagggtacggtgggaggcatgtacacagatggaacaaaagcagaagtaacgtgagacggagcatatagtccagtatccagcggttcctgagtagcaccacccatcaactgaatgccctcatgagtaaaagtctgcgggcggcagcccttggggaccgttggcatgggacgatcgatctccaaaccacagcgtaacacggttttcttccaacgtcgttgatacacgtcgtttttacggttactccccagaacccagaaagtctcgtccaagtcgtaccaggagtcttccccagggagacgtggcggtttccaatcctcatcgtcccgtcgcaaagcacgtcccaaactggcttggggagtcaacggtggttctgtgggtcgggtgtagcgcgagtgttttccgttcatgagcgattcgtcctccttgcctttaggctttttggcctttttgtgtatcatctggccgccggcctccataaccaccgtggccaagtccagtcccagagcttgagcgtcggcgcggcgtcgggcgtcttgcaggtagtcttccacatttgcacagatggccgggtgtttggtggctagggtgaggacctcagcctcgccgcggcccggacgtagcaaaaaagctaactgcccgtgcggctcgcgcgcccacagcgcggcgcgcgggtgcaggtgcagcgcgtcccagcgcggccgctcccactgctcgcggtccagctcgggcagcagccgccgcgcggcctcggcggcgggcgccgactcgcgccccagcgccagcgcgcccaacacgcccgcgcgcagaaagtgcgacagctccgccgccagcgggtacacgtgcccgtccagcgggcagtacccgaacacggcgcccagctcgtccagcaccaccaccagcatggcgcgcggcacggtccccgacgccgccggacccgccatcgccgtcggacccaccatcaccgtcggcgccgccgctgctgccgctgccgcatccgttccgaccaccgcgtgcgcgtccgcgtttggcacgcaaatcgcgctcccgccggcggcgccgtacggctgcggaggtaaagtcacagcagaccccacggctcccgccatcgcgcacggcgcgtccccgccggcggcctccgtctccgtgccgctcgcccccggcagcaacgtcgtccccgtcgccatcgccgtcgtccccgccgtcatcgtcgtcgtcgtccccgccgtcgtccctgtcgccggccctgccgcgcagcgcagccaccgcgacggcagcaccgcgcccagcgccagccagccgcagcacagacgctggttcaggtgccgacgcacggccgtcagcagcgacgcggggtgcggcgccgacgcgaacggctcgtactgcgccagctcctgccacgcgcccagcagcaccatcggctgcagtcgcctgcccggcgtctgcagcgccaccgtcgtgccggcccaccgccggcgcagctcccgtccgagcgccgtcgcctcctcggcgcgcagcaacgtctggcgaagcgccggctgaggcagcagcgtcgcgcgcggggtgcccacgcccagccggttgcagcggtacaggcgcaccacctcgcccgcgccgtgccgaaaccactcgtccgcgtcgcgcgccgccaggatcagcgtgttgttcgccaggtcgtacacgaacacgcggaacccggcgcccagcgccaggtacagtccgtcctgcgcgcacagaccctcgggatggccggccttgtcgcccaccgtcgggtcggccgcggggtccacctcgtgcaccacggtcgccaccagcacgatccacgcgtcccgcggcgacagctgacgcaggtccgtggcgcccacgccgttcatctggctgcgcggcgtcactcgcgcgtagaatccgtacggccgtccgagcggcagcagcgtgcccgcgtcgcgctgcgaccacttgcgcatggcgcggcccgtgctgttggccaaaaacgcggcgcgccacacggcgcccatggcctggtattccagctccgtcagcgcctggcgctccaccggaatctgagacagcagcaagcgctccgggccgtgccaaaaggtgctgttgttgccgctacccggaggggcgcccggcggcccgcggggttctacccggtggacggcgtgggccggcgtcgccgtacccgcagtactcgtactagtccccgctgttgacgtcgcttccaaagaagaagaacgagaggaaccaacccccgaaggccctccggctccgcggccgcgaccgaggggcggggggcgcggcgacatgccgttgcgctgggccatggccgccggacgcctccgacgtccactctgtatatataggaagcaaacccgcgtcagcgaccacgccgtttacacacgcggacgcctccgtcgcccgtgtgccgcgggcgacacgcacctggcttttataggcagcgacgtgcacggcgcttgctggcgccgccttgccgccgcgcagtctggaaggccgtgaaaaaaccgaaagaagatgcgcgacaagccaccaacaacgggccgccgagcgcgcgcacacctaggtggacgcctgacctccattccgggccgtgtgctgggtccccgaggggcgggggggtgttttcatcgggggggtgaaatgtgggaatttgggaagttggcggtggcgggggacggcgacggcgaataaaagcgccgtgcggcgcgcacggcgaaacccagacgcgcgtgtgtcttgcgtctctttcagtcgcgcgtctgtcttgcgtgtctttgagtccccggggaaaagaggaagcggtcccgaggggacggcggcgcgactccctggggacgcgaagatcggacgcggaaaagaggaagtccccggggacggccacaggcggaaaaaaaaaacgaggaagccgcagcccagtctgccgggaccggcaggcaggcgcacagacccgcgtcgaggacacacgcagaagaagcgcccgcgccggggcggggggggggatcgcgggccccggggcacactgcttccatctggccgcgcgcacaccccgccgacacacccctgacacacccgcgacacacccggcacacgcccgcgacacacccggcacgcgcccgccacacagccagccgacacacccgcgacacacccgccacacccagccgcacccggcacacacccacccagccgcacccccgccacacccagaccgacgccggtgcgggaccgggctccattccgggccgtgtgctgggtccccgaggggcgggggggtgttttcatcgggggggtgaaatgtgggaatttgggaagttggcggtggcgggggacggcgacggcgaataaaagcgccgtgcggcgcgcacggcgaaacccagacgcgcgtgtgtcttgcgtctctttcagtcgcgcgtctgtcttgcgtgtctttgagtccccggggaaaagaggaagcggtcccgaggggacggcggcgcgactccctggggacgcgaagatcggacgcggaaaagaggaagtccccggggacggccacaggcggaaaaaaaaaacgaggaagccgcagcccagtctgccgggaccggcaggcaggcgcacagacccgcgtcgaggacacacgcagaagaagcgcccgcgccggggcggggggggggatcgcgggccccggggcacactgcttccatctggccgcgcgcacaccccgccgacacacccctgacacacccgcgacacacccggcacacgcccgcgacacacccggcacgcgcccgccacacagccagccgacacacccgcgacacacccgccacacccagccgcacccggcacacacccacccagccgcacccccgccacacccagaccgacgccggtgcgggaccgggctccattccgggccgtgtgctgggtccccgaggggcgggggggtgttttcatcgggggggtgaaatgtgggaatttgggaagttggcggtggcgggggacggcgacggcgaataaaagcgccgtgcggcgcgcacggcgaaacccagacgcgcgtgtgtcttgcgtctctttcagtcgcgcgtctgtcttgcgtgtctttgagtccccggggaaaagaggaagcggtcccgaggggacggcggcgcgactccctggggacgcgaagatcggacgcggaaaagaggaagtccccggggacggccacaggcggaaaaaaaaaacgaggaagccgcagcccagtctgccgggaccggcaggcaggcgcacagacccgcgtcgaggacacacgcagaagaagcgcccgcgccggggcggggggggggatcgcgggccccggggcacactgcttccatctggccgcgcgcacaccccgccgacacacccctgacacacccgcgacacacccggcacacgcccgcgacacacccggcacgcgcccgccacacagccagccgacacacccgcgacacacccgccacacccagccgcacccggcacacacccacccagccgcacccccgccacacccagaccgacgccggtgcgggaccgggctgaggggggtgtaagcgccttgacgcgcggcgctatggcactgcgtgccacggtattggttggcgggacgaggctgaggggggtttgcgggacgtaagcgcgacgccgagtttgcggcgtgctgtggcgcgctcaaggctagggacgggggccgcgcgtagcttttcggcggcgacggggaacaaaacaggcacgcacacgcagctcgcttcagcggtcgccctatcggcaccgccgctattctttattaacgtcgttctccccccgcttctacacgcggaccgctgcagacggctatgctcagactgtttctcttgacggcgacatgtgtttgcgtctgtgcggcgcggcgacggccgcaagcggacgacgccgcctgccaccacacgtggcccacgcgctgcgccggcccgcgtcccgcgccgtcggctcacaacacggcgctttcttcctcgcacgccatctccatcgcacaccgtgtgctgcattcgccgtcgcctccacgagagaacatccgccacagcatgcgctgtcgccgtcgcgccatggcctcctcggcttgcacacccgtttcgcacacccagcctcgggccgccaaccacagccgttcgaggatgacgtacgcgacgagcgagcccaccaattctcccacggcctcgcccgccaagtcagacggtggtgttgcctgcggcggggacgggggttgcgctgggatcgggggtggcgccggggacggggggctttcgcagcggggaacacacaccgcctatttaacctccacccgctacaacacacacatgccgcacaatcatgccagccacagacacaaacagcacccacaccacgccgcttcacccagaggaccaacacacgttacccgtacaccacagtaacacacaaccgcaagtccaaacctcggacaaacgcgccgccgaagaccaccgcacgcagatggagctcgacgccgcggactacgctgcttgctcacaggcccgccaacacctctacggtcaaacacaaccccaactacacgcataccccaacgccaacccacaggaaagcgctcattttttcacagagaatcaacatcaagtcacgcatctacttcacaacattggcgagggcgcagcgctcggctaccccgtcccccgcgcggaaatccgccgtggcggtggcgactgggccgacagcgcaagcgacttcgacgccgactgctggtgcatgtggggacgcttcggaaccatgggccgccaacctgtcgtgaccttactgttggcgcgccaacgcgacggcctcgctgactggaacgtcgtacgctgccgcggcacaggctttcgcgcacacgattccgaggacggcgtctctgtctggcgtcagcacctggtttttttactcggaggccacggccgccgtgtacagttagaacgtccatccgcgggagaagcccaagctcgaggcctattgccacgcatccggatcacccccctctccacatctccacgcccaaaaccaccccagcccaccacatccaccgcctcgcacccacatgctacggctcggccagatcacacgctctttcctgtcccttccacaccctcaaccacggttcacaatccccgaaactacgccgtccaacttcacgccgaaacgacccgcacatggcgctgggcacgacgcggtgaacgtggcgcgtggatgccggccgagacatttacgtgtcccaaggataaacgtccctggtagacggggtagggggatctaccagcccagggctcgcgtatttcgccgccacgctgcttcaccgatatccaataaacccatcccctcgccacgacgtctccgcgtatctttgtagcctcaggaatccgtccccacgtccacccatcccgagcactccacacgctataacagaccacggacacggcaaatgcatgcaaacttctcatttattgtgtctactactctgtgttgctacagggggtgaaggcaaagaaaaaaaaaaggaacaaaataatagattagcagaaggaataatccgtgcgaccgagcttgtgcttcttttcttataaggaggcaaatatactagggaaaacataagaataggaagaaaccgaggtttgggagaaaagctgagataaaatagcgcattttccatacagaggttgttgtttttgtggatcctaagaggtttcaagtgcgaatcttaaagttctcacgagaatattgtcttcaagaatcgacaactgtggtccaagatttttttttggtctttttaggttctgcgagggacatcacgatggatcgttgcgatgaagtcacgcgtacgcctctggtgtggcgcggtgtcgtgacaggagagtgtgttttcagtgcagagctgtcttgattcctatatccgagtatctgttttctcgtaaggacggtaatcttctttggtgtaagtacatctaaaagctgcaaactatattttaagggctgtctctaggtgtactttgatgctggagtttttcgctgtgttgatgtgaataaatctactactactattatatgcagaaagagtgattatgccgagacaagattgcattggctgaactgtttcaaaaacgcctacactctacttatccgtaaacctaaggtaatactatgtgtaagttgttttttttttctttttgtagtaaaatggtgatacgtgcaattaaaactgtattccatgtttccatcctttcatttcaactttaaaggcggctttgagagcgaagaagtgcgaggataaaaatggatgactccttcgtgtccagggagtcgactactgcaacgctgattgattaaaagatggtctccgatgatgatgttgttattgatcgaatcatggtgcagaacggcgacggagaggagcgtgtccgccgccgggaaggtggtctctttctcttttcttttttcaagaaatcttccatgtgtttatcgtagtgatcgaaatcgactgatctcgggttctttttgttggtttcttttcggttaatcatgtattgttttctttttttacagaaagatacttttttcatgagcaattcctcgcccggcgccggcatgccgaggtggggccactgcgatcagcggcatgccgacgccgacccggggatcttggattcaccgttttctctcttctctctctacatacagaccgggtggcaggagcggtaaggaatcatcgtcgtctttcattcttcgatgattatggtaatactaaatcttatctaggagcatatacatctaagattggagtactagtagtcgtttgtggtttctatttttttttatatttatctatgacagtttttctgtttttcgttttgataataatataataaaaactcatggacgtgaaatctggcttggttgtggtgatttcattctcattattgttgttttctttccgtcttgcggatgaagatgttgcgatgcggttgttgttggtgttgctatacaccgagagagatgatctttttgttcttctggttcatttcctatgattgtttggctgctgaccgacgcgtcaggatgtgcagggcatgcggggaatcaggaccggacacgggataatttcatctacctatacggagatcgcggtcctcgccatgaggatcgcgacaggcgcgtcgagggggcaggaacacccttgcggattgacattcttggtggtgtttcgttgttgtcggtagttgttgttgacgatgaggataaataaaaatgaccttgtttttgttctgttttctcttgttgggaatcgtcgactttgaattcttcgagttatcggaaagctgaggtacccaaatgtctgtagcttttttctttttaccctcttgtttatcatctgcgattcgtggtaggtaggagagggaaatgataatccgagattaaggaaaggagaagataaaataaaaaaaaaataaaacagaagccgaccggccgccgacccgttccccaggaccagcctacgaggaacggataacgcggtggcgacggcagcggtggtggcgctgggggtggcggtagtggtactgctgatggtagtcgggacggaggagagacgatgcatacatacacgcgtgcatgctgcatgggtggatggtccgaccgggagacgcggaagagaaactcacataaaaaggtgacaaaaagagcggttgaaaaaagaaaacgagattcgaccagacagaagaggaggaccggggcttggcgacccttccacgactgctgttgtcatctcggctcctccgtcttctcccggccacgggcggctaagtcaccgccgttctccccatccgtccgagcgccgaccgaccagccggccgattcgcccgccggggcttctggagaacgccggggcagcagcgatctggagaagccgctaaacccctgcgtttttatatggtagctctgccgagcgcgggctgacgcgttaagtaagcggaaagacgtgtgtgacgaaaaggggtcccatggtatttcacgtgacgatgaggagatgcggtttggagcacatacggtttagaaaaagggagttgtcgtgacaagggctgagggacctctgtctccatgtgtgtataaaaagcaaggcacgttcataatgtaaaaaagaacacgttgtaaacaagctattgctgtatcattcggctgactatgcttcattcggactgattttcttttcctaacggcgtaacttaaagtgattaacgtatgatatttgttccccagagttatactatagtcatcatcctaaaattcagatataaatgaacacatgtcgtatgagattattaagaaaccgaaaccacccatagttcaccatcctcttcatcattcagccgatgacccactccgtacaacgactcagtctgcttcgtcatattgcaaagcacaagcgacgtatgtgaacaacttgaaacacagactgtgttattaatgaccgttgtaccattactagtcacattgcataaagatcctccgccgtcgtcccatcttttccactcggtggaaaaccggtcgctatcatcaactatggtgagattttcaccctgcgtggtattcagtttcttcatattcataccttggattccattattaaaccccaatattaagcacgttattagtaccccccccccccaccaaggaatgtgactggaccggttcctagcagctctgggagccatgttcaggttgaaccacagctacagcgaaaccgagtccagtgaccggtaaccacgtccagcccctgcgtatgtaccagtccaagcacgtccggtcattgttctacacaggaaatctaactaggtcaacgtaattttattccaccgttacgcagaatactaacaaaaaactacacaaatgtaacggattacacataatttattacgtgaaaactgtaagaaagccaattcaccaagcgatacatttatttgacttccaagtgccacacatcaccactatattcatccatgttttcaccgaaccaacgagacagatcgaagaagccagaatcttccgactttaaattacataaatccaacgtattatgaccacagctcgacacacaaatagttgcgttactattcacagtggcattacctatacccgtaacgttgcacaaccactgatcaccattgtcaccaaaaacggttttccacttagttgtcaacggatctttcctatgcgtaatggtaaaattactaccagtcgtcgcttttagctcattacgagtattatccgcatccacatatatcaacgtcatagctaggcacgctataagtaccccccccccacaatggaatgttgccaaaccggttctttcccgttatagccatagcgttcccaggcaaaagcaaacgccgaacctaatgcagtaaaaagcgcttgcagccagaaccagcttatgtaccagccacgataacatccggtcactgtttccacaggaaaccctaccagggtagagccccgcttgttttttcctgtctatcttgtttagcaactcgtaaactgtcagtctagccacgtccgtttagatcaaaagtcacgtatactgcgacgttgtttccacccgtttccccgtcccgccgtttccgaacaacccacccgggttcagacaaccgaccaccaacagaaatatacacacagaccaccgggagttcagttaaagatttcatcaggtttattttggctgctgctagtcttttgcttcttagaaaaaaaatacccatatagagaaataatgatagtttgacaacacatatggcagggatttcttcttcatcaataagatatgcaattcccccagggagagactttcaacaattgaatttacaaaaacaaaattacatcaggagaaagagaggatacattaataaatatattatatctggtgtatatactgaatgctgctggttcataaggtaacgatgctactttttttaattccaagatggtttttctttgttagtcttttgttgacttgctggttcctaaaagttctcaaaaacgattgtgtgaagattttatgacgttggttgactagttcatgagattctgctgtacgtgtgatggttattcgctggttcgttctaagatgagtatcgtactgtgtctgcgatggtcgtctcttactggcattctctcggctgcctcttgctttcatgattgaaaaggaaaaaaggactccgagggcgcggtcatcttttacttttcggttttttcgttggcgggtcagaggtagtcagatcatgagactgtcgtggtcgatgaaactgtgtctgctcaagtgacgtccatttcttgtacggagaaaaaagtcatcgggataaataaggctatacaaggcgttgtcaagcgtgcggctctaaacaaattaagcgatacaaaattacagtaatacgaataataagttaccccctccccctgtggtccccccgagacgagagccacccatcgtgtactctcgcaccacccacgaccacagagggagacgggacgaagagacgacgcagagcgccatctccttctggaggccggcggcgttaactgctacagctgcggcggcgacaacagctgcgatttgtcggccgacatgccgatggtatgggcggcggcggcagtggccgcggcagcggggaggagaggagagagaagaggagcggggcgtccgaaggcgaggatggcatggtctcgccggagcgcccggcttttatggaacgctcgcgtccggtcgggcagcgcccacaggaagatgagtcaaaacttttaaaccatcctgagacccgagtagcggtttacaggccgcacgccagtcttagctaaaaacagcggacagtcccacgctgtttctgttgtggctctctccagtttcctcatcgccgtcccgatctccgtcgtcatcggaagaataccacccgctctcatgcggcagtcgatcgacctcgacgaacgagacgcggcgacgcctctctacggccgactggttgtggtggtgaaagaagagcaccagcaatcccaggaggagcaacaagccctcacatgtccaggaggtcggggagagggcctgtcggagatggccgtgaggcatcacgtacggcagctgaggagaaacggagaagaaaggaaaattaccgtcaggggccggggttcttattagagaaacagcacgtaggtcaggatccagatgctaatggcaatcatgatgacgatgatcatgcaggccaagacgcggcgcaccaatgccgaatccaatagccgccgtgcctccggttggtggccggcggcatctagagacatgatttgggggggaccggcggcgcgaaaagacagggagatggacagtgtcacggtgttttgttatgattaggacatggggaccggaagccgagacagagtactacagggtgttgaagggtaacgtgagggagatcatgtcatgggcgggctgaagaccgtgcggggaggattggcgtgtgcggtgcttgtggaacacggtgttttaatatgtatccgcgtgtaatgcacgcggtgtgctttttagcactcggcttgataagctacgtggccgtttgcgccgaaaacacggttaccaccaactgtctcgtgaaaacagaaaatacccacctaacatgtaagtgcaatccgaatagcacatctaccaatggcagcaagtgccacgcgatgtgcaaatgccgggtcacagaacccattaccatgctaggcgcatactcggcctggggcgcgggctcgttcgtggccacgctgatagtcctgctggtggtcttcttcgtaatttacgcgcgcgaggaggagaaaaacaacacgggcaccgaggtagatcaatgtctggcctatcggagcctgacacgcaaaaagctggaacaacacgcggctaaaaagcagaacatctacgaacggattccataccggccctccagacagaacgacaactccccgttgatcgaaccgacgggcacagacgacgaagaggacgaggacgacgacgtctgataaggaaggcgagaacgtgttttgcaccatgcagacctacagcacccccctcacgcttgtcatagtcacgtcgctgtttttgttcacaactcagggaaatttatcgaacgccgtcgaaccaaccaaaaaacccctaaagctcgccaactaccgtgccacctgcgaggaccgtacacgcacgctggttaccaggcttaacactagtcatcacagcgtagtctggcaacgttatgatatctacagcagatacatgcgtcgtatgccgccactttgcatcattacagacgcctataaagaaaccacgcatcagggtggcgcaactttcacgtgcacgcgccaaaatctcacgctgtacaatcttacgattaaagatacgggagtctatcttctacaggatcagtgtaccggcgatgtcgaggctttctacctcatcatccacccacgtagcttctgccgagctttggaaacgcgtcgatgcttttatccgggaccagggagagttgtggttacggattcccaagaggcagaccgagcaattatctcggatttaaaacgccagtggtccggcctctcactccattgcgcctgggtttcgggactgatgatctttgttggcgcactggtcatctgcttcctgcgatcacaacgaatcggggaacaggacgctgaacagctgcggacggacctggatacggaacctttgttgttgacggtggacggagatttggaataaaagatgcgcgtcaaccgtcaaagacgcaacaaccttacgtaccgacaaacggtatatgtaattctgaccttctacattgtacataggggcatatgtaacagcaccgataccaacaattctacatctacttcaaatagcaccgtctctgatactaatgtatattctactccaaatcctcccagtgtatcttctacaactcttgatacatctaccgactcacagatatcaatcgcctcaaacaccatatccagcactacaaatacattgaccgcatattctataactacgttaaacacctcgacttcatcttcaactcttactgctgtctctagtacccatacaagatcctcaatactctccaacaacgcatcatacaccacatcattggataatacaactacagacataacgtccagcgaaagttcaatcaacgtgtcgacagtttacaacaccacgtacattcctgtaacatcgcttgctattaattgtactgctacaattaacggaacaaataattctagttcaaaaacttgccaacaagacattgaaacaatacctgtgaaatcaactccactaacggcagaagaaggaacaaatattacaatacatggcaatgacacgtgggattgtcccgacgtggtttggtatcgacattataattggtctacacatggacaccacatttatcccaatacacattacaaaactttgatacatcgacgcaagatcctaacgtcacatcctatatgttattctgatcgctcatcacctaccgcgtatcatgatctatgccgttcatgtaataaaacagaactacgcctttacgatttaaacaccaccaattctggtagatatagccgacggtgttacaaacagtaccatcaccagggaccacacgaggatgaaaatttcggactaactgtaaatcccaggaacaacactgacaattataccatcccagtatgtcccagatacgtagaaacacaatcacaggaagatgaacaagacgacgattatacactaagcactaccataaataataatcttatgcgcaaaacaggtcactatgacatctcacatggcacgcacactacatgggctcttatactaatttgcatagcctgcatgcttcttttttttgttcgacgagccctcaataaaaaatatcgtccactacgagatgatattagtgaatctagccttgttgtgcaatatcatcctgaacatgaagactaacgtttccggacatgcaacacataaaattaagtaacatatctaccatgaagtacagcaaatatctactaatgtctatccatccaacagtgataccatgcactggcatcttgcgattacatggacggtaatcatatccacgttttcggaatgttgtaaccaaacttgtccgtgttcctgcgtttgtgtcaattctacaacagtcaacatatccacaaatgaaacaacgtctaaagccatcactccaactgctacgacaaataccgcaaaaacaacgtcaagccttgttattactacaccgtcatcagtaacgattagcaaagccgtgtctactgcagcttcatcaaccatactatctcaaaccaatcgcagtcatacaagtaatgtcatcacaaccccaaaaacgcggtttgaatataatatcacgggatatgttggccaagaagtgactttcaacttcagtggatcattttggagctacattgaatggttccggtacagttctccaggctggctttattcctcggaaccaatatgcaccgttaccaacagttatcatcatactttccctcgtggtaccttatgtttcgattgtaacatgacaaaatttgttatttacgatctaacgttaaacgattctggaaagtacgttgtcaagagaacacgtcatgacaatcaatacgaagaagcatgctacaatctcacggtaatttatgccaacacgacagccatagttaccaacaggacgtgtgatagaagacaaacaaaaaatacagacactactaaccatggaatcgggaaacatattattgaaactattaaaaaagccaacattcccctggggattcatgctgtgtgggcgggcatagtggtatcagtggcactcatagcactatatatgggtaaccgtcgtaggcccaggaaaccgcgttataccagacttcctaaatacgacccggatgagttttggactaaaacctgatatgcacatcaataaacttttttgtatctttagttattaatgtctgtgtgtttattcagaataactcatttataatataagacggaatattcatatacattaaaaacatgggtgtacaatataacactaaactgttattagccgtattagcaattatcccagctggcattctagtacaggcaatttcacatgagcaaaaaacatcctaccggcaacttttgctgcaaagtgaacgtgtgcaaatacccatcacaacagtcgagggagatacaatttgctttaacgttagtaacaacccctgcaacttttccagttattggaatcacaataattgtgaactttgcggttggacaccgtttttctttgaatatgctggatatactgaaaacacgtcgtgtcacccacgatttacctgtattcatgatactaaaggtctaaaactatacaatgtaaccatgaatgactcgggaatttatacacaacacgtttatcactgtgatattccatgtaacatcagcgatgatcgtaaatataacgtagatgacattgataactgcaacgctactataaatgtaaccgactatattattaccgtgttgtcttcacgttattctaaacgcaccgattaccacgtagatacttacattggttatgcaaccactgtggtgacaatagtatttatctgtgttttaacttgcattaacgtctcagcaactctaaggcacagactacgaactagaaacaacgttaacagcataacgtgattacaaagtatcaacgctagtttatccaagagaaactttcatgaaggatcgcaataaagcattgctatgtatcatctttattttaatcatgtacctcatttatatttattttaaacgtcgttgtattcctactccgtccccagacaaagcggatctgcgagtggaatttccctcattacccccgtgtgtcggcatacagtgcgctgcataagaacacgcatgacacatagcgtacctctggacggtacagtatatgataacatgattcaaggaaagtatggattcctaccgacatgttatgacagaacacacaggttttctgcgtgttttataaaagagcgtctcgaagcagcttgagccacactacggtccagataacgagcgttgcaaaaaatatgccgcgcagtagtcgaaagccgtactgagcgtgcgaagcgggtagggtgccgaacgacggatatgcgccgttgtcatcttcgactataaggatcgcgaccgagtcttcgggcatggtaaaagccacacggtgtggttgatatgtagcgtatccggtttggaatcgttcggctccggctcaggggatagtgaggaattctcaggggacgatatgggacccaatgactggataaaagaagggtttttcccagtaagatgatccccgtatcacatgaggtctggatatatataaatgaggagtgaaataggcaaagggtatcagacaccagcctcgtcatgcagccgttggttctctcagcggaggaactatcgtctctgctaatttgcaaatacatcccaccttaagcgacgagtccataaagcaccgttgtccgggtacggtgaaagtgacccggattgtagcacgtcccttttttgtttttgcatcgtttatcgtcaccactagtgcaatattttgatcgtaaggctgaaagagtattgttatgatgcttagaacgtggagattattacagatggtactgcttgccacgtactgttattatgtttttgcgaattgttcaatcagcacgacgactgctcctgtggaatggaagtctcccaaccgtcagattcccaagaatattacctgcgctaattactcagggaccgtcggcggtaacgttacttttcagggtctcaagaataaaacggaagactttttatcttggctactcgggtctggctataagtccatttgctcgttcttcccacaactccctggtgattctaatgagcagcattacagatatgaagtaaccaacctcacgtacaattgtacctatgaccgcctaacgttactgaatctgacaatggaaaacagcaggaattactatttcagaagagaagatgcgaattccaccttctactactcttgttacaatctgaccgtgtcctagagaacgcacgtgaagttccacagagccgcgtggctgtagctattgtttacgttgcttttgaaatgttaagcgtccctacggcgctaacatgtttctaggctactctgactgtgtagatcccggctttgctgtatatcgtgtatctagatcacgcttgaagctcgtgttgtcttttgtgtggttggtcggtttgcgtctccatgattgtgccacgttcgaatcctgctgttacgacatcaccgaggcggagagtaacaaggctatatcaagggacgaagcagtattcacctccagcgtgagcacccgcacaccgtccctggcgatcgcgccgcctcctgaccgatcgatgctgttatcacgggaggaagaactcgttccgtggagtcgtctcatcatcactaagcagttctacggaggcctgattttccacaccacctgggttaccggcttcgttttgctaggactcttgacgcttttcgccagcctgtttcgtgtgccgcaatccatctgtcgtttctgcatagaccgtctccgggacatcgcccgtcctttgaaataccgctatcaacgtctcgtcgccaccgtgtagctagttagccagctgtgtatagtttgttgtgttttgcttttgcgtatttgttttcagtcagagagtctgaaacggggtgggagggacttttgcgggtaatgcatgctaaaataaacgggtgggctggggtgtgcttggtaactcactgtttgaatacgcgctcacgcacatatgtagcactcaacatgttagcttttgcccgcacgccccggggcgtgccgagctgcctttttaataaagtctgggtttccagatacgcgctggttctgattttgatgatttgtgcctctgaaagctctacgagctgggccgtgacatccaatcgactgcctaactgtagcacggtaactacaacagcgggtcaagacgctgaattgcacggtccggcaccgttaagctgtaatgtgacccagtggggacgttacgagaatgaaagcacacccgtattatggtgcactttatggggatcacgcatgcgagtctcattaggacaccgtgtagcgtttggctgttcttggaaaacattttttatttataacgtttctgaaagtagcggtggcacttactatcaaaaaggttacaactgcaccgacaaacatataacactatcttgtttcaacctaacggtggttcctcgagcggttcaaagcacaaccaccgtaatgacacccacggtggttacaaactccacattcagtgtgtcacttattgcgttgagactgacgacaaattccagcgcggttggacacgctagttatcaacgacaacagcgtgttgaaaacgggacgttatccaagaacataactaacttggcattcacctatggcagctggggcgttgcgatgctgctgtttgccgccgtgatggtgctcgttgatttgggtttgcctcaatcggcttggcgacgctggcaaagccacgtggacgatgaagaacgtggtttgttaatataggaagtaaaaggcactgttttagcatgactgtttccaaaccgtaacgtggtaaataaatcatggcttccgacgtgggttctcatcctctgacagttacacgattccgctgcagagtgcatcatgtgtacaataaactgttgattttagctttgtttgcccccgtgattctggaatccgtcatctacgtgtccgggccacagggagggaacgttaccctgatatccaacttcacttcaaacatcagcgtacggtggtttcgctgggacggcaacgatagccatctcatttgcttttacaaacgtggagagggtctttctacgccctatgtgggtttaagcttaagttgtgcggctaaccagatcaccatcttcaacctcacgttaaacgactccggtcgttacggagcagaaggttttacgagaagcggcgaaaatgaaacgtttctgtggtataatttgaccgtgaaacccaaacctttggaaactactccagctagtaacgtaacaaccatcgtcacgacgacatcgacggtgaccggcgcgaaaagtaacgttacggggaacgccagtttagcaccacaactacgtgccgtcgctggattctccaatcagacgcctttggaaaacaacacgcacatggccttggtaggtgttgtcgtgtttctagccctaatagttgtttgtattatggggtggtggaagttgttgtgtagtaaaccagagttatagtaatgtgttttttatcagggagaaggttttgtaccaacaatgactacatcggggctatctgtgtcggaaaattatgacggaaattatggactcacggaaaccgccaatacaacgcgtacaaatagcagtgactgggtaacgttaggaaccagtacgccactgttgggaagcacggagactgcgatcaatttcggcaacgcaactacggttattccacaacctgtggaacacccggctggagaagtacagtaccaaagaacgacaacgcattactcttggatgctgattatcgttatcattttcatcatttttattatcatctgtctacgagcacctcgaaaagtttatgatcgttggaaagacagcagagagtacggacaagtgtttatgacggatacagaactgtaatatactatgatgtctaagaagtgtttgcggttatttccatggatgacaattttgttttgcataccaaaagcacaacattggaactatatgacaataccatgcgttcttaaaattggacgcggcggtcaaaatatgagtttgcctccccttaacaattcattgtacggaaacgatatttttcaatggtatacagacagaccgacagtcaccaacacgttatgtctttatcaaaacaatgagtactacacacaatccaatgaagatatttcaaacatcaaatggcaatgtacaaaaaaccatacgttaattcttattaacctaaccgcaacatatagtaggaactattactttcaatctcttaaaactcttgggcaaggaataccgagaccgagcagcttatgttataatgttagtgtacaccttacccaccaaacacattgtcatacaaccacattatccctgtatccacctacacctgtacacaattcattaacaatatcaccgtcattagcttcaaccaactttacacatgttgcggtccatcatgccgcaggtaacgttgaagcacaacacaacactgccactccacatacaacgtggatcatacccctggttatcattataacaatcatcattttaatttgtttcaaatttccccagaaagcttggaataaattcacacaataccgatacaacagtatgctcgccgccgcttaaagaatcaccgtcgaggaaactaaaagctatgtacgtttatttttcagctcactgtttgaataccgtaaacataatgacgtacatatacgtggttatacaacaggtgtttgtgttatgcggcgactgattaaccatatcgtgaaccatgatcttttccgatggtctgtcgtgaccgcaatgatattttacaagtattccgaaacctgtatggaggtcactgtcagagtaggtgatccagttaccctcggtagtggacatggttatcatccaggacaaaaagtacactggtataaccagtcatgcgtcggcatcagcaacggcgaaaatacgcatcctatctgcacctacgaccctcctaaacctggtagacaaaagacaatgaaaaccactccgttgccatcaccactgttgtatgaatgtcacaattccacattaagcattcttcatgtaaacgtctcagatcccagaaactattgcaggcgaaaatgtccaccaaagggtaactgtgagtttcccacatgttttacattatcgctgatttctagaacgacaaccaccagaagacccggacaaaaaactacgctgtcgcgattaaaaactacgccaaataaacatacgcagcacaaaagatccacgcgaagaacgtcacttaaagattacaatgtaacgggtctgccgaaaggctttgcggactcgtttaccggtaacgtagaggcacatagagccaaagatgccgcacacagcgcatggattctcattgtcatcatcattatcatagtcgtcattctgtttttcttcaagattcctcaaagactccgagagaaatgggacaccaagggatacctttacaaagggaccgatggcctgcccactacggactaattatcgtgagcggacggatatgtccggtttcaaactcactgtttgaatatagggacagtccctacggaacctgagaacatgtggaaatcacctgtggtagaatgctgctcaggtacattacctttcatcgcgaaaaggtactttacctaacggctgcatgcatctttggtgtctacatcagcctccatgatgcctgcataccggtggttggcaagataggtaccaacgttacgttgaacgcggtagatgttctttcccctcgcgatcaagttcgttggtcatacggtccaggcgggcaaggctacatgttatgcattttcactggcacatcaacaacaacgtttaacagcacgcgctttaatttttcatgtctgagtaattacagcctcctcctcattaacgttaccgcgcagtatagtactacctatcgtactatgacatcgctagacgattggcgtcaccaaaaacataaccatggttttcgatggactttagacacatgttacaatctgacagtgaacgaaaacggtacattccccactaccaccaccaaaaagcccactacgactacgagaacgacaactaccacaacacaaaaaacaaccaccacgagaacaaccaccaccgccaagaagacgacgataagcactacccatcataaacactccagtcccaaaaaatccaccacccctaacagtcacgtagaacatcacgttggttttgaagccacagcagcggaaacaccgttacaaccaagcccacagcaccaacacgtggctacacacgccctctgggttttagcggtcgtaatcgttattatcatcattatcattttctactttcgaataccgcaaaagctgtggctgctctggcagcatgacaagcacggcatcgtgctcatcccccaaaccgatctgtgagcaagtcgcgtaggaaacgattgcatgaaatcactgtgaaacgccaactccgtgccaactggcacggcggacaggcctttgacgtatttgaagccaggcgcgctcttgataccgaaaggatccgagggggctttccaaagccgacgtccctgattcccttcataaagctgttgaccggccctagaaagaccaagagcatgctgtgggcccactgcggtcgcttcttgcgttatcatctgctcccgctgctgctgtgtagactgccattcttactcctttttcagcggccgcagtgggcccacggcttggacattgtcgaggaggacgagtggctacgggagatacaaggagcgacgtaccagctgtccatagtgcgccaagctatgcagcacgccggattccaagtcagagcggcgtcggtcatgacacggcgaaacgccgttgacctggaccgaccgccgctttggtcgggatcgctcccgcatttgcccgtctacgatgtgcgttccccgcggccgttgagaccgccgtcatcacagcatcacgccgtatcacccgaactgccgtcgcgaaacgggatacgttggcagtaccaagagttgcagtatatggtggaagaacaacggcggcgaaatcagtcgcgtaatgcgattccgagaccctcgttcccccccccggatccaccatcgcagccggcagaggatgcacgagacgcggacgcagaacgtgccgaatcaccacatagtgcagaaagcaccgtcaggcacgacgcgagtgagaacgcagtgcggcaacggcgcgaaagacggcgctataacgctctgacggtccgcagccgggactcgctgctcctgacgcgaatacgcttctccaaccaacggtgtttcggacgcgggcgtttgagacatcccgcgggaagtggtcccaacaccggcggaccgcgacccggcggtgcgggactccgtcaactacgccaacaactgacggtccgctggcagctgttccgcctacggtgccacggttggacacagcaagtctctagccagatcagaacccgctgggaggaaagcaacgtcgtgagccagacggccacgcgagtacgtacgtggtttgtggaaagaaccacgttttggcgtcgcacgtggattccgggacagaacccggcggccgaagcgcaagaactggccgtcataccgctggcacccacggtgctccagcagaacgaggaaccacgtcaacagcttacgggagaggagacaagaaattcaacgcacactcaacgtgaagaagtggaggacgtttcgagagaggacgcgagagaagggaatgatgggagccgagcaagtggaaacgacgagagaaggaataatgcgggaagatatgatgatcacgaggttcaagagccgcaggtcacttatccagcgggacaaggagaactgaacaggaggtcacaggaggagaacgaggaaggtggaccgtgtgaatcgccgccaatgacgacaaatacgctgaccgtggcctgtccgccccgcgaacccccgcatcgtgccctgtttcgtctatgcttaggactgtgggtctcgagctacctggttcgacggcccatgacgatttagaatacaccgagccattcctttatttcccccccccccatccccggtcgcttatgcgtgtcaaacactaccaataaagataatctgccaatagcaccttatatataatatgtggtcgcgtgtggtctttttaaggagccctgaaacacagacaggtatgggcggtggccggctgccgccgctgtggctgccgctactgatcgcctggagcgagtggggcaactgctgcctcgatgcgcctccggtggtgcgttcgccctgtctgcagccggtgcgcgaccgcaaccgcgagcggaacccgggctcaccgcagttgctgccttacggcgaccgtctggaggtggcctgcatcttccccgcgcacgactggccagaggtctctatccgagtccacctctgctactggcccgagatcgtgcgttcgctggtggtggacgcacgcagcggtcaggtgttacacaacgacgccagctgttacatcgccggcgggcgctggcgttttgaggacggcggcgcggcgcagcggctgagcctctcgtttcgtctcatcaccgagaccgcgggcacctacacctgcgtgctgggcaacgagacccacagcctggcgaccgagaccacggcgctggtggccgacgtgcacgacctgcgccactcggaccgctcctgcgacctggctttcggatcgcgctcacagacgcggtacctgtggacgcccgatccctccaggttgcgcagtataaactgcggttgggagggtgaacggcaccgcgtagtccactacatccccggcacctcgggtctgctgccctcgtgcgaggaggacgagcgcgaactgtgcgtgcccttcatcagccatagcatcgccgacaacaactgcagccgccggcatcgagtagacggcgctaggcggcgctatcatctgcggagggattactggctgacggatccgaagatcgggctgctggccgcgggatcggtggccctgacctccctctgccacctgctgtgctactggtgttccgaatcgtaccggcgcctgaacaccgaagaggaaaacgaggcggcggaggaaactgccgcgggagaagcctctgcggtagcggcggcggccgtctctgaggaagagcagcagcgggagtaaacggggagagccatgaagcggatgattcgcagtcacggcaggaaaacggaatgtcagatgacgggcgccggcgagcgacgcggctccgccgtcggtgcgctcatctgcgacagcggtacccgacgcggcagcggcgccaacgaacgccgcgactccgacgtcggtcccatcgcccacagtagcggtaccagacgcggttcggcaaatgaaacgtccgcctgtacgcggaccgatcaccagaaggcggacattgggctgtggttcatgtttctgttttttggactgtgttcgtggttagcgatgcggtatcgcgcacaataaattttgaatccatatcaaggaacgcgtgttttgtattttattgggaatattggcggggataaaccggtttcggatgtttacccttaatcttaccggggacctcgttgtcctctcccccttcttcctcggacaccgggcttcatgctgacgtaggtaccgactggggtcaaaagcctgggtacttatggggagcgcgcacaaaggaccgtcaggcgccggcatggagcgtcgccgaggtacggtaccgctgggatgggtgttttttattctttgcttatctgcctcttccccgtgtgctgttgacctgggtagcaagtcctcaaactctacctgccgcttgaatgtgacggagttggcctcgatccgtcctggggaaacgtggacgttacacggaatgtgtatctctatctgctactacgagaatgtgaccgaggacgagatcatcggcgtggcttttacttggcagcataacgagtctgtggttgacctgtggttgtaccagaacgatacggtgatccgcaatttcagcgacatcaccaccaacatcttgcaagacggactgaaaatgcgaaccgtccctgtgactaaactgtacaccagccgcatggtcactaatcttaccgtgggccgttatgactgtttacgctgcgagaacggtacgatgaaaataatcgagcgcctccacgtccgattgggctcgctatatccgagaccgcccggatccgggctcgccaaacacccctccgtaagagccgacgaggaactgtccgcgaccttggcgagagacatcgtgttggtctcggccatcactctgttcttcttcttgctggccctacggatcccccagcgactgtgtcagcggctgcgcattcgcctgccgcatcgataccagcggttacgcaccgaggactgaacggataaccgcaaaggccacgtgcaacgttcacgctgctataagaaggccatgtcccccgtggacgggtctctttgacacgagcgcggcacgccgttgccacgagcatggatcacgcgctcctcacacacttcgtcggccggccccgtcactgtcggttggaaatgttgattctggacgaacaggtgtctaagagatcctgggacaccacggtttaccacaggcgccgcaaacatctacctcgacgtcgcgctccgtgcggcccccagaggcccgccgagattcccaaaagaagaaaaaaggcggccgtccttctgttttggcacgatttgtgctggctgtttcgacgacttttctttcctcgggaggactcggagccactgatgtcggatccggcacggtctcccgaagaggaggagtaaacaacacacggctaagaggatacatcatcaaagaagataggaggggtcaaaacgcggactgaaagtatataacgccgatcatgtccgaggaactgttaataaaacgccatgatgacaatgtggtgtctgacgttgtttgtgctgtggatgttgagagtggtgggaatgcacgtgttgcgttacgggtacacggggattttcgatgatacatcgcatatgacgttgaccgttgtggggatttttgacgggcaacacttttttacctatcacgttaattccagcgataaagcgtcaagtcgggccaacggtaccatttcttggatggctaacgtctcggcggcctaccccacctacctggacggggaaagagccaaaggtgaccttatttttaaccaaaccgagcaaaacctgttagagctggaaattgcgttgggttaccggtcacagagcgtgctgacgtggacgcacgagtgtaataccacggaaaacggtagttttgtagccggttacgagggatttgggtgggacggggaaactttaatggagctcaaggataacctgacactatggacgggccccaattacgaaattagttggttgaagcaaaacaaaacgtacatcgacggtaaaattaaaaacatcagcgagggggatactacaatacaaaggaactatctcaagggtaattgcactcaatggtccgtcatttatagcgggtttcaaacccccgtcacccacccagtggtaaagggcggtgtccgaaaccagaatgacaacagagctgaagcattctgtacatcttacgggttctttccaggggaaattaatattacttttatccattacggtaataaggcgcccgatgatagcgagcctcaatgcaatccgctacttcccaccttcgatgggactttccatcagggatgttacgtagccatcttttgcaatcaaaactacacctgccgcgttacacacggtaattggacggtggaaatccccatcagcgttacctcacctgacgacagttcctcgggggaggtccctgatcacccgacagctaacaaacgctataacaccatgaccatcagcagtgtcctcctagccctgcttttatgcgctttgctattcgcgttcctgcactactttaccaccttgaaacaatacctacgtaacctggcctttgcgtggcgctatcgcaaggtccggtcgtcatgaccagcaacgccctgtatgagctgtttcgacgtcggttaccgcgtgcccccgtcaacacggtcatgtttctcacgcgacgcactcgtgatgggttctgcggtcggttgacgtccatcgccacgaattcccactacactatgttcgtgttagatcacggatccgtgcgcatcgagcgaccgagtcagtcagaagtggattgcgccagtttaatggaaacgctgaagcggattcggttacgaaattcgtgggtagcgtcagaagacgagctagatgtgagtcgcagggacgcgtgacacgaaacgcgttcaggattaacgtaggttttcgaaataacctacgtccgtgagtgacgcggtttcgtgttgaaacccgcgcccgcttctcacggtggtttatgatgaaaccggcgttgcggatccacgcgggttcctcattcaacctgcgaaaagaggaagttgcggtaaaaccacgtcaataaagacgtcaatgacacctcaatgttgcgttggaacggtctttatatatacaaacgccgttatgatcagtgtccggcaagatgctcgggatacgggctatgctggtgatgctggattactactggatacagttgataacgaacaatggcactcgaagcaacaataccgataccatctttgtatctctccttaccgggcccaacggagttactcgcacagccatcggaggtctgtattcaaactacaccaacttaactggagcatttggcttcacttcaacaaatatgtcagcaaccaactcttccgctgaggataattggagcgtaaccaacctgacggagagttgcatcaaccgcggtgagtcctatgtgactaccatctggcttctggactgcactaaaaacgatacttattggtactatggaaatgcctacaatcatacatgtgaaggtacaatttcgggatatctcctgggcatgtgcaagctatggaaaagttgggtcaataatattacttcttataacactgtcagagtcgaatcgctgggaaatgaaacacggtgcatgctgctccctagacagtatactctcaacgccacggtggaatggtacaacaaatctgaaggtgacgtaccagaagaattcatggactatgttatcctgacccccttggctgtgcttacatgcggactgcaggaagcttatatactcgacaaaggtcgtagatacatgtatttgttttccgtgtcctgcgtgggaatcacaggtaccgtatctattatactcgtctccctatcgctgctcatcctcatctgttactatcgctgtggccggcttctgatatgcccacgcggctttgaactcttgccagaattcactgaggaagaggaggaaaaagaaaaattgttaacgcataatgacattgaagtccaagtgcctattcgcacgcggcgactactcgtcccttggatccgggagagcaaaatgtgggtactaccacccccgttgcctccacgacctccccacttaatagaattcccgccgtctcctccgtcatcgcctgggcccatgcacatggtggtctgcatgccagcatgacgaactttggactctgagccccaagcggtacgaactacatattttccataaatctacactgaacttgagcacaaagatactgacaatagactggatatacagacttttatatgatccctgtacagatgtaaataaaatgcttttatttaaaactggtcccaatgttcttcgggaatcatggggtggggacgggggacgcggtagggagcaaaaccgggtacatgggggggaacatcgtccaacagtagcaccagcggattgggtaggggttgctgcggaggtcggtcgatgacgatgtcgatctccatcggcagatccggcaacatctcttcatctccctcaccgaccagcactcggcgctgttctggatgtatatgattctggaaaagcctccgacgagctcgcggcgcgtagaaagccaagcggcgcaagggccggcgagcccgaaagtccatgcgcacagatggcatgagtccttgagtgacggtggtgagctggggaacagggctacctcccatcgcgacggtgacagtggatccatgagagaggcgccgcacgctgcatggctaaataccgtgaatcccctgacgtcgtctttcgtcccgaacgcgtcatgttgggggcgaggcgtaaaccgtcgaggttgaaaaaccgcgtatctgcgacccgtccggactacgttgttttttagaagcggccacatgacctcgagatgtcgtcacccaaggtatttaacggcacacagccagacgcgttcgtcagcagcgacgccgacaagacctcagcatggctcggaggctatggatcttgagcttactagccgtgaccttgacggtggctttggcggcaccttctcagaaatcgaagcgcaggtaaacggaatctggggaattcaacacaggtaagaaatataaaaaaataacgtgattgtgaacgcggttatcgtgtttttgcagcgtgacggtggaacaacccagtaccagcactaactccgatggtaataccacccccagcaagaacgtaactctcagtcagggggggtccaccaccgacggagatgaagattactccgggggagactatgacgttttgattacggatacagatggaggtaaccatcagcaaccacaagagaagaccgacgaacacaagggagaacacaccaaagaaaatgaaaagacccagtagcagcagcagatcccaagggttaaagaccatgttgactattttgttttttattaaaaagctgtaaggttttgctctaaaaacaccccgcctccggtcttttttcttttgtattcggcacgcgaaacacggtttcttcccatagcctgtctaactagccttcccgtgagagtttatgaacatgtatctcaccagaatgctagtttgtagaggctatgcgggatgctgcggcggcgcgaccttccctctccacccagccccgtcaaaacacacgcgactcgagcggttcgtatgaaaaataaaaaacagctttttatttacaggaacggggaaaaaaaaggcacacggtccgtgggagacgcgggttcacgcgtcgtcaaaaagttggtggtccactccgtaaggacaggtaggcttatttagcttccgcatgctcctggttccgtaataaatgccgttttcgtggcagcgtgtcatgccgcgagtcacaaactccatcaaactgtcggccacgatgcaaacgtgctgattgttggcagcaaagacgcgcatacagtcgtccacgaagaggttgatcacgtcgtaggggctcaccaaccagcctaaaggttccacgtggttactgccgaccatgaccctccagtcgttaatctcgctccagtcgtacagccgaatcgtggagacgcgaatgacgctgtaatcacccatgaccatgagtcggccgcgatacgtagcacgccactgcgcgaacgcgtggatgtgcatgcagccggccagcgctctaagcgaggcggtgtgcggcagctcctctgggacggtgatgaagttgcagcgtcgcaaaccgatgttgagaaattcagtgatgctctcggccacaaaggtcaacgagtcagagtagatgtggtcggtccacaggtacatggcgcccgaggcgcccaggtacagttcagacggcacgttgtgatcgcccttgtgtttaagaaagttgtaggtgcagatgctgccgacgaaacgcagcggctcggggcagcagaggtagctggccagacgctgtgcatcccgtccttcgtcgcgcaccaagcgccagcgacgccggataacgaggcagcggtctttgggccagaccagggccacgcgttgcccgggtttccacggtcgcgacgtcttaggaggcctccagcggtcgagcagattgagaaaacagtccttgattaccgacatcgcggtcgcgcgtcggtggacaaaaagaaatcgggccgatccagaaaaaaaaaaaacgacagcgaaacaccgccgtgctcgagcgaagggtggcggagggccagaagaggcggccttgacgacgttggcagcgaaaaaattggcacgcgagtcaaacgggaagtagcgtcggtgttttatgccccaagcagcgtcgtcgtcactcgtggcgtcacagtcaacggtgctgacgtcctttggggcagtcgggcacgcgatcgtagatgccgttgtggccgctgaaacgtcggttttcaaacagcaggttaagtcccagacacatgaacgtgttcagattatctcccacccggatgtagcggtcgtcgcgcacgtcgcaggcgtagacggccccggtataggcgacgacgatggggataaggtcgacgggccagcgcaggtgaggaaagggcgcgttctcgcccttgaggctgacggttcccaggccgagaacgcgcattccgaaagcggttttgatgttgcgcagcaagtgaccgccttccacgctgttttcgaaacacctgaggttgcatagacgcagttccgttcccggcgggaacgtcaatggcatgaactgcccgtggtggcggatgatgaatcgtgccatggtatccaaaccgaggctccaggcgcgcaacagcgggcgaaagtagcgcttaaccaacgacgaggtcaggtagcgcatgcagtgcagggtttcgacggcgcgcagcccgacgcgcgcaaactccatgaggttgcgggccaggtagtagacggcggtgtcctcgcgtacatagcaaaagacatagccctcgtccgagatgaggcacacggcggtcttcttctgctgatccggcgacaacacggcctcgttcacgaagcgacccacgaaggccaggcgcgtctcgcagcacaggtagtgactccaagctttcacgtcctccggtttgaagtcctcgtccgtctcgatctcctgcagcactaggttccagcccggcggccagaccacgggcaacacctggcctgcgttgatgcgcacgtaagcttccagacagcccaggccgaactcggccgtgagcgccaggctagccagatcgctcatgtgacgcgccgagtcggtgggcgagcccgggggcccgtcgcacaccacgctccgtcttcttgtcctcaccgcggccagcgtggcgaggacactttccgcgcccgaggctgtatcttcggtttgcccgccggagccggccctcactatataacgtcccgcccgggtctcctccatgtatgcaggtaagcaactgagccgaacgcacctcagcagacgagaggatgtcgtcgcggcgtcgcagctcgtcacgtcgctctggcgaaccctcgacggtgatttatatcccctcgagcaacgaggacacgccggcggatgaggaggcggaggacagcgttttcacgagcacgcgggcgcgcagcgccacggaagatctggatcgcatggaggccggtttgtcgccctacagcgtctcctcggacgctccgtcgtccttcgagctcgtgcgcgagaccggcggcaccggcgccgccaagaaaccgagcgaaaagaaacgatcgtcgtcacgtcggcaaccgcagatcgcagcgggcgcgcctcggggctcgccggcgacacccaaggccggcaagtcgcctaaagtctcgcgaccgcctagtgtgccctcgctgcccgagaacggcgccggcggcggtggcgacgataacagcagcagcggcggtagcagcagtcgcaccaccagtaacagtagcagaagcaccagtcccgtggcgccaggtgagccgtccgctgccgagggcgatgagttttccttctgtgacagcgacatcgaagactttgagcgcgaatgttaccgggtcagcgtggccgacaatctgggcttcgagcccagcgtggtcgcgccgcagcacgtcgagtatctcaaattcgtgctgcaagactttgacgtgcagcacctccgccgcctcaacgaatgcatacccatgccggccttcgcgctcaccagcctcgtcgaccccgtcttaaacaacgtagcgcctggcgagcgcgatctcacgcgtcggataatcacgcacgcggtgatcatcaactattactacgtggcgcaaaagaaagcgcgccacatggtggaggccatacggaccaccgtgcgggacgacacggtacgccgggtagccgcgcaggtcaacaaccagagccgttcggggcgtgcggccgcgctagcgcttcactttctcacgtcacgaaaaggagtgacggacggtcagtacgccacgtctctgcggcggctggacgaagagctgcggcatcgcggcacgcccgaatcgccgcggctcaccgaggtctaccagacgctacgcgattacaacgtgctcttctataccgcccactacacctcgcgcggcgcgctctacctctatcggcaaaacctgcagcggctcaacgaaaaccaccggggcatgctccggctgctttcggtcgaagagatatgcgaagagcacacgctcaacgatctggcgttcctagtaggcgtcgagcttatgatcacgcactttcaacgcaccattcgcgtgctgcgctgctatctccagcaccagctgcagagcatctcggagctgtgttacctcatctatgtacaactgccgtcgctgcgcgaagactacgcgcagcttagtgacgtgctctactgggccgtcagtcaaaactacgactacgcgctctacgcgagcacgccggcgttgtttgactttttacgcgtcgtgcgtcagcaggacgccttcatttgcaccgactacgtgtactgcgccctgcgtctgctggcctgtcccgacagacctattatcggtgacaccggcggcagcagtagctcccaacgcctcgtaggcgagtttatggtgcgcgatccgctgttgcgcgacccgcgcgccacccacctgcgccagaaactcatcacccgcgacatatgcgtggcgcggttgcaagcgcagccctcgagtcgacacattccggtcgaacacacgggtgtctcctccgtcaccctgctcaagatctttagccaggtcccccccgacgaacgcgaagaagacacgttacgcgagatggctcttaaagcgtttatggaagcgaacggtaatcaccccgaacaaatctgccgatccccaccacccccgctgccaccgcgcgactatcctcaacgcgacgagcgggaccgtcaccgtcgcgaccgccgcgacagcggggaatactgttgctgatggtgggacgaaacagcagggcggaacagtttatgatagaaagtcacaggaaagtatgtgttgttttttttttaatgtaccaagaataaaaagtgcgtctacgaccaaagcggtgtgtggacgctcgtcctctgtcttctccggtttttttttatgtgtgtgtttttcttttccttcctattttgttacggcaacagcgctgatggcacgttgccggcttcgaacatcgcgtcggtgatttcttgcttgcccggcgtcacacggtgacgcagcagcgcgcggctcacgtagcaggccgactcgcggatgacctggccgtcggcgtcgcgtcgcaggcccgagcggttgccgtgacgcagtcggccctgcgcggcgcgctccacgtcttcaaagtagctgtgtagcaggccgcgctccagcagctgcggcagcgagtcggcggcgcgcaccacaaagttctcacggctgatctcgtagcacagcacgctgccgtcggctgccacgccggccacgctgcggtcccaactgaagaggttggcgagtccgatggtgccgatgacgcgcaactgaccctgggtcaccaccagcagcttccagtattctacgtcgcgcggggtgaggatggtctcctccacgtcgcagacaaacaacgtgtagccgcgcggatagggcagatccaggtggcgaccgcgctggcggcgcataaaatcgtctaaattcaaaccgccgtcgggtgcgcgcctgctcgtcatcgccgcgcctcgtcggtcgatgaccccacggtgcttataacgcgccgccgcggcttcatgtggcgtgacctccgacctcgtgaggccgaaaacggcgtacatgaagacgctcaaacttttgaatgtgggcccggtagcgcaccgagggccccggggcggcgacgacggcgggtccgagttccagcggggccttgcggcggcagcggttggcgtggttgctcagctcggcgtccgagagcgccgagctgaactgcggcagccgcgtgcgatcctgcggcgcgtccccgtgtcgcagcgagtgccagagcaggcgctggacgcgcgccgtctcgggcgtcggcggcgcgcgacagccccggcgcagcttgaaaacgtgcaggcacagcagctcgcgcttgatgcgcagcgacacgctgcggtagtcgggaatccgctgcaccagctcgagaaagtcgcagaaggtctccacgaacgtgtcctcggtgaagcgaatgcgcttcagatcgtggacgtgtttgcgaaaccgcgacagttctcgacgttgcacggggttctgagcgagtcccttgcgcagcagcgcagcctcgcctttaaacagcctgatgagccgctgcacgtccccgctcaacatacgtatacacgccgtgtactcgtgacgtatactggcgcgcagcagccgaatgatacgcagggccagcacggcgttggaggccaggtacatggcgtagccgcgacgcgggttggcacaggcccagcccgcggggagcagaaagtagtcgtcgaccagcgtctgcgaccagtcggcgaagcccaggtcacgtgatacgctgtcctggacgcgggccacgtcgccggctgtgaggtggcggatcgccggcaggtgaaacgcgcccaggtgtcgattgcgctccagcctcagctcggcgtgctccaaacgggaatggtgggacgccaccgcggagggcgacaaagaggagtggtcgccgccgccgtagttaccgttgtgattaccgccgtcgtcgcgcccgtcgccgcactcgcaaaaggccgcgtagaggtccttcaacgccgcttcggctcgcgccataaacgtggcgtggaaaaaaacggcggcgcggtgcgtccggtacttgacgggcaacccgcggcacagggccgccggcaggcagcggccgatgagttcgcgctcctcgggctccagaaacaggcacagggtgccgtccaggcgcaggtacagctcctcggtcatcgagcatagctgccgcaagtaatgggtgcgcgtcccaaaggtcttgtaatcgagcaacgtgcacaccacgtattgccccgtggccacggccagagcgatgcgtttggcggcgcgactgatctctggcaagtactgcgcctcgtgcaccagacggcggaaagcgccggcgttgagccagcgaaaatgctgcggatcgggcggcaagggcacgcctcgaagcgcggcccagacagcgaggtccgactcgagcgtcagaccgcggatgtcgtacttgccgtgcgccgtagcgcaggctgaatggaccagacagctgcggcgaatgtacaccatggcgtgcttgggatgtttgggcgccggcgttttctttttctgaccgccggcggccgccagatcctcgggcgtgcgacacaacaggccggcgcgcacagcctcctgtcgattacgaatcggcgtcaggtaggcgcgcaggaactggtgacaaaactcctcatcatcacgacagtcgtcgagatactcgtacgtggtgagcggatcgcgaaataggcgctcgtcaccgtcgtcatggtcttctttagcctgctcctccggctgctgggttggcggtggaggcggcggctgatccacggggttcatgactgagaggaagaagaaggtggcggcgaagcgacgcggagcgacggcggtaaagccagacaccggctatatagctagtcatcacagtctcctccttcacgacgcccccgtgccgctcacgctatccagcacgctacggcccgaaaacacgtactcgctgacgtcgtacgcgggcgatgtatggctgctcaccggtttcgcggcgacggttgcgctcgagtccaacggcgagaagcaaaaacgccgtgggcaacgaaaccagaaggagccctgacggataaaaccgcgcagcgtctcggccaacttaaccagcatcgtaccgtacagcagtacgtgaatgccgccgtgcgcgtccataaatacggctttgtttacgggttccatccatccgatgactacaaagtgagcctgttctagcacgccgatcacaaaattgttggcctcgtcggcctcggccacattccacgagccgaaagtgaaagtacaagcgggcgagccgcccaggcggattttgctaccggcgtggagctgacatacgcgcagcagattggcgcggtcgtgcagtatctgggagagttcgtacatgcccgcgaaggtgtgcttaaaccacgcgccctctacgatttcatccacgtaatcgcgctcaaagaagctatacacggcaaagaggccgttctcaaaaaactcgccgaacgagagccccagcacgtacaccttgtcctcgccgggcaggtacgcaaaggcgtgcccgtgcccggagacccagatctcgggcgccgtgtttgcgtccggcacgcattcgtacacactgacgaggccgataaagtacaagcggccagcctggcgcaggcacgagaagcgccggtaggtcttgtgatcgcgcaccaccccaaagtactgagtgtcgcccagcatgatgccgtgcagcggcggccagcacagcgggagccaacgacccgccgtggcgcgcacgtagcgctgcaggtgaaccccgctcgcacgctcgcgcggcttcgggcgcttgtgggtccaggcatcacgcagaccgcgccagatgctgctgaacttgggctgcccgcgcagatagagcgacgagagcgagtcaaagtagcccacgacgagcctgtcgggagacacaagagcgcgaaaatcaaacctagagcgacgacggtgaaaaaaccgattataagcgcgtgtctcaaacacgctactttcggttataaaaacaccgtcgccctatttctgggcgtgtgtacactgatgactcacctacgctttttgaacggcagtctcagctcgggattggcctcgtacagcgagctgcggtccacggggccgatgctctcgtagcgaaagtcgtcgatgagcagcgccagccccacgcgcacgaagcccctgaggtcgcgcgccagccgcaccaacttatcctgccccaccagcgccgcgtacacggtacccgtgtcgccgcagagaatccgcacgcggtgaaagaaggtcttgtcctcggcgccctcgatctcgcccagcggcatgacgggctcgcgcgtgtacaacgaacgttgaaagcggcgcagcatcgaggccgagagccccagatcgcgcgccgtgcgcagcaccagggaatgcttctcgggccagatgagggtcagctgcgcctcgcgatgcgcctctacgtaggcgcagcgagcggcggtgtcctcgcaagccagcaactcgcggaaagccagcagcgaacgtaggtagcggccgcgagcggaggcgcgcgagcggcggcacagctcggcccgatgatcgggatgcaccaagggcacgttgggttgcagacgcgcgcagatggattcgtgcaccgggtcgcagcggatcatgcccttggcaaaaaatccggccagatccgaggccaactcgtacaggcagtcctcttgcgcgtcgtaggcgaacacggcgccgtacgcgtccacgaacacctggtaccggcaggtggcgtgcgagaccgtgccaatgagatgcagagctcggaattcgccgaaaaagtcgttctggcagtgctccagatcgatctcggtcagcgagtgcggcgaatgctcgcccccgaccacgtagatgcactgcgagggccagcccagcgacacgcacgagccctcgaagcgccgcaagtaacgccgcaggccctcatagtcgcgtcgcacgcacaggtcggccaagtcgcgcgtgcaaaagacctcgggtaccaagcagcgtttgcgacgcggccgacgcgcgtgcccgggcagaggaggaaggcgcgacggcggcgacgacgaggaggaagacgccgtggccgccgagcagcccttgcgacggccggacatgccggcagtccgcgacgatccacaggagacaaaaaagcagaagcagcagtagcctcggcgacccgctccaccccgtcctccacacgctcagccgcgactgaacgccggggcgcgccgctacttgggtttttatagccatctgccccccgtctcgggcacccgggagcgatctacggagacctgacagcagttgggcaacacaagatagggaaatacaaagacacttttaataaaaaacgagactactttgtgtgtgtgctccgtaaactgtttattctccccctccgcttcgctctggatgggctccgggcccgtcaacacgcgactcgcgcggcaaaaggcacgctgttgacggcgcgagagcccgtcgtgatagtccatcatgccccggagatcgtgcacaaagcagctgtcgccgcgcagaaaccgacgcagcgtctccacgtgctgcagctgccggcgcgtatcaggagccgtcatcgctgatgtcgtcatcgccctgacaggcgcgtagatggctccgcgagatcacgcgcgttttcaaccgccgtgacacatcaggtccatcttgagctggcgccgggcctcgcgcaggtgtcgcacgcgttgtgagcgggaggcgagttcggcttcttgctcgaactcctgctgctcactgtccgagagggtgcgataaaaggcggcaaagtcctccaagtcggctacatgcgccctgggtctgacgctccaaagcgtacgcagtctgatgaagcggacccatcgagcgtcacggcacgccgtcttgaacgcggggcccgggaagaggttcttctccccggcgcgctcgggccggcgaggccgacgcggtttatatacaccgtctcggacggcgggacgccgagcccgcgccgcggccgctcatccggagacggcggaaaccgcggcgccggaggaaacggggaccggcaacgacggcggtggcggcgaccagattatgggggaaaaacccacgcttgtaaccctgttgaccgtcgccgtgtcgtcgccgccaccgtcgtcgccgctgccgcttgtcagcttcacggagctgctgttaccgccgccgtccgtcgccgccgccgcggtggcggcgacagcgacgagcgaggtgggcgagaaaaccgcggagcaagaggtagcggctgcgggtccggagaccgggaatgagagaagagaaaacagggagaacgaaggaggggagacgaggacgacagacaccaccgcggtcaaaaggtcgcacgacggtatccctcgccaactagcagagcgcctgcggctgtgccgccacatggaccccgagcaggactatcgtctgccggcgcaggacgtggtgacctcgtggatcgaagcgctacgcgacgcggaccgcgataactacggtcgctgcgtgcgccacgctaagattcaccgttcggcctcgcacctgacggcctacgaatcgtacttggtgtccatcaccgagcagtacaacacggcctcgaacgtgacggagaaagcttcgtacgtgcagggctgcatctttctctcgtttcccgtcatttacaacaacacgcagggctgcggctacaagtacgactggtccaacgtggtgacgcccaaggcggcgtacgccgagcttttctttctgctctgctccaccagcgagagctccgtggtgctgcaaccgctcatcaccaagggcgggctctgctcgtccatggcggtttacgacgaggaaaccatgcggcagtcgcaggcggtgcagatcggttttctgcacacacaactggtcatggtgcccttcgtgccgcacgcctgcccgcattacgccgtgcctttcacgacgccgggaaagccgggctgcggcggtgctccgagcggcgttgcggggttggaggaggcggcgccctttggacgggtcagcgtcacgcggcatggcgcgacgctgctgtgtcgcgtggaccatctgacctggatcagtaagcgcgtaaccacgtacggacacaaaaaaattacgcgctacctcgcgcagttccgcggcacgatggacgacgacgaggcggcgctacccggtgaggacgaagcgtggatcgcgtccaaaaacgtgcagtacgaattcatgggtctcattttcaccgtcaacgtggattcactatgcgtggacgcggaacagcgccaactgctgggcaccgtggccacctccttctgtcaccgcgtctcggacaagatcacggcgcgcaacatgccgcgcgccttttccttctacctgctgacgagcgcgcagcgcgggtacgacctgcgatttagccgcaacccgtcactcttttttagcggcgacgcgctcaactgtccgcttctcaatgagcccaacgtgttttcgctcacggtgcacgcgccttacgatatccacttcggggtgcaaccgcggcagacggtggagttggacttgcgctacgtgcagatcacagaccggtgtttcttggtggccaacttgccacacgaggacgccttttacacggggctcagcgtgtggcgcggtggcgagccgctcaaagtcacgctgtggacgcgcacgcgttccatcgtgatcccgcagggcacccccatcgccacgttgtatcaaatcaccgagggcgacggtaacgtgtactcgtacaaccaccacacggtgtttcggcagatgcacgccgccggagcaaccacgttctttctgggcgacatgcaattgcccgcggacaactttctcacgtctccccatccctgaccctccgtccgtcctcctttcccgacacgtcactatccgatggtttcattaaaaagtacgtctgcgtgtgtgtttcttaattattcctccgtgttcttaatcttctcgatcttttggaggatgttctgcacggcgtccgacggcgttttggcgccccccatgccggcagaacccggttgcggccccgtaccgctcttctggggcgacgataggtcgaaagccaccgttttcatgcccgtcgtgctcttgacgggggaacctacggcggcggttcccgtcgagcggcgtgattgcaaagccgcgctcgcccccggtttcaggatggagggagaggccacaggcggcgcattcgatacgctgcttttggccgtagacgacggtgggtaaacggtggttaccgcgggatacgtcggcgtggtcgaggcggcccggctggtgccggacaggcgacccggcgcgctaccgctcacggggaccgagggcggtcgacctaccaccgctttgccgcccaaagtaggtttcaaggaaggaacaacaccgacacggccgccccggcctttcaccggagacgggggggcactcttggccggggacggagaggctgacgaaagcatggacagcggcgatgtggcgggggacacgacatcatcctccgtgggcgacaaaacggacgccgaagctgacggctgtcgagccgaagcggaagaggttcccgcgccagaagtcacgttccttgatgacgtcgttttagacgaagccggttgaggttgcaacagcgtggcgggtaccgtcgacggcgtgcccgacacctgtttctctagccttccctgaaccggtgtcgacgtcaccgtctgcgctcgggcggacgcgtgcggcgtcgcgactcgcttgcccagcaccggtttctggctcgtggatgtcgtcgtcattggagacgataacttagctttacgtattctggacggcgtcgactgctcgggcgtctgactgggaggcgaaatgacgtcgttgtaatcggacgacggtgttgtgtgtcccaggctgacgacggagccggtgtccgaggagtcgtcgtcttcctcctcgctgtcttcgaccggtgactctgcagtttggtcccttaaagcccaaacctcatcagcggcgttctgagacgctgtttgtgtcaccgcggcgcgtggagtcgacggcctccgaggggtggtggacacggtgttttgagaagccgtggaagtcgtaggcatcctgaagggattgtgagccaggtgaggattcttgagggcccacgcgcgttcgcgcggccagttggcggggttcatatccccgggcaacggcgccgtcggagcccagggcgagttaccgttgaccggggtttgggtacccgcgaaggtaggtgtcggggccggagcgggggccgtggaaggattgacaggcgtcggcgtgaggatggcagtgccggcgccagcagggacgttaactccggcgccgaacgtcaacgtcggttgctcgaacttgtacgcggtggtgacgggcggtttggcactcgtctcggtatccgtgatgtccaccagcgtgtcggtgaaacgcggatcttgacggttggggggatagccatccgagctgtcggaatcctcgtcgcccgagaaaagatcccctctggtctccgtgagcggcctcacgtcccacgcgctgtcccgacggacccttcccgggctggccttggtcacctgcggggagacgagactgaaagccgcgtgacgctgttgttgctgcgggatgttcaagggaccgctggtcggtttctgactgcccgaggataacaggccgctgaaaacgctggaaacaccgccaccactagcgacgcccttgccgctagttcccggtttcttgatgggcgtaaagatgtttttctcgtcatcgtcatcgtcgtcgtcctcatcggcactggagccaaagagcctccgggaggcgctcggtttacgtgccgggggcggtggttgctgttgacgttgctgcaggttctgctgcctctcctcccaagccttcagctgctgtttctcacgctgcaccacctcgtcgtccacccgtttctgccgctcgcgacgcttttcctcttcgtcgtaatagccgacggccgccgaacgggcggcgtgggcgtcggcggccggtgccagagaaccatgggcctcgaagcggaacggtttgtgtcccttccagggactggcgatccagctccagccgtccagcggctgcgtggggacatgtttcttgggtaccgacgagaaggccgaaccgccgccgagcgagaggagattggcgtcatcatcaaactccaacgacggcgagcgcgcgcccaaaaaggtgtgcgccgactgcgggaagctgtccacgtagatgtcaaagtcctcgatgagcagctccagcagcgtgtcggccgagtcgccgttttccacggcgtgcttgaggatattgcgacagtagttggaatcaaaggaaaggcacatacgcagctccttgaccagcagcttgcagcgctcctgaatgcgcgccagacatttgcgctccagctcctcccaagacctacgcacgttcatgatgagacggcccgtgtacacgagcttgttgacggcgttgaccagcgccgtgttggcgtgccggtccaggttaaggtcgagcggtttcacacagaacatgttacggcgcacaccctccaggttttcttcaatgcgctgcacctccgtatccttgaggtgcacaaaggcgatgggttccgtctggccgatggctgtgaccagcgtctcgcgcaccgacatcttggccagaatgaccgcgcttacgagcgcgcgctcgacgatctcggcatcgtggcgcacgtccgtatcgaattcggtatggtctagcacagccaggtgatcgcgcgccttaccacgatcaccgaacgggtaagtgtagccgcgacgcgccacggccgcgcaacgcacctcgaactcctcgagcaccgaggagaggtcggggttgtggaaacgcagctcgcggtagtatcccaaccaaagcatgagctcgttgaacagcaccgtacgccggtgcaggcgtttttcgccacattttttcaggatcttggggtgtgcctcgagatccacgtcgggcttttgcgtgagatggcgcagaaagttgaccagggctaccacatcgcgccgctgtagaccgataaactgcaaactcatgctggcttttctccagaacccggaagcgtcgtcgccccggactgcgcccgcggtctgctattcgcccgcgatggacaccatcatccacaactcggtgagcgtcccacccaaagggagggggggtagtttaatagcggaggcggatacgcggttttcttttaagcgccgctgacttgtttcttctgttttttcgccccgtgtgctgttccgcccagacccgcaacaacactcctccgcacatcaatgacacttgcaacatgacagggccgctattcgccattcgaaccaccgaagccgtactcaacacattcatcatcttcgtgggcggtccacttaacgccatagtgttgatcacgcagctgctcacgaatcgcgtgcttggctattcgacgcccaccatttacatgaccaacctctactctactaattttctcacgcttactgtgctaccctttatcgtactcagcaaccagtggctgttgccggccggcgtggcctcgtgtaaatttctatcggtgatctactactcaagctgcacagtgggctttgccaccgtagctttgatcgccgccgatcgttatcgcgtccttcataaacgaacatacgcacgccaatcataccgttcaacctatatgattttgctattgacatggctcgctggactaattttttccgtgcccgcagctgtttacaccacggtggtgatgcatcacgatgccaacgataccaataatactaatgggcacgccacctgtgtactgtacttcgtagctgaagaagtgcacacagtgctgctttcgtggaaagtgctgctgacgctggtatggggtgccgcacccgtgataatgatgacgtggttctacgcattcttctactcaaccgtacagcgcacgtcacagaaacaaaggagtcgtaccttaacctttgttagcgtgctactcatctccttcgtggcgctacagactccctacgtctctctcatgatcttcaacagttatgccacaaccgcctggcccatgcagtgtgaacacctcacactgcgacgcaccattggcacgctggcgcgtgtggtgccccacctacactgcctcattaatcccatcctgtacgcactgctgggtcatgactttctgcagcgcatgcggcagtgtttccgcggccagttgctggaccgccgcgctttcctgagatcgcagcagaatcagcgagctacagcggagacaaatctagcggctggcaacaattcacaatcagtggctacgtcattagaccccaatagcaaaaactgcaatcagcacgccaaacgcagcgtgtcttttaactttcccagcggtacgtggaaaggcggccagaaaaccgcgtccaacgacacatccacaaaaatcccccatcgactctcacaatcgcatcataacctcagcggggtatgagctttcctgttactttattcagaaagcaccagaacccgtcgccatttcccctcatatacggtacacgtccccctgatctgtcatcacggtacacagatttcgcccgactgcggacgccgacggccaatcgcgtggcgtaggagtggcgccccggcttcattataacgccacgtcggagcccctgcgcgccacaacgccgtccggcgcaacttctgtctcggcacggtacgataaaaacgacgtcccccgtcgacgttgttttctccgagcggtgatcgttcccgtccctatcctccctccgcggcccccacggcggcggcctgctcgcacggacctatactattaccgccccaccgccgtcgtcgtcatgaacttcatcatcaccacccgagacttctccaacgacgattcagtcctgcgagccgccgagatgcgtgacaacgtggcaggctcgatttccaaagcgtacaagggcacggtacgcgccgaaggcaagaagaagctgctgctgaagcacttgcccgtgccgcccggcggctgctcgcgccgcaacagcaacctcttcgttttctgcaccgaacgcgactaccgcaagttccaccagggcatcgcacagctcaagcgcgcgccggccgaactggacccccacgagatccagcaagtcacggccagtatccgctgccgcctgcagcccagtctccgcgagccgcccacgccggccgacgagctgcagacggctgtgtcgcgcgtgtgcgcgctcttcaaccagctggttttcacggcccagctgcgccactactgcgagcaccaggacaaggtggtgagctacgcgcgcgacgagttgaccaaacgctgcggcgaaaaatcggcgctgggcgtggaggtgcatcaactggtagccttgctgccacacgagcgccaccgcgaactgtgccacgtcctcatcggcttgttgcaccagacgccgcacatgtgggcgcgctccatccgtctcatcggacacctgcgccactacctgcagaacagcttcctacacctgttgatgaactcaggtttggatatcgcgcaagtcttcgacggctgttaccacagcgaggcctaccgcatgctcttccagatcggtcatacggactcggtgtcggcggccctggaactctcacacagcgcggcggccgggctgcccgaggccgatgagaacaacgacgagggagaggaggacgacgacgagctccgtcacagcgacccggcgccgcttcacgagtccaagaagccccgcaacgcccgtcgtccccgcacacgcatgccgcctcacgagcaaaagcccgaagaaaacgaggaggaagaagaggagctgtttccctcctgcaaggcaaccgcagcattcctgcgggcagaaccctccgtctccaacgacgacggcaacggcggcgaacgctgcgacacgctagcgaccgccctgcggcattgcgccgacgaagaagacggacctctagccagccagaccgctgtgcgggtcgccgcgaccccctcaccttcagtcaccccagcccttacccccgtcacgtcccccataaccccgttgtgtatttaacgtcactggagaacaataaagcgttgatttctcaagttccgctctggttttggtttcgttttcaaagggagccccatcatggcccaaggatcgcgagccccatcgggcccgccactgcccgttctccccgtggacgactggctcaactttcgggttgacctgtttggggacgagcaccggcgcctgctgctcgaaatgttgacccagggctgctccaactttgtggggctgctcaacttcggcgtgcccagccccgtatacgcgctggaggccctggtggacttccaggtgcgcaacgcttttatgaaggtaaagcccgtggcccaggagattatccgtatctgcatcctcgctaaccactaccgcaacagccgcgacgtgttgcgggacctgcgcacgcagctcgacgtgctgtactcggagccgcttaagacgcggctgcttagagggctcatccggctctgccgcgctgcgcaaaccggcgtcaagcccgaggacatcagcgtgcacctgggcgccgacgatgtgacattcggcgtgctaaaacgagcgctggtccggctgcaccgggtacgcgacgcgctggggctgcgcgcgtctcccgaggccgaggcgcgctatccgcgcctcaccacctacaacctgctgttccacccaccgcccttcaccacggtcgaggcggtggatctgtgcgccgagaacctgtccgacgtaacacaacgtcgcaaccgaccgctgcgctgcctcacctccatcaaacgcccgggctcacgcaccctggaggacgcactaaacgatatgtatctgttgttgacgctgcgacacttgcagctgcgacacgcgctggagctacaaatgatgcaggactgggtagtggaacgctgcaaccggctttgcgacgcgctttacttttgttacacgcaagcccccgagacgcggcagactttcgtcacgctggtgcgtgggctggaacttgcgcggcaacacagcagtccggccttccagccgatgctgtacaatctgttgcagctactgacgcaactgcacgaggccaacgtgtacctctgcccgggatatttacatttcagcgcgtacaagctgctgaaaaagatccaatcggtctcggacgcccgcgagcgcggcgagttcggggacgaggacgaagagcaggagaacgacggcgagccgcgcgaggcccagctcgatctcgaagccgatcccacggcgcgcgagggcgagctttttttcttctccaagaacctgtacggcaacggtgaggttttccgcgtgccagaacagcccagccgctacctgcgccgacgtatgttcgtggaacggcccgaaaccctgcagatcttctataacttccacgaaggcaagatcaccaccgagacgtatcacctccagcgcatctatagcatgatgatcgagggcgcctctcggcagacgggcctgacacccaagcgcttcatggaactcctcgacagagcgcctctgggccaggagtcggaacccgagatcacagaacatcgcgatttatttgccgatgtttttcgccgtcctgtgaccgacgcggcttcttcgtcgtccgcgtcttcgtcgtcgtcctcagcatctccgaattctgtttcgctgccgtctgccaggtcgtcatccacacgaaccaccacgcccgcgtccacgtacacctcggccgggacttcttctaccacgggtctcttgctctcctcttcttccttgtcgggatcgcacggcattagctccgcggacctggagcagccgccccggcaacgacgccgcatggtcagcgtgaccctcttttcgccctactcggtagcctacagccaccaccgacgtcaccgaagacgacgcagcccgccacccgcaccccgagggccggcccacacacgcttccagggacccgacagcatgccgagcactagctacggcagcgacgtcgaagacccgcgggacgatctggccgaaaacctacggcatctctgaacgcggtttttcctctttttctacgtgtctgtctcaggacgagacgtcgatatcaataaaaataccgtcgacgtggtttttttaacagtgtggttttctttattgactagcggagtacacagtttacgagtaaaaaagacagggaaaggttatataaaatgctgtattatatacaaaaacatgcacataaacagacgggaccaccgtgctcgtcatcctctcctcaatcagttgttcatgtaggcgtgtggcggggtgaggggcggcatgccgttggcggcgccgggaataatgtgccgtcgaccgacgtcgcacaccttgaaacgccgtcggcgcacgcagcggtcgcaggacgggatatcccagaggaagcccatgtaggtctcggggtcctcgtcgtgaaagcggtaggagagttcaaagtggtgcaacgagcccgtccgagctcgcagcttctggcgaacaccctccacgtcatcggtgcacaacgacagtgctgggctctcacacagggcctgaagctcctgcggccacaggtgcgtggccaggggcgagtccgtcgtcaccagtttgacgcagtgcatcaggttctcggtgatggcgtcgtacaggcgactctcagcctcctcgtgcgtcatcacgtttcgaggcagcgacagctcgtcgtcgtcatcctcgtcaaacatgatcatggggtcaggggtttttttgggatgttgacaggtgggtgtcttttccagacgcacgatggcctcacgccggccgctgaaacggtggtttcggtgtcccttctttcccatgacgcaggtgaacataaccacgtcctcggccaaacggtagacggcgtccatggcggggtcgtagccgtagacgacgccgaaagtgtccaccaagacgtactggcgtacgaggaactctttgcgttctggcacctcgtggcccagcgcgcccaacaactggtggtaacaggtgatgcgcggcacggtacggatcatgagctccatggtctggatgctgccgcccgcgcggacgacgctgaaggatgtttccttgaacttcataacctctgtgttgtgggtccagaaggcgaaatgggtgtcgggacactcatcgaaagggtcgtcgatggtgtaggaagcgtagccccgcttggtcacctcggccgacaggctctccacgtcaccgcggtagagcatgacggcgttccagtaatcgtcgtactgcaccatgggccgctggtagtcgcgcatagtgtggaagtggtcgcagtgacgaaagccatgccgcagaaagtccttcatggtggatgccagctcgtagacgcagtcgcgcaggtcatcgtagcagtagatgccgccgcgctgcccgatgagcacgatgagttggtagcgcataaagcccggaccctcgacgaagccaaaggggtgcaggtattcctgacagcacacgtaagcacctggtggagaaataagaaaaatccacgcacgttgaaaacacctggaaagaacgtgcccgagcgaacgtcctctttccaggtgtcttcaacgacgtggggcttaccttgcgaacagacggtgcccatcttgcccacgaagggccccagggcgttgcgcgaacggagctggatgaagcagcgttcgggccaggccacgtgcagccgggtgccgcattcctgctccagaaagtcgttgagaccgttaaagtccccggctcgaatggcgatgcagccgtaggccatcagcgtgtcccgtaggtcgtccatgacggactcctctaccttcgctcgccgacgctgcgcttctccagccaccgctgcggtcgacagactccttcgtccgccttcggagaactacggcgcggcggcacggcctttatagacactatcagcgttgacgtcagacgatccgatgaacgtcgttttttgtgctggaacttccctcgtcccgacaaatgtagcggaaatcttcaagcaaatcgcgacgaagtccgatgaggaggatgcaaaagaggctgagcaacgcgatgctgcccgccgccacagtacatatgctcaacaacgcccagtgtcccaacgcgcgacttttggctcggagcagagccgaacggcggtttctccacatgacagataacgtggtccagtacgtccatcctttgcattccggcgtccagacgggaagcgttgtcatgttagttcccgtaaaggtcgtgttttgtcttgttttgtttctcatgagtttaacagtcctttttagaaaccgcgggcacatgtcttgtagaaagatgtaatcactctccgcgtatgtcgctagggttgacatcacagtggtagtgttttccgaagaagtgacgttgtcagtgatattgtcagtgacgttaatttcttcccagtgtacggataactcgaacggtgtcgtatgcgccaccgctctcaacacgtaactacggccggtgaggttaagtgttagttgtcccacggtcacattggtgtcatttgtaaaacacgcgatttctccgcgaacttccgtgacgttggtttcacgggtctcgttgagaacacgcagaggaaaccagccttccagatgatactggaaaccaaacgtaagcatgacgctatgccattgtctccgtggttgccgaaacgttacgttcagaggcagtttggcttcggctcctgcgcaaggcccgttatagatttgcgtgtcattgcgcgtacagtttaaccggcagttcatactcgtggtgttagaagtgatgttaacacccgtgccgtggtacgtgcatcggaccgaaacaccgtgtcccgtgctccaaaacagcgtcaacaacagccacacagacacctacgtggagacgacacgggactttttattgacggagactcacgtttctaccctcccctttcccgtaggtaaaaacccacgtttatcacacacgttgtttttacctgaaacccgcgcagcccgtggacgcgacaaaaaaccgcggcactagaaagaaaatgaaacaagtatgtttattaagcagcatgtggggctaataggggggataactgaggtatagcaactatgaaaaaatactacaaaaaaaaaagctgaacatggtcatctagcagcaaagttctccttctagaccacgaccaccatctgtaccacgtcgccctccccggtcgtgtacatcacatccttcaccacgaccggtggcaacggcggcgacgaggacaactcgctctcgacggaggccgggacgacagaggacgggggggtggtggcggcggaggacggaggggtggcggcgacagcggggtcttcttccgacacgggcgacggcaggctcggcggcgcggacagcacccgttgcgccggggcgtgagaaggctgagccccggtggcctggatgtgggccaacgaattggctcgcagcgagtcgcgatccacgaaggtcataggaattttcccttcgcggatccgccgctcagattccaggatggcgcgcacgtagctgttcaccgacttggcaaaagtgcgcggcccttccgtattcttgtcgcgacgcgcttccagcacctgcttttcgtagtccagctggtggaagaccatcaccaggtcgtccatagtgtgcgcgtgctgacggacgtgggagcgcacctccaccgggaacaaagcgttccaatactccagcacgatggcaccgtgccagaactgcgccatgctgggcgccaggaaaaacaggataccggagtcgtaggcgaacacgtcccacttgggcgtcatgaacaacaccagctgacgcgtgggccgcaccgaagcttcctcccaggcctcgatgaccccgaacatgatgagctcctggtccaacggggggcagtgtcgctccagccaactgatcttgctcaggttcatctgcagaaactcgtaagaggggtcgcagatgcacacgtagagacccgagtcgtgccgcagcctggctccgcgcttcatcagtttcctcaccgcgtagcgaagcgccaccttgcccaacgccgacgcctggatcagtccccccacgtccatctgcgtctgtcgccactcggcctcgtccagcaggctcgtgatagcggaagtgctatgcgtggtcgtagtcatcctttctatccttctctatgaatagcagcaatagcggtaaagtcccttcttatactatcccggagtctgtggttttttttgtttacccctgcttactggtgagactgctgggggccgttgtgctgcagcagctgagctcgtcgccgccgttgccacaggaaccggtgcctccgcagggcctttttgagggcctcgcaggcttctcgcgcaagtcctgagaggccctcggcgtcgatggggttcacctcgggcgtccgagcctcgttttcttcttcttcatcctccctttcctcctccgtgtcctcccgctctgtgtcctccgttacgctctcctccccggcctcggccaagagcgcagccaccaagtccacggaccgctcggtctccgagttctcaccgtcaattacgccatgttggcggcgtaaccggtgccgagaacgccgggtgagcgcacatgcttttttctttcttaaccaaggcgggagaggatcttcaaggcgttttcgctggatccagcggtagctaaagtaccaaaaggccagcaggcccacgctacctaacagattcacgtagactggagacataattaaagaaagaagtgaaacccgcgtgtgggtctcacgtcgtcttgaaacaccgtcttatatacatgaagatgccggacatgacgcgcccaagacacgtggggtttcccccttaggggacccggtttcttaagatgtttttcatcttcgcacgcgatgtactacatcaaagggtcggctgaccgaccgcattgacgcacagtttccgagtacgcgcgtctcggagcacctgacggtgagccacccagctcacgcggataggggacaacactgacgtgaggggcgattcacgtcactgacggctgacgggaataagacgggtgagggatttccacctttttcttaagtgtgactctccttacggtaaatcgcacctgtgacctcttaacccctcctccctggtacccaataacagtgaaaaacacacaccacacgtcacgacaccgatcgattttctttattcttagtgtgatgataggtaagggcactcgtgaggatgtgcagttatcattatcaagccttcttcaaggcgtagtgatgatcgttgggcagaacccccaagctcctagcgatctgggaatagaaggaggagaacgaccccagggccagaatgcccacagtgtacatggcccaggtctccagaccgaacgtggcgggtcgcagcttcagatggtaggccacccgctccgagagttgtgaatgctcgttcaggcaacaggactgcaggtgggtgagcccaaaagcgctttcgtttacgccgcgcacgtgcaccgtctgggccgggcaatcctggtgttgcgcgcgaaaatggtcctgacaggagattccgtctacgtggcggcgcgtgttgttacccacttcgatcagcaacgtgttatcggcaggatgatgcgagaacgcgacgacggtgttgctggaggtctggcggcagcagtacacgtcgagcgtcatgagggccatgtcgccttggtggtacacggcgtacgcccaaccctggaacacgagcggacatcgcggaccgtgagcggacatcgcgccggcggttgttaccgtcgtctcggcaggagaacacaataaactcctgatcctcatacacaggagtccaagcgtcagaattaaagtccgcggagccataaccgcgcaagtgaagccgatacgagtgttgctgaatttgttcattctgccgactgttgctcacgagcgttcggaggcggtgccacaggctgttggccattaaaaagtcctggcccgaatgacgacgagacagagcccgaggcgaagaaaaaggcgcccgtcatgaagacgtaggcaggggaattcccatatttttatggcttcttttaaaagtctgtatccgactccatccggcgcttttcccaaaccgtggtctcctcgtcgtccgactcggtacccaggaggtggtaagtcttttgccgcacgtagaaagctttcaacgtggagcaaaaaatgagaataaagaccccgaaaacgaaacaaaccacgccgatcatgccgatgcagacgttcatgtcgacgtagccggcggtgctgttggcggtgcggcaaaagagtgtcatgtcgtgcgtgcacaaaaaacaacacacaccacaggccaggtcgtagcgtagttattattccgtagcagcaatgatggtacagtcaagcacatgctctatttcccgttaccccgatgatgatgatgatgttgtccccgttgcagtggaattgtcccggttaatcaccacggtgaacaccacggccaagaaaatgatccctaatatagcgaccactaagagagcaaaagtccatttccagccgttgtcaaagtacgcccccgtggtgggatgcatggtggcgggcatttccatcatatccatgtcgaacgtgtgtcgcggcgacggcgaactaaccaggcagtacgggggtcgatagggcggtgggctgcagtcgggtggtggcggcggtggcgtggaaaccgtcgtcgggcacagacccatggcctgctcgtaggtggggggcgcgtcgtcgtgatcccggtcgcggagcatcggcgtgggctccatgtcggtggcagtgacggcgacggtggtaactgtggtggagacggtaccgacggcgtccgcggctcaccttcgagcaaagagccccttctttttgcgcaaacgacggcaaaacagttctctgggacagccggtggcgcggtaagcgggtgccacgctttcagggtgggtaaaacagtcgcgggcgaagcagtagttgttgcagaaccgcaaaaacccgacgcgaaagaagcccaggagtccgcgcgccagaaagtgcgcctgccgcgtctcgggatgcacgccgaagacggcgccgctctcgttcaccagtatggagatgtccaggcgctgctgcgactccaccggcacggcccgcaccacaaatacctgcagcacgttcagcgagcacgtctcttttaaccagttgccgtgggccggatcctcgtaagtctggctcccgttcaagacgaccgtcgtcagcgcctcattaccgtctcgccagctgaagatggaaccctcgcgcttcatgcacaggcgccacagggccagcaggtcgcgcgccaacatgaactcgcgacccacgtcgccgccggtctcgaagcggacatagcccagttcttcgcgcagcggcgcgtagttgcgcaggccctcctgcacgaagccgcggaaaccggaccgcgacaccaggtacagcgattccaccacgggcgagtagacgtagacgcggccgccctcgccgatgagtacgggtagcggtgggcggccgatggcttcgcaacgactcacagtgcccaccggcagcaggaacttgtcgcagcacaggaaggtcttctccaaacctttaatattgagatgtccaaagtagccgacgcgtaacaggtcgcagtaggtgaaaaaccaaccgttcggccagctgagacgcagcaccgtgccgctgacgcgacgaaccagcttctgcaggtccttgcgggcgtcggcggtgacagagcagcggaaggtctcgttgaccagctcgacagccagcgcgtcctccagcgtacgttccttcatctcgtcgttgatgctctggcggcgccgccggatttcgtcgaaacgagccgcggaggcggcgaccgacgcggaggtcgtccgaacgccctctgtgacgctgtcgtccggccagtcaagaaagctaaggctggcgctgcgccgcctaaagtgtccgatccgcgcgggacgtcgctgagggacggtggctggtctgctggggcgggtacggccgcgggtgtccgcggacacgttagttatacacggaattgagtcacgtggcacgttgccagctgaaaccgccgtcgtctccgccggcgttttctccatcacgggaccgcgccgtgcgcgcgttcccaggcacgcggcccacgctctacccgcacttttgcttcttggtgttagggacgaactcgaacgttacagaatcctcgctgtcgctctcctctttcgcgtcgttaaagtaattgccggagttgcgatccaaaccgccgcctcctcctcctccgccgccgcccgatccacctttggacgtcaggtagctggtgatcttgtgctgctcgtatttttccttggaggaaagaccgtggtcgtgatcaccgccgccgccaccgctgctcattttccgcgtaccggaaccaccgccaccaccgcggtcgtgcttcttgccgccaccgccgccacctcctcccagaccgccgagacccatgggttcgttcatgagatcgttatccagacccgggccgtcgtcgtgcagaccgccggcattggccagcgaagagaggctgccgccaccaccgccgccgccacgcgacttgccgctgttcccgacgtaatttttatcgaagggatcgccacgctggaaaggttcctcggtgagaaaattctccacggcgaacagaccgttgcgactggccacgtacaacagcgtgtcgtgctccgtaactatacgcaacgtgcacggcagtttggtgacggcgcaattgagcagcgtctggtagaagttcttcagctgcacgttgatacgcatgttttttacgccgtggaaactgacgcggttattggccgtgaattccagctcgctgccgttggtcaggatgaatttgatggccggcggaccggcgtgcaccagaatctgcacggtgcccgtagggcagggcgcttttttaacgttacgcttgacgcgggtatgcggcccgatccacttaagcaggtcggccaccacgccgaaatctagatccacgtgcacggccgaattctcgctttcgcgcacaatgtcttggccgtgcacgcaggccgagctgaactccatattgaaatcgggcgcgcacatggagatcttggccgaaaggtccgagatgtcctgcacgtagaacttggtcaggtccttgctggaagtcaggtacatgaaattaccgagcagcggcgtggaattgttaatggtcttgggctgaaacgacttgtcagtgatgtagagacatgagctgttaaaagtgatttttgacacgcagtgactgcgtaccgtttgcaagataagcgacggcgtgggcaagaaggtaaccgtggtgttctccttgagcgcacggatcacagatcgcagctgctggatagccgtcttgtacggcttcagccgcagcgccagcgtcggcggctccgagaggcgcgtcttgcgatccatcccggacagcgtgcaagtctcgactaaggagcgggcgcgagcgagcgaaagttttatagagagcacacacgacgaccgggaacgctgcgaagacgcccggcgtctaataatacagccgcgccgagccagcgggcccccgactaagaggcacagtacttatatactccgaccttaaagcgccagtggtaccacttgagcatcctggccagaagcacgtcgggcgtcatccccgagtcatagtagaaaaccagggccacgcactggtccacaaacacgctcaggttcacggccgccatttccacgtcgttttggatcgccggcgccgcctggaacagacactgcgtcgccttaccctcctcctggtgctgctccaaccacgcgtaattcaccacgggcacgcgcagcggcctccgcaccacggtggggaagtaacactcacggttgggcgggcacaatgaccacaccgtctcctcctcgaacacggtgccgcgcgaagcccacactgacggcgtcacgccccacagatgcgccacctcgtcgtcgggacccaccgccagaaactgacagttgcgcaatccgaactcgagcatgtcggcgcgcagcgcttcccagcgcgcgctggcgatagagagccgcggcaaccgatacaattcgaaaatgaatttgccctcttgatagatggtgcgttcgaaccactcgcagcgcggcaaacccgacttgcacaaatcgacgctagcgcgcaccgcggcaaagtacatgtgctcaaagatgcgctcgatcaagtcccaagaggcaaagtacgtgaaccctaaccgcatgagcgccgtgtgcaagccggccacgccgatgtgcagcggacgcagtttttccagcgcgctctctacccaccattcggacgctgacattagcgcgtccaggcgcgcgttgccccaaaccaccgcctcggtcaccaactcgcgcagcacgctcaaatcaaagtaacgtcgcgtgttccccaaaaccacgtcgggtagatgcagcttctgctcgtcgctacgcgcaaacacgcagcgagccacgttcaccgtcagccgctgcaccggcatgtcacactcgccaaagtggcacgacgccatatcgggactcaagcacggcggcaggcacacgctgtcggccataatcgagtacttgactacgtgatggacaaagaccaccgaggcacggcccttgagcgcgcacagcaacatctttttcagaaaatcgtccgtgttcacgatcaccttggggcacgattgctcgcagcgcgaatactctttctcgaaagccgactcctgacccaggtccgagagccgccgggagacaggccgcccgaacagcgagtagcgctgctcacgcgcacggtatcgcttcattaacacgctaggcacgttgaaagcgtagcaaacccccgtcaactccgacgtgctttctttgagaataaagttaatcacgcggatagcggccacgtcccacatgtccacaaacacacgtaccacgggtcgatgcacctccttctcgcgtatcaaatcgcagtatccccccaggcaacgaatcacgctgttcacatcggcgttaagtcgcgttacgttcaccgacacagaaacgccgcaactcaaggtgctcatccatttgcacatagccgcccaactggcgtcacgcgaaaaagggtcggccgagatcagaaagtcgtactgcggcacgcgatcgaaacccacggtagacatggtgaaggtggacagcgacagctgcccatcgcgacagcgcttcaacaccgattccaacacctcgccttcgaaacgcgcatccagatggaaacgatagatgcgcgagtgcctactgttctcgatagccgccgtcaacgccacggcgatgcgcaaaaacacgccgcccggactctcgtcctgtccgtgcagttggcgacacaccttatccaaacacaaaatggccgcgtacaagccccagcaaccggccaattccacaaaacgcgccgtctcctcggccagcttgggtagatcctccatgtgacgcagcacaaaacggcgcaccgactcatcgcacagctccgaagcgtaacacagtggcgtgcggctttcacgcgcccagttggctttgaaataaaagcgacccaacagcagatcgcaacgcggcgagtgacgaattagacagggaccgtggcgcatgataagctgaaacagcctgaaactgcccaaaccggcactgtgccgcgacacggtgtccatctcgcgccacagcgcgttcctgtcggacggcagctcccgtgccggctcctgtacgccgcaaaagcgaaacttgccccaatagccgtgacaatgacactttttgcccatcaacatgcgcgtagcctgtatcggcggcgatactttgcagagcgaagccccgaaatcgtcctcctcctcgacactgtccagctccatcctggtcgcgccggtcggattgaaggtgctcaaaccgctactcacgcgtccaccgcgactgggcacggcggaaccgctgtcacgcgtcaacgacagcacagacggcgtgccgtcaggagacggcgactcgggacgccaactgacgacgccgccaccactcgtaaaacccgctacacacgctacgccgctcgacatgttagtattttcagcggatgcttccttgtcacccccgggcagcggcccttcctcgagctcgctgtcatctcccccggtagtatcagcgacggcctctgccgacgattcctccgtctcggtttccgcgccgcggctcggaatcctacctggccggcaccgatgtgcgggcaccgaggacacccgctgttcctcgtccgcgtcagccggagtcataagtttacgaggaaaagaacaaagaaatcaggtagatttcaataaagtgagtctagatggcgccgataactacggtttataaagtctgtgtgcgatgtgtttatttttttcttctgtgtctcctccccgtatgctgtcagcgccgctcagacgaattctcgaaagtctcccaattcgacgctaaagttgtccaaacggacgacggacagtttgagttctttgtgtaccaggaacgaggtgtgaatgtcgtcagccaggcaccagcccagcttttgtatgaccccggtacacagagggatctggcgtgggcgcgtgatgcgacggttgacaaagctacagcgctcgcgggcgaactttccgcgtgcaacgtcgaccagggtctgccagtgtgcgatgctggaggtgagcacgtagatgccgggacgtgtttcgggcccgtcatagtcatagacgatgattaaatacacgtattgcagccgtccccgggtctcttcccacgtcagatacatgtctttcggtatcatcaacgcgaacacctccgttttgagcgtgttgtaaaggtagccgcgcatgacgcaggtgagcaacgaggtgatgcccagcgagacggtcttgacgcagcccagcgtctcgaggcggcggtgcagcagatgcgggcccagatccagccactgcagcgcggcgcgcgcggccgaggccgtgtacacgctttcgagcaggcagcgcgtgctggccgagacgttggaggcgcgaatgcctaacaggtagaggctaatgtagaggtgtcgcggcgagtcgcaacccgtctccatgcggatgagcagcgcgcccggctgcgcctcgaactctaccaggccctcgggcacgaagaaacgcgccgtgagcgcctggtgatcggcgtggtagaggtagcgcaccgatatagtatttacctcgcgtttggctttgagcgccgtcactagttcattgtcctcgtcggccgggtcgcgcggccgtttggccaccgcgcgcgcgtccatgatggcgaggcgcacggtagatttcaaaaagttgatagagcagctgcgggcacgggccacggacaaagcggaggcgttaaataccgtgagccaattggagatcggcgcggtggatgcccaggacgtgaccgcgagcgccgtgcgcgccttcgtgggtgcgttgccgagctcgggctaccactttggcttcgtgcgtcagaacgtggtcttttacctcctaagccacgccacggtacagacggcgcgcgacccgctgtacgccgccgagcagttgcacgaacagctggaccgcttcctgcgacaccagcacgacggcggcggggacgaggaccggttgccgttctaccacaacggggccacactgacggctttccagaagctgttgcagaccctgcgcgagatccagaccgtaatagccgaacagagcggcggcaccgcggcagcggcggacttgatcgccagtaacaacgcgtcgaccgagcgccgcggcaagaagggcggttcgagttccgggggccagcagccgctggtccgccgggtgatcacgcagctggaaacggctgccacggaggcgcggccctacgtcaattgtcgcgccgtggccgaactcctggacctgacctaccagcggctcatctactgggcctgcacgctcatgccctacgtgttgtttcggcgcgacaccgacaccgaactggacacggtgcttctgatgcattttttttacacacactaccgttcggttaacggcgatttggccgtggagtttcaaaactacgtcaagaacagcgtgcggcacatgagctctttcgtcagttccgatatcgacggcgaccagaagcccggtgccgaacacatgcgtgacgtcagctacaagctgttcgtgggtaatctgcaggcgcgtgacgccagcggcctcatgtttcccatcattagcacgcgcatctccaccgtgaacctttacctgtcgcccgaacgtatgtttttccacccgggtctgatctcgcgtctgttgagtgaggaagtttcgccacgcgccaacctagacgcttacgcgcgcgtgtgcgatcgcgtgctggaagaccacttgcatacgccgcgacgcgtgcagcggctactggatctgacgcagatggtaacgcgactggtggaactgggtttcaatcacgatacctgcgcggcctacgcacaaatggcgctgatccagccggccagtcagaagagctcgctctttgtcagcgagattcgcgagaaactcatacagatcatctacaatttttacacgtttttcatgtgcctctatgtgtacagccccacgttcctgttcgaccaccggcggcggttgattttggagcagcatcgatccacgttgatcggctccaaggaggaactacagcacgtctggagcaacgtgatactgaacgtcaatacgcactttgcggttcagtacacggaagaagactttgaggcacatacgaagggtgccacggaggcggagcgcgagtacctgtatcgggacctgcacagcaagtggggcgtgcacctgtttaccttgcgtccgtctcgcggcgcggccggcgcggcctcgcctttgcctccgcttgacggcgtcacacgctccgacatcttacgcgaatgcgcgctcgttaatctgaacgaaggccgcgtcaactacgcctccctgctagccttcagtcatcatcccgagttccccagcatcttcgcgcagttggtggtggtaactgaattttcggagatctttggtatcccgcagggcctgtttcaagccgtgggttcgccgcgtctttttgcgctcattcagctgtgtcgtgtattgttgcccgagcaggtgacgctgtaccagaacctggtctccatctacaacctgaccacctttgtcaagcacatcgacgccgcggtttttaagacggtacgcgattgcgtcttcgacatcgccacgaccctcgagcacctcagcggtgtacccgtcacgcccaatgtggacctgctggccgagctcatggcgcgctccgtagcgcataacctgtacaccaccgtcaacccgctgatcgaggacgtgatgcgcagcagcgccggcagtctgagaaactatctgcgacacacgcgactctgtttcggtctggcgcgtgggcgggcgcgcctctcggaggacggcgtgacggtgtacgtggaggtacagggtcagtacggactgcgcgtacctaccacgcgtttcgtagaacagttgcgcgagctggttcgccgcgatcggctgttggccgagaatctgcgcggcttgaatgagcgcctgctgagtgttcgcgtgcgcgtacgtcagatcagcagcgacacagaggaagtaagccgacacgccaagggtcaccgcacggtggcccagatgagcaaggcgctcaaaaagacggcctccaaaatcaaagtgttggaaacacgcgtgacattggcgctcgagcaggcgcaacgttccaatggcgccgtcgttaccgcggtgcaacgcgcgctagccgtctttgacgtactaagtcgcgagaacttggaacgccgcggcgcacagctctgtctgacggaagcgacgagcctactgcaccgacatcgcgcgctagcgccgatgacctggcccgcgggcacgggcgttgcggcggcggccgaagcggatcgcgccttacgcgagttcttggaggcgccctgggaatcggcgccccaaccgccgcgactccgcatgacgcccgacaccgatcacgaagaatcgacggcaggcgcgacgtccgtaccggaggtcctgggtgcgcgctacgaacccgcacacctggccgcgagcgacctattaaactggtacatcgtccccgtaagccaggcgcagcaggacatcttgtcttcgatcgacccgcccgccggctcgacatcggtgtccctgccgccggcctcgccatgaaagtcacgcaggccagctgccaccagggcgacatcgctcgctttggagcgcgagcgggcaatcaatgcgtctgcaacggcatcatgttcctacacgccttgcacctgggtggaacgagcgccgtcctgcagaccgaggcgctggacgccattatggaagagggcgcgcgtctggacgcgcggctagagcgcgagttgcaaaagaagctgcccgccggcgggcggctgccggtctaccgactgggcgacgaagtgccgcgccgcctggagtcgcggttcggccggaccgtgcacgcgctctcgcggcccttcaacggcaccaccgagacgtgcgacctggacggctacatgtgtccgggcatcttcgactttctgcggtacgcgcacgccaaaccgcggcccacctacgtactcgtcaccgtcaactcgttggcgcgcgccgtggtcttcaccgaggaccacatgttggtctttgatccgcacagctccgcggaatgtcacaacgccgccgtgtatcactgcgagggtctccatcaggtgctgatggtgctcacgggcttcggcgtgcagctgtcgcccgctttctactatgaggccctttttctctacatgctggatgtggcgaccgtgccagaggctgagatcgccgcgcgtttggtctccacctatcgcgaccgcgatatcgacctcaccggcgtcgtccgggaaagcgcggacacggcggcgacaacgaccaccgccgcaccttccttacctccgctgcccgaccccatcgtcgacccgggctgccctcctggcgtggcgcccagcattcccgtctacgatccctcgtcctcacccaaaaaaacacccgagaaacgccgcaaggacctcagcggtagcaaacacggaggcaaaaagaaacccccgtccacgacgtccaaaacactggccaccgcctcctcctcctcctcagcgatagcggcggcctcttcttcgtccgcggtaccaccgtcctacagctgcggcgaaggggccctgccggccctgggccgctaccaacagctggtcgacgaggtagagcaggagttgaaggctctgacgctgccgccgttgcctgccaacaccagcgcctggacgttgcacgcggcgggtaccgaaagcggcgctaacgcggcaacggccacggcgccgtccttcgacgaagctttcctcaccgatcgtctccagcagctcatcatccatgccgtcaatcaacgctcgtgtctgcgtcgcccctgcggcccgcaatcggcggcgcagcaggcggtacgcgcctatctgggcctatccaagaaactggatgcctttctgctcaattggctgcaccacggcctggatctgcggcgcatgcacgactacctgagccacaagaccaccaaaggcacgtactcgacgctggatcgcgcactgctggagaagatgcaagtcgtcttcgatccctacggacgtcagcacggcccggcgctcatcgcctgggtggaggagatgctgcgctacgtggaaagcaagcccactaacgaactgtctcaacgactgcaacgtttcgtaaccaagcgaccgatgcccgttagcgacagcttcgtctgcctgcgacccgtagactttcagcgtctgacgcagatcatcgaacagcgacgtcgggtgttgcaacgtcaacgcgaggaataccacggcgtttacgagcacttggccggcctcatcaccagcatcgacattcacgacctagacgccagcgatctgaaccgacgcgaaattctgaaagcgctgcagccgttggacgacaacgccaagcaggaactctttcgcctgggcaacgccaaaatgctagagttgcagatggacctggaccgtctgagcacgcagctgctgacgcgcgtgcacaatcacatcctcaacggctttttgccggtagaggacctgaagcagatggaacgcgtcgtcgagcaggtactgagactcttttacgacctgcgcgacctgaaactgtgtgacggcagctacgaagagggattcgtcgtcatacgagaacaactgagctacctcatgacgggcactgtgcgcgacaacgtaccgctactgcaagagatcctgcagctgcgacacgcgtaccagcaagccacgcagcaaaacgagggtcgcctcacgcagatccacgacctgcttcatgtcatcgagacgctggtgcgcgacccgggcagccgcggctcggcgctgacactggccttggtacaggagcagctagctcaactggaagcgctaggcggcctgcagctacccgaagtgcagcagcgcctacagaacgcgcaactcgcgctaagccgcctctacgaagaggaagaggaaacgcagcgtttcctcgacggactctcgtacgacgatccgcccaccgaacagaccatcaagcgacacccacaattacgcgagatgttacgtcgcgacgaacagacgcgtctgcgactcatcaacgccgtactgagcatgttccacacattagtgatgcgactggcgcgcgacgagtcgccgcgaccgacgttttttgacgccgtcagtctgttgttgcagcaactgccacccgactcgcatgaacgtgaggatctgcgtgccgccaacgccacgtacgcgcagatggtcaagaaactggagcagatcgagaaagccggtaccggcgcatccgaaaaacgcttccaagcgttacgggaattggtttactttttccgtaaccatgaatatttctttcaacatatggtcggacgactgggcgtcggacctcaggtaacggaactctacgagcgatatcaacacgagatggaagaacagcacctggaacggctagaacgtgaatggcaagaagaggccggcaagctcacggtaacttctgtggaggacgtgcagcgtgtcttggcccgggcaccgagccatcgtgtcatgcatcaaatgcaacaaacgttaaccaccaagatgcaagactttttagacaaggagaaacgtaaacaggaagaacagcaacggcagctactggacggctaccaaaaaaaggtgcagcaggatttgcaacgcgtggtggacgccattaagggcgagatgctctccaccatcccgcaccaaccactggaggccacactcgagctgctcttgggcctagatcaacgcgcccaaccgttactggacaagttcaaccaggacttgctgtcggcgctacagcagctgagcaaaaaactagacgggcgaatcaacgagtgtctgcacggcgtgctgacgggtgatgtagagcgacgctgtcacccgcaccgagaagcggctatgcaaacccaagcctcgctaaaccacttggaccaaattttgggtccacaactcctgatccatgagacgcagcaggccctgcaacacgccgtccatcaagcgcagttcatcgagaagtgtcaacagggcgatccaactacagccatcacgggcagcgagttcgagggcgactttgcacgctaccgcagcagtcaacagaagatggagggacaattacaagagactagacaacagatgaccgaaactagcgagcggctggatcgctcgctgcgccaggatcccgggaacagctccgtcacgcgtgtacccgaaaaacccttcaagggtcaggagctggcgggtcgaatcacgccgccacccgccgacttccagcggcccgtcttcaaaacgctgctagatcagcaggccgacgcggcccggaaagcgctcagcgacgaggccgatctgctgaatcagaaagtacagacgcagttgcgacaacgcgacgagcagctgagcacggcgcagaacctgtggactgatctggtcacgcgccacaaaatgagcggcggactggacgtgaccacccccgacgccaaggcgctgatggaaaagccgctggagacacttcgcgagctgttgggcaaagccacgcaacaactgccgtacctgtcggcggagcgcacggtgcgctggatgctggcctttctggaggaagcccttgcgcaaatcaccgcggaccctacgcacccgcatcacggaagcaggacccactaccggaacctacaacagcaagccgtcgagagcgccgtgacgctagcgcatcaaatcgaacaaaacgcggcctgtgaaaattttattgcacagcatcaagagacgactgccaacggcgcgtccacgccgcgggtcgacatggtccaggcggtggaagcggtctggcagcgactggaacccggacgcgtagccggcggcgccgcgcgtcatcaaaaagtgcaggaactgttgcagcgcttgggtcagacgctaggcgacctagaactgcaggaaacgttggcgacggaatactttgcgctgttacacggaatccagaccttcagctacgggctggactttcggtcgcagttggaaaagatccgcgatctgcggacccgttttgcggaactggccaagcgacgcggtacgcgtctctccaacgagggagccctgcccaacccccggaaaccgcaggcgacgacttcgctgggcgcctttacacgcgggttgaacgcgctggaacgacacgtccagctgggtcaccagtatctgctcaacaagctcaacggctcatcgctagtctataggctggaagacattcctagcgtgcttccgccaacgcacgagaccgatcccgcgctgataatgcgcgaccgcctgcgtcgcctatgcttcgcgcgtcaccacgacaccttccttgaagtggtagacgtcttcggcatgcgacaaatcgtcacgcaagccggcgaacccattcacctggtcaccgattacggcaacgtagcctttaagtacttggcgctgcgagacgatggccggcccctggcatggcggcgccgctgtagcggcggaggactcaagaacgtcgtcaccacacgttataaagccatcacggtagccgtggccgtctgtcagacattgcgcactttctggccgcagatctcgcagtacgacctacgaccctacctcacgcagcatcagagccacacgcaccccacggagactcacacgttacataaccttaagctcttttgttatctggtgagcaccgcctggcaccagcgcatcgacacgcagcaggagctgacggccgccgatcgcgtaggaagcggcgagggtggtgacgtaggggaacaaagaccgggccgcggtaccgtgctgcgcctgagtctgcaagagttttgtgtactcatagcagctctgtaccccgagtacatctacaccgtcctcaagtacccggtgcaaatgtcactaccctccctcacagctcacctacatcaggatgtgatacacgcggtagtcaataacacacacaaaatgccccccgaccacctccccgaacaggtcaaggccttctgtatcacccccacccaatggcccgccatgcagctcaataaactgttttgggaaaataaactggtacagcaactgtgccaggtaggcccgcaaaaaagcacaccacccctaggcaagctatggctctacgccatggccacgctggtctttccacaagacatgctgcaatgtctgtggctagaactgaaaccccagtacgccgagacctacgcctcggtgtccgaattggtacagacgttgtttcagattttcacgcaacaatgcgagatggtgaccgaggggtacacgcaaccgcagctccccaccggagagccggtgcttcagatgatccgcgtgcgacaccaggacacaaccaccacagacacaaacacgaccacagagccaggacttttagatgtttttattcaaacagaaaccgccctagactacgcgttgggctcctggcttttcggcatacccgtgtgtctcggcgtgcacgtagccgacctgctgaaaggccaacgtgtactagtagcgcgccacctcgaatacacgtcgcgagaccgcgacttcctccgcatccaacgctcccgggacctcaatctcagtcaactgctccaggacacgtggaccgaaacgccgctggagcactgctggctacaagcccaaatcagacggctacgcgattacctgcgtttccccacccgcttagagtttattcccctagtcatttacaacgcacaggaccacaccgtcgtacgcgtgctgcgaccgccctccacgttcgaacaggaccacagtcggctggtgttggacgaggccttccccaccttcccgctgtatgaccaagatgataactcatccgcggacaacgtcgctgcgtctggcgccgctccaacaccgccggtacctttcaaccgcgtgccagtcaatattcagtttctgcgtgaaaacccgccacccatcgcgcgagttcagcagccgccgcgccgacatcgtcatcgagcggccgcggccgcagacgacgacggacagatagatcacgtacaagacgatacatcaaggacagccgactctgcattagtctctaccgcctttggcgggtccgtctttcaagaaaaccgactgggagaaacaccactatgccgagatgaacttgtggccgtggcgcccggcgccgccagcaccagtttcgcctcgccgcctatcacggtgctcacgcagaacgtcctcagtgctctagaaatactgcggctagtgcgattggacctgcgacaactggcgcaatctgtgcaggacactattcaacacatgcggtttctctatcttttgtaaccgacactgacagtagcgggtaataaaaacaagaggattgttatcgtttttttatgataaaaaaacaacgtgtcattttcacggtgatttattcttgctattatttttccccatgggctgtcagcgtcgggtgcgcgacactgctaccatgcgcaacaggtccagtttaaaggcgcacttgtcgttaaacaggctggacatgcgtgtatatttgctcagcatggtggccagcaccgggtgggtggcctctgagatctcggtcggcaactccaaaacgacgttgacgacgtgacggtgtttttcgtcccgcttgttggccaccgtgggtcccggcgcggtgttagacatggggcaggccgtggggggaggacgaggaggaagtcgctgctaaaccgccacgcgcctgctgcacaatgtggccgccgacgtggcaggcggtctgtttaaccagcgcgcagccccgacacagcggggcgccgtcttcgctttccaaacagctgtcgcggtactcgcccgtctgacagcgcgcgcacagcaggccgtgcccgtgcgaagtgaggcgcaggagacgcgggaccgtcacgccgcgtaccaccacagtggagtcgcaggtgcgtgccgcgcagggcagaatgacgtcgaaagccagccggtgatcgtacacggcgcaagccgcgttgaggcccagcacggctttccagcccacgcgtacgcagcgctgtccaaagagcgtctcggagacgagctcgtagacgcgctgccgcaccacccgctgactgccgcagagcgagcagtgtacgagctcggcgtgcgtgttgaagatgacgctcttttcttgacggtcccgataatagaacatcgagttgagcggaaaattttgctggcagtgtagcttttccttacccaggttgaggcagtgtccgcactgccgacagaccacggccaccagcgagcgcgcgtccagatggcgctcgcacttgagtcgacacagacaccagagcggcaggtcgatgacgctgccgatgaggccgccgcgcagcgcggcgctgagtgcaaagaggacgatcttggtgggctctacgtgacgcgcctgctgtccggcgcccgcgtgtcctaccgccgcagctgccgccgtcgagcctcctccgcgcgtctcgtcgtgcagacccagtgcccgcaacggcaccaggtatcgcggacacgtgtcgcaaaacgtctgcaccgcttgtcgggccagtacgtagagcgggtttccgcagggtaccttcccagcgtgccggcgcaaggctgcgatgaggccccgcagctgcggcgaccgcggctgccgttggtgacaccactggttacggtggtatacggccaaatcagcgcgggcgtcgaagcgcttggcgcgtagtagtgctaggcacggcgagctggtggggtgaagcacgggcagccgaaggtccaccccgaaaaggaaacggtgaaggtcacctagcagcgaggcggtgacaccgtccaacaacgcgtgcagccgctcgggcgggtagagccgcagacggcgcagcaggtagtcggtgtcgtagcgttcgaaacgcagaaaggccatcgtgcggacggccacggtgtgcagacagtccatgctgtagacgtaagcgagaaacacaaagtagggcttggtcataaccatacgctgaaagagcgccgtcaccgcctcccgctcggcctgccgacacaccagccattcgcgcaggaagcgttggtagagacggtcgcccagctcccgattcagaaagcgcttatccgtcacgaagagatgaaggacgcaagaacgtggcacgtgatgcaccagctgctgctggaggaccgccgacgtctgcgccgcaaactgcgccggtggctgcgacgtttctaccgccgcttcctccggctgcagcgcaccgcggccgatcaccagctgcacatggaaatggtcctcgtgaacgcagaggggcgcgaagagacggcgcagagcctggtggaactcatcagtcgcggtgtgcggagcgtgtcggagacgacgactggccatgaccgcgccacagcagagccagcaccagcagaagagccagcaccagcgggcccagagtcgcaaagcgcgcgggcagccacggcccagactgcggtcgcgatggcccggagcgcgctcgccaccacgatgacggtgcccaacgataaccagtccgctccaaggacggcgcgcacggcggagacggcggatgacggtgatgggtcgacacccctcgccgacgactcacgtgctcctccagaggccgacgcgcggaccctccgacgtcctggcccgccgctgccgccgccgccttcccttctcccgccagagccagcaactcctcctcctcttcatcagcgtctccctcgcttgcgcatccgcatcgtcccatacaggcctcacaacgacacagccgccacgaccccgccgccatgggtggcggcggcggccgaggcccggcagcggcgccgccagcggcgaccatggtgggagagcaactcggatgacgaggaggaggaggaggagggggagatgcggtccgagaggaccgctttcccgccgttcgcgtgagcgcggccgacatgcgggcgcgccacagggacggaccgctgccgctgtgactgcttacggtgacgtggttccggaccgccaacgacgtcgacgcggctttcttggcgtacagctcgcgcagcagattctcgtactcgccctcgttttcgggtccgaaggcgatgagctcgatgttgaagaccgacgccgaattggatttgcgcaccacgcacttcgtcagcactccgtaggccgagggcttgatctcctcgatgtccttgagcgtgacgatgagcgactcgttcaccttaagcacattgaactcacctacgtggcgcgccggcgagacgagcttgacgggcgctcgcacaaaacagcagagggagacggcgcagccagtgtttttaaagataaaacaaggcacgtggtctgtgcggctctcccagtagctgagcagatactcgacacaatagaccgtgtctgtcttgagcatggcgtcgcacaccgagtaattgggatttttacagataaggccggcgtcggtgacgcgcagctcgctgggacccaacttgaggatacgccgcgtggcctgcaccagatcctgatggagaaccttgttcatctccatcgcaccgacgccaccgccgatttatttacccggcgccggctcgtcttttccctccaggattccgttaatgtccatgagcttgctgacgatcgccgttaatagttgcgtcttctcacggaggatctctccgtgactgcaggtcgcgcagtcgccgtgcacgtacttgaggaaggcggcgtacttctgacccgcgttcacgaaatttaagcgcgcgtccagggagggcagcaacagatcgtagacgcgcggcagcatcggctcgaactgtaatagcagatcgtcgtcaagatcgggtagcgcgtgcccgtcttcaccgtcctcgtcgtcaccacctcccccctcgagcccaccgctcgtaccagccgcgggctccgcgtcctcgtcgatcaccagcggtcgcgtcggcaccggagaatccacgtcatcctgcacgtcgttttcctcctctccgtcgtcatcgtccagaaacggcacccgctgcttagcccaggacattctttctccgcgtcctcaatcagcggcgccgatcgccatgaatccgagtacccacgtgagcagtaacggcccaacgactcccccccacggggcccacaccacgcttcttcccccgaccagcccggccccgtccaccagctccgtcgccgccgctaccttgtgcagtccgcaacgacaggccgtttcgcgttacagcggctggagcaccgagtacacccagtggcactcggacttgacaactgagctgctatggcacgcgcacccgcgtcaagtacctatggacgaagcgctggccgccgcggcggccgcctcataccaggtgaatcctcaacaccccgccaaccgttaccgtcattacgaattccagacgctcagcctcggcacctcgggggtagacgaactgctcaactgctgtgcggaagaaaccacgtgcggcggcacgcaatccaccgtactcaccaatgcgaccaacaccaccaactgcggcggagccgtcgccagcagtagcaacgcaggacctgccggcgcttcggccgcctgcgacctagatgcggaactggccggcctcgaaacctcggcggccgactttgaacagctgcggcgactgtgcgcgccgctggccatcgacacgcgctgtaacctatgcgccatcatcagcatctgcctcaaacaggactgcgaccaaagctggctcctcgagtacagcttactgtgcttcaagtgcagctacgcaccccgtgcggcgctcagcacgctcatcatcatgtccgagtttacgcatctgctgcagcagcacttttccgacctgcgcatcgacgacctgttccgacaccacgttctcacggtcttcgatttccacctgcactttttcataaatcgttgctttgaaaaacaagtgggcgacgcggttgataacgagaatgtcaccctgaaccatctggccgtggtgcgggccatggtcatgggcgaagacacggtgccttacaacaagcctcggcgccacccgcaacagaagcaaaaaaacaacccttatcacgtcgaagtgccgcaagaactgatcgacaactttctagaacacagctcacccagccgcgaccgcttcgtgcagcttcttttctatatgtgggccggcaccggcgtcatgagcaccacgccactcacggaactcacgcacactaagttcgcgaggctagacgcgttatccacggcctcggaaagagaagacgcaaggatgacgatggaagaagaggaggatgaagaaggggaagaaaaaggaggagacgatccgggccgtcacaacggcagtggcaccagcggggggttcagcgagagcacgctaaagaagaacgtgggtcccatttacctatgtcccgtacccgccttttttaccaaaaaccaaaccagtaccgtgtgtctgctgtgcgaactcatggcctgctcctattacgataacgtcgtcctgcgcgagctgtaccgccgcgtcgtctcgtactgtcagaacaatgtgaagatggtggaccgcattcaactggtattggccgatctgttgcgcgaatgcacgtcgccgctcggcgcggcgcacgaggacgtggcgcgctgtggactcgaagcacccacctcgcccggaggcgactcggactatcacggcctgagcggcgtcgacggcgcactggcgcgacccgacccggtattttgccacgtcctgcgtcaggcgggcgttacgggcatctacaagcactttttctgcgacccgcagtgcgccggcaacatccgcgtcaccaacgaggccgtgctcttcggacgcctgcacccccaccacgtccaggaggtgaaactggccatctgccacgacaattactatataagtcgacttccgcgacgtgtgtggctctgcatcacactcttcaaggcctttcagattacaaaacgcacctacaaaggcaaagtgcacctggcggactttatgcgcgatttcacgcagctgttggagagttgcgacatcaagctggtggaccccacgtacgtgatagacaagtatgtctagcgtgagcggcgtgcgcacgccgcgcgaacgacgctcggccttgcgctccctgctccgcaagcgccgccaacgcgagctggccagcaaagtggcgtcaacggtgaacggcgctacgtcggccaacaaccacggcgaatcgccgtcaccggccgacgcgcgcccgcgcctcacgctgcacgacctgcacgacatcttccgcgagcaccccgaactggagctcaagtatctcaacatgatgaagatggccattacgggcaaagagtccatctgcttacccttcaatttccactcgcatcggcagcacacctgcctcgacatctcgccgtacggcaacgagcaggtctcgcgcatcgcctgcacctcgtgcgaggacaaccgcatcctgcccaccgcctccgacgccatggtggccttcatcaatcagacgtccaacatcatgaaaaatagaaacttttattacgggttctgtaagagcagcgagctactcaagctctccaccaaccagccgcccatcttccaaatttattacctgctgcacgccgctaaccacgacatcgtgccctttatgcacgccgaggacggccggttgcacatgcacgtcatcttcgaaaactccgacgtgcacatcccctgcgactgcatcacgcagatgctcacggcggcgcgcgaagactacagcgtcacgctcaacatcgtgcgcgaccacgtcgttatcagcgtgctgtgtcacgccgtctcggccagcagcgtcaagatcgacgtgactattttgcaacgcaagattgacgagatggacattcccaacgacgtgagcgagtcctttgagcgctacaaagagctcattcaggagctgtgtcagtccagcggcaacaacctatacgaggaggccacgtcatcctacgcgatacggtctcccctaaccgcgtcgccgttgcacgtagtttccaccaacggctgcggcccctcctcctcctcgtcccagtccacgccgcctcatctccacccgccgtcgcaggcgacgcagccccaccactactctcaccaccagtctcagtctcagcagcatcatcaccgtccccagtcaccaccgccgccgctgtttctcaacagcattcgtgcgccttgacactgtacggcagaaaagccggctccaagtgcaagcgccgcggcagcaccatgtgcaaaaacttgtccttgcgcgcggtttcgccgccgggaaagacgggcgacagcacgttggttacagccttgagaacctgctcaaagtacttgtcggtgtgaatgggcacgccgtgctcgcgcacgtagctcggatcttcggctacctcgtagttgcacacggccgacggtggtttccgcgccctcttctttgccggctctcctcctctcctgttgctctcctctaccccgccgccgtcagcgtcgtcgtccgtgccatcaatcgcgtccgaccgggaaaccacgccggcggttacagaatcaccgttgtcggaggaaccctgcggcgccgtccggacaccgggcgccgtcaggacgtaaaagacccgatccccgaccgagggtagctcctcagaacgggccgccagtcgcttaatgacggcaatgtgcggcaggttagattgacggtacaacgagatgtccttagaaagcaccgacgaaagcaccaggtcctcgacacgcacacggtgcaggtacagatcgtcgcgggcctgcaccaggcggcgcaagatacgccagaaaccgcgtggcacgccgtatttcttgacttcatcgagtgagaggcgcgacaggcgcacggctgcttccgagacctcgcgatcctcaaagagcagcgagaggacgtcacgcgtgacgcccttgacgaactcgcaggccgtcttgcgcaccagatccacgcccttcatgctcagacccgaggcgccctccactttgccgatgtaacgtttcttgcagatcatcataagagagacgaagaccttttcaaactccagcttgacgggctccacaaaaagacaggccgtcacgtagtgcgccaggctgggcccacgcgccaccagagcctgcggcgtcaggccacgaaagcggacaaacacgctgtccgtgtccccgtagatgacccgcgcctccacccgccgttcgtccgagccccctgacgatgtttcgagcccctccggtaacgtgctgctctcctccgaatccccctctcgcgttctcactacatagtcttcctgattaaaaaaattgtgcaaaaaacacggctctgaaaaattgtctttgatgaaccgcgccgtgcgctctagcatgtcgcgaccgatgcgcgtgatgctggcggcgatgggcagacacggcatcatgccgttgaccacgccggtaaaaccgtagaaagcgttacacgttactttgagtgccatctgttccttatcgagcagcatacggcgcacggggtcttgacactcgcgcatgcattcgcgcacggcacggcgctgcgaaacccacttgttgagcagttccgaaagcaccgagacgcgcaccgaagcacgcacaaagcggtgagtcacgccgttctctagcgtgacgctgtatacgtcggcggggtccacggggtactcgccacccggcaccagcagggtggagtagcagaggttgtgagccatgatgatggaagggtagaggctggcaaagtcgaacacggccacggggtcgttgtaataacccacctcgggctcaaacaccgtggcaccctggtacgaaaccgccgcagtaccgccggcgccgtgactgtcgttggaaacgccgacgctgccactactgccggagccgacgctgaaaacgccgacgctgctactactgttactgccagagccgggtaaaacgccgtcctgactcgacggcgcagattgcaagggcggcgacatctgaaacatggccgccacagaacccgcgtcgccgggcacggcagcggtagagatgatagcggcgttaggtgacacggcaacgctattcgtttcgggcaccgtcgtacctttgctgtagtggttgggcaggataaaatcgcggcaggcgcactcgtccagcagcgaggtgtagatacggatctgctgtccgtcaaagatgacacgccgcaacggaattttagccagccgcgcgatggccccggcctcgtagtgaaaattaatggtgttgaacagatcgcgcaccaatacggcgtcctgcagacagtaacggcctacctgggcgcggccctcggcattagccacgaaacaacgcgggatgtccttgtaggacaggtcatccttgcgttgccgcaggtaaagctcggccatagtgttgagcttatagttgggcgagttagtcttggccatgcatacggggtacatgtcgataaccaccgaacccgcaatatacaccttggtggcggccgtgctggccggattgttgtgagaagccgagggaaaggcggcggcgtactgccgcttaaaacccacggcggggctgtgtaaaaagaaacggccgccctgcgccgtgggcaacttgcagaagcgctgcgagtccaccttatacaggtactcgaggcgcgtgaggatgtacttcaagtcaaaagagttgatgttgtaaccggtcacaaaggccggcgcgtaccgttgaaagaaaagcataaagcccagcagcagctcgtattcggaagggaactcgtagacgtccacgtctgggcccacctgcccgcaggtgccgatcgtaaagagatgaagacccgagtgcccaaagatcacaccctccgaagtgcagccccgaccatcgttcccgtttgggatcccctgatccacggcggtgtttccccccgtctcgtagcacacgcacgagatctgaatgacaatgtcatcggacttctcggcgcagggaaaaccaccctcgccgctcatgcactcgatatcgaaggacaggcatcgatagcgcggccacgagctgtcgtcgggcacggccaccaggtcagagacatcgcagtcgacctcgatatcacaagtcgacgcgcgaccctgctgccgccagtcgtaacgattcacggagcaccagccgaacgtggtgatccgccgatcgatgaccaaacgcgtcagcggatccacacggacctcgtacacgggaaaaccctgctccagcagatactcgccgatttttctggccatggtccagttgctgatagacacacactgcaaatcgggcacgggtcgcgtcccgtacccgtagatggaggtcttggtggccggcgtgacagacacggcgtatggcgtccgcggctcgggcactagttcgcccacgctggcaatgacctcacgcagcctatcggtgtcgctgtactcacagtaaaagtagctgcgctgcccgaaaacgttgacgcagatactgtagccgtgttctgtggccccgaagaaacgcaacacgttccccgaaggcaccagatgctgacgatagcgcggcgacacgttttcgggcgagtcgaagaagagcacggcgtccgtctgatcgtaggtgtgaaaacgaataggtcccaccacgcgacccaccagggtctcgcgccaaggacacggccaaaccatgtcatgactcaacaaatgtttaatctctcgatagaacatgagaggcagccgtcccgtcttatgcttgatcaaccccgtctgaccgtcgaacatgacgcctcgcggcacgatctgcaaaaactgtttctgtggcggccgcttgcccgagccctgcgcggagccgggctgcgaacgctgacgccggccacccgcgaccgcaccgccggtcacgccgccgctcagatacgggttgaaaaacatagcggaccgtgagaggctgacagcttacgaagcacaatcacaaagaaaatacacatgcagcacctagatatccagtttgaccccgtatatcacaagtctctgtgtcactttttttgtctgttttttttttcttctcctggttcagacgttctcttcttcgtcagagtctttcaagtgtcggtagccgtttttgcgatgtcgcagtcggtctagcaggttgggcttctgtcccttgtcctgcgtgccagtctgtccgtccaaagaatctgtaccgttctgctgcgctcgctgctctgcgtccagacggaccagggccagaagcatctggtaagcctgctcgttggtgtaaggcggagccgccgtggatgcatcagacgacggtggtcccgatcctttgcgaccagaattataaacactttcctcgtaggaaggcggagcctgtaacgacgtgtctttggtgttgcccgacgtcacggtggtcccgttggcggacaccagatagggaaagaggttctgcagcggctgcatgcagagacgccgctgtcgagtatagatcaaataagtgataatgactacggctatggccacgaggatgatggtgaaggctccgaaggggtttttgaggaaggtggcaacgccttcgaccacggaggccaccgcgccacccacggccccaatggctacgccaacggcctttcccgcggcgcccaggccgctcatgaggtcgtccagacccttgaggtagggcggtagcgggtcgactaccttgtcctccacgtactttacccgctgcttgtacgagttgaattcgcgcatgatctcttcgaggtcaaaaacgttgctggaacgcagctctttctgcgagtaaagttccagtaccctgaagtcggtattttccagcgggtcgatatccagggcgatcatgctgtcgacggtggagatactgctgaggtcaatcatgcgtttgaagaggtagtccacgtactcgtaggccgagttcccggcgatgaagatcttgagactgggaagctgacattcctcagtgcggtggttgcccaacaggatttcgttgtcctcgcccagttgaccgtactgcacgtacgagctgttggcgaaattaaagatgaccacgggtcgtgagtagcagcgtcctggcgaatccttcacgttcatatcacgcagcaccttgacgctggtttggttgatggtcacgcagctggccaggcccaagacatcacccatgaaacgcgcggcaatcggtttgttgtagatggccgagagaatggctgacgggttgatcttgctgagttccttgaagacctctaggctgcgccgttgatccacacaccaggcttctgcgatttgcgccagcgcccggttgatgtaaccgcgcaatgtgtcataggtgaactgcagctgggcgtagaccagattgtgcaccgattccatgctggataaatgagttgcattgttgccatctgcacttcttttggttctactatgagtaagattcagactggagcggttggccaaacgttcgagttccaccagagatttttgcttgataccttgccagaacaccaccaaaccaccagtggtttcaaacacggacacgtttccatatttttcatatgtttgattgtatgaagtattgaaaatctgctgtaacttatttatggcctcatcacgtacgcagtccagcgcagagtcggacatgttcacctcttgcttcttagataagaaagtggcggtcattttggcagaagaaaagtgatacgagtcctcggcttcggaacgaatggtgcgttccgaggcttcccagaaagtgagttgacaagtaacattcttctcgtcctgtatatcccaggagatcactgagtccgcacgttcaagaaaagccaccaacctgtgggtctctaacgcagaattcggtcttccaaagtcggagacgatagtgtagttcggaaaaatgaaaaacttgtcggcgttttctccaaaatagctggcattgcgattagttccgttgtagaaaggagaaatgtcaaccacatcacccgtggaagttgcgaaaaaatgatagggatacttggagcgcgcagtagtgatggtcaccatacaattcagattacaggtctcacgatagagccaggtgctgccgcggctgtgccattgatccttgaccgtcacgtaacgggtactgtgggtgttggaataatcgtcgggcattaattgcatggttttgttttcatagctgtccctatgataagccacgaaaaccgtgcctgctataacgcggctgtaggaactgtagcactgactgtggctgttgatatgatgaatctcccacataggaggcgccacgtattccgtgttgctgcccagcagataagtggtgtggatgtaagcgtagctacgacgaaacgtcaaaaccttctggtagactcgtaccttaaaggtgtgcgcgacgatgttgcgtttgtagaccaccatgatgccctcgtccaggtcttcattgataggcttcatcgaggtgcagacgatattacgttcaaagcgaataagatccgtaccctgtgccatagaacacacgcgataggggtacttggtggtattgacccccaccacatctccgtacttgagggtagtgttgtagatggtctcgttaacaccatggctgaccgtttgggaagaagttacgcgttgagagactgaaccggatcgagagtgagcagcagacgtcgtatgagaggaatggtgactgtgagtagcagaagttccacgagaagtagaagatgaggaaaccgcagcacccagacagacgatacacaagttaacgcagactaccaggcaccagatcctggattccatgttcgtcgcgggccaaatccagcagcgatgaggcgcgtcgtggtctcttgcgtgttgcgcggaccctccgggaaacgcccgcggtcgaggaggaggggtacggacttggcagccaaggtcggtccggctccctgaaggcacccgagacggccgcggcggccgttagggtggagggcttggccacgggagctgttggcacgtcgccactctcatccggtctggacagatgcctgtagaggaggagatatagatctttggacttataaagacttccttcgtgacgaagcagcagcggccactctttgttatacgtgagaatcacatctctgtccgggtgcagttcgtcgcgcaggcacgcgatcgagagttgtttcccgaaagtttcattatatagtgcgacggagagcacgagctcccgcacgtgcatccacatctccttctgcagcacgtttaggtcctgacagtccgaaaaattgaaaaaacccatgtacttcaccaccatccactcactgggatacacggtaccttccgcgcatttgaccaaatcgtccttgacgtggggtagtacgcccgcgttgtcgcaggcataggccatgtccacattgtgagagaggggatagcgatcggtacagtgtgtgaagaggggcccgttacacaactcgtagatctgctgacccagtagcgggagggattccacaggcagactcttgtggatcaggttattgaccacatacaggtgctcatcgtacgtgaactgatcccccacgtccaccacgtcttggtcctggtggtattggctgcggtatagaaacccattcatgagcttagagataaagtccagacacaagggccccactaggttgacatcgatgagtttgctagtcagacgctcctgcgttttgatgcaacggatcaccttgccatagcccacctctgagaccttctgcaggtaggcgcgtttgcgcacgttcacctcgcgggtgacgttgtggatgcgggaacgcgcgtccaccaagtcgagagcctcgtgttcgtcgcagttgcgcacccgtaagccgttctcgccgccgtcgccgtcctgcccattcgcccctccccctaccgctttcttgcctcctccacgggcccggccgccgccaccgttattcctctgactgtgagtactgctgttgctgctgttgctggccgtcatcaaagtcgtacccgtccccgacatcgcctcccgtccacgcaggtgaatagcctcgccctcggggccgtcgccccccgtgccatcgggcagcggacgtcgaatctcctcgagaatatgcttgattttggtgtacatctcgttgctttcgtggagcttgttgaacaccgggttgtcctcgaaagcttgaatgctgagggatgtgatgaggtcgatgatcctgttgggggcggcaaagaccgaccccacgaacatgcgctcctccccgtccaacgccttttccccgagcacgaagatgtcctccacgtcctccccgtacagatggcgactgatgccgttcatgagcgcccggcacagctggtgatacacatttagctgctggatggtgatgcccacccgcttgacgataacctccgaggtacgggaccagtaggtaaaatccgacaaggaatatattcgttccggtatatccgtaaacaggttgtactccctcagcgcctcctccgcctcctggatgtagctgtggtaggccgatgaagaagagaataggcttttgagggccgaaaggactccagccaagtgggggatgcgcgttgtcaggtccagcaggtcctgctccaccgtctggatattcacatcggactggcttgacggacggtggaccgctatatggttgcacagcaagccctgcagccgcttgttcagcgagcggccctgattcgggatgatggtcagctcctcgtagcattgggcgcatgtcgtcccttcgacgtacacttcctgacgcgccaccggcgagatgccgcataggcgacggaggagctccagcagctgcgcgcagacctccaggccggcctccggcgccaggatcccgtacacgtagttcattttgcacaggaagcgctcgatgtcgttgagtgtggccagactgacgctgaaacggacgttgtccgtaaactggagctccacggtgtgatggcgatcgcagcgatccaaacggaggacggtacggtagaaggccgcccggtccggctggcgcgagtaggccatcagcgcccgatccagcaaagccgtatcctcgtgcagcgccttcagcagcatctccagatagagcgtcagcagcgaactctgcgtacgattctgcgccaccacctccgggtagatcttccggtacagatacactatagccgccgcgtttctcttgaacggcgtggactccgccagtaacacgttcggatcgcagtactttagacactccagctccatggcgtattcgttgcatttcgaacacactacgcatagtttctgtaacaaattcatctccatgactcgactcgctcacgtacgagacgctgtcgtccggtctggcgccggccagagacatggagtcggtgcacaaataactcgcgggccgctcgctatgccgactgacgttgacgttaatatataacgacgtcgtcgacgacgcgggttctgctcccgaagctgttgccgccgcttgcggcgcaacctcctccaccaccgccgccgccggctcctccgcctcgggcgacgggggctcggagatgaccggctgtgtctgacactcctccccttcctcaggcggcccgggcgccgacgcgaatgtcggagtttgccagcgcggcggcggtctctgtctctggtgccgcggcgctaaccttcggggctgttgctgctgttgatgatgcgacgccgtctgtcgccgctgttgcggcggtagctgatacggtgtcgcctggtgctgctgtgtcggtggctgctgttgctgctgttgttgcggtctgaaaagcggccacgggggctgcgactgttgctgctgttgttgcgatgctcgtggctgcggcggccgttgtcgcggcgtttgctggcggttacaaccggctgcgtttggccggcaataacccgctgcccccgccgcccccgctgctcccgccgacgccgccagcctcgtcttcgccggcgttcacgagaaagcagccacctcccgtctcgccgggcacgccgaagcaaatggagttgcccgcgacggactcgccgagaagaagaccgccacccccgacgccggacgccgcgccgacgccactgggcgcgaagagcgccgacaggtcgtgcacctcccccccggcggcgtccgttaatcgctgggcgtcggcgtccagcacgcgtcgcaagttctccagcgaaaagtcctccacgccctgctcctgcaacgcggcaaacttgtccatcagcgacgcggccagcgcctcgcagccatccacgaagaagagcacatcgtcggacgcggggatctcctcgcgcacgctcagaatctcgtacacggccatcacttcggggtcgcaatccaagttctcggcgtccagcgccagcatgacgcggttttttataagatccgcgtcaaaaagcacgttctcgcggcgcgagcgtttgatgagcacgtcggccagacgcgtagccaagaggtagcgctggcgcatgaaacgataatcttggccgctcatagagctcacgttaaggctgcgttccacaccgttgcccgaaaagtagccgatctgcccaaactgatagatctccttgctgttgttgatacccgcatacttttccacgctcacgggcacggtcaccaaggaacgatgctcaaaaacgctccgtaccaacgattcacgcgccacagtggcggccatgggcgccggcacgcctgcggtcttcaagcccttgacatgcaacgcaaattcggcgggcgacgagaaacgcggactagcacctaacacgtgaggaaactgcgcgtggttctgcgtcgttaagcgcgtcgtcaacccgtgcagcgagccaatgtagtctttgaagccgtagtagcagaggaatttgttatggaaacggctttccacgtaactcagcacacagtctggcgccacatccagcagatcgtgctcctgatagtcagccgtcacagccaccagaaatttgacgaaagcattgaactcgcccatgtcacctatgggcacattcttgggcaacgcgttggaacagaccttctgccaaaactgtaagcaggggagaccacattcaggaaagagtcgctcgtgatgtcgatacagcagaaatcccaagcagcccttagccggattacgacgcggaacgtgatcgcggcgaaaaaacacgctacccgcgttgcccttgcccgcgcggtagatgggtcggtttttcactcgcaccatgatcaacgtgggtaccgacagccgcgagagcttgatctccatgggcaccacggcgtacgtgccctgcgcgtacagcctaaagtccagcaggcggtcgtgatccgaattcttggacgacttgatctgcttggtgaagagaaagcccttgcgcgacgacgtggtggagaacgcgccgtgaatggattgaaaatgctgcgtcatccatttggataccaagttggtggtcaacggattgtccacaatgtatgaggtagcggtaataagcgccacgttctggatcacgtaaaagacggatctgaaataggcgtaggccagcagcggctggaaggccacggcgtagggattcagatccaggttgaaggcctgcgtggcgcccgccacctcgtcgcggctgctcttgaggcgcacctccgaaacgaaacccagggcctcgtcgtccacaaacttgttgagcgccgaaaagacggccacaaagtcgcttttgccgtgcgcgctaaaggtatcctcgcccgtcacggggtcgatgagccgcatcttgcggcagtaatccaagatgcgattgagccgataggtacggtccacgctagcgcccagcatgcgaccgccgcgccccatcattcccccggaatccccgccacccccaccaccacgaccgccgcccagaccgtcgctcgggcccccgctcacgtcccgtccaccacccccgccagcaccgccgcccggaaccccgtcgtcacctttgccgtccaaacccccgtccttggcgtcgacgttgtaacgccgaccgaagctgcccaaaatatccacgtcgttgagaaaacgcgactgcacggtgatcacgcagggctccttcttgggctgcttgggcaccacgggcaagcgggtgcgcacccgcacgaaggccgtctgataacacgtgtggcaacaagtacccccacaggcctcgcacagccccgcggcgcagcccaccaggtgattcgtgagcgtcgacgaacccgacaagcccgtgttatacaccgagacacgatttagataccagacgaagcccgaaactagctgcggacacgtgccacacaccaacgccaaatgctgcggcccatagcgttcgtccttgagcggcgcgccttgaaatttgagcaccttgcgcgcgtcgttgtagacgtcttcgcaggccgccgacaacccgttggtgaactgaatagccttgagcaacgtctcctgactggccgtaccgccggcgctgggatgccgcgccgacgactggagatacaccagcctgtgctggtagagcaccgaattagcgctgaagaccaaggcggccacgtgcgtcgagagatgcaacttgagctcggtcagcgcgcggatcagatcgcggtgatcggttgcgttggtcactaaaggccactcggaaaagagcatagactcggcaggttggtaggccgaatcgaaaaataccgaggcaaaactgaaggccaactcgcaaaccaccgcgtcactcagcatcagatgatccttttccagactgctgagtcgctggctcatgtaccccaagtagcgcttatgtggcgccagcttcaccgactgctgactgtcgtgcacaaactgccgcaacgccgcctcgatcagcacacgcggctccgagaagcgcagcgattgacaccatgacgtgtacacgtagtagaaaagcgtctcgcttacggccggcacgtagagccctcgcgcctccacaaaagcgctgcgcgcatccagcgagacctcgtcggcttcggcgtcaagctgcagcgaattaaagagcgtaggcgggtacaacggcacgcgcaccgcctcgccgccgtacagtcgcaccgtggtcgcctcctccacgcatggaatcagctgaccggcaaagagaaactccttcaagccgttgcccaccaccacgtgcacagtcgtctcggacgcctgacagcccaccgccgcgcacaacgccgacagatcggtaggcacgcgatccgcctcgggcgtgtaggcctccaacgcgtacttctggcgggcgtcctcgcacaaccgatgcacgtctccgtgatcctcggtaaaagccacgatgccttgcgtatgatgaaagtagagcgcaaaaggacagaaggacgtgactttcgtgagcaccccgccgtcgtaacaaagcacaggcgtgcgcacagagacgccgaaatccgcctccaccgtcagccccgccaacagaggagcgatcaccacgctcgaggaacggtcgcatagcgagagagtggccagaatctcctgcgtttctgcgttcaacctgctgaagtagagaaaagccgcgggccccaccggcgctagcgcggttagttcctcgtggctcatggtggatgaacggaagacaatggctacgccgccactgagtgaattttataccaaggaaaagttcagcacgtcatgtttgacgcacgacgtctgatacaccaccgtggccaccactgcggtctggctgcggttgcggaccaccaaaggcgacaaccgcaacgatcccagcaattcgtaagaaaagctaaccgttacggtcgggcagcctctcgcagccagaccgctagccgacgcacccgcccgcgaaaatagcgtgatgttcgggacggcttcgcgtcaccgcaaactaacgtcggtagtcgcgcacgtcgtttatcctcagcacaccgtccgatcacaacccgttttcccactcagtcgcacaagcagcacataaaaaccccacacagtgcacgtgaaaacaacgtccctagaaaacggtgttttctgtcctaccgtcaccgggccacacaggcaaatcccgagcccgatccccgaaaacaccgtacggtgtttgtggcctccaaaatcacatcagataacaaaccgtgaaaagtcacgtttcacgaacacggtgtttttaaatcacaaagaaccacctgacggtttacaagcagaaacaccgcaccacggtggtacaagcgcggtggatctggtctcgcaacctcaatcgccgctatcaccaccgactttcgctgcgctccgccgacaaaacgccgtataagctacacaccccaaaaacccgcacgcctatgggcgccaaacgtgtgtattatctcaacgtcacgacacgacacaaacagcgtaacgtggtttcccgaacacgtacgcggcacagacccccgacacgtactcgaagaccttacagtttacgagtcaataaaacaggaaaagatccgaactttaaaattgtgtatttttattttcccatccccctctttttaccaaaaaacacatttttcgtcttgtaaaaagtaactttcgcccattgccatgaaacaccgtgatggggaacggtgttgtgtgtcgactgacgtcactacggcgatcagtatcgacgtcgtgtatacataacggtgcccggtgtttttattcggggcgttgtcgcgtcttgatgtaatgtaacctgaaaccgccgtgtccaagaatgcggaagccagcgtgtaatcataacggggttttgggtacaatctgacgacatctggcggcgagcgtacaccatcgaatgtggcgatcgccggctctacgtcacaatgacgcaaaaacacactgtaaaacacgcgtagacagctttcctggtcaacgagcgccatctggtgtcggcataagaacaggcatcaaccccgtggccggcgaggcggtgagcacttttgctggtcacgtgaccatcagcgcaggaagcgaggcccgtagaaccgcccaagaggcggtgccagatgccaacgtcataatcacaaggtgatttgttacgtcacgcgcgcgcacgcacgcgcgcgcggtagaatacagcgatccctagtgaagccacacccattacgtgtagccatatccgcttacgtatacagccacacccctaggtacgccaccttatctaccaatcatagaaacggatatacaatgacccctccctagactccaccccttgtacggaaatttcagataggtggaacccgttagggttccaccgtcctcggtgtacgtacaggcttctccgtctaccggaaatatacacctgctgacgtagacgctactcccggatacgcgtcataagctactggaccctaggggggagtgtctacagggctacgtgcacgcccccttacttagggtatccgcccccttcctctgttttggcctagtaaacttaacgccgccgcttctcacgtgacccctggcaagcctacgtcacactcgcgtgaccacacccactccggatatacgtcatcctgtggaattccggacatacggtgacgtagcgagcgtagcgagctacgtcacgtatgcgtacgtcacctccggcggaaatcatctctgatgacgtagcgagcgaagcgagctacgtcatcagtccgttttacgtataccgggtgctaggcgacgccccgtaggggcggagcctagcttccacccctaggatgcataccctatatagcataattcttctaacgaaacgttctacgaaaacggactggcggaacgggaaccaccgtaacccccccccctcacccccccccttctcctccggaaccggggggggcaaatttttaccaaatttgggcaaccatgttttccaatgggacggcgtttccgtgcgcatgcgcagtcggggcgaatttttggttgtcagggcgttgccacgcggattatgggatgggggctcgagtgcgcatgcgccggggatgccgcatggaaagcctatatataaggaggggtgaaccaggggccccggtgcgcatgcgcggaccaggccccgcgggagggtcgccctgcgcatgcgccggtaaaattccactgggtgtgtgtcgtgcgcatgcgccagtatttttccactggaggcggtcagtgcgcatgcgtcggtaaaattccactggatgtgcaccgtgcgcatgcgccggtatttttccactgggcggccgcacctagggagcgcgagccccgtgccgggcatgggccgcggcggtggaaaattaccgctccgcccacctaggcggggcatcttaaaacctataaaacccggcgtacccgccgccccccggcgcagtccgcggcagggttccggccgtgctgcggtccgcacgctgcgcccgctcccgcctgcctcccgccctaccccccaccctccccggccgaggcccggcgccggtccgtccgcgggcccgtcccaccgccctggagcaccatccggggccgtgggccgggcaccgggcgcggcccgctccggacctcggccgggggtccctcccctccccccgctcgacccccccatccgacggcccggccgggctgggacccccgcaccggggtcccggttcccgtccgcggcccggggggacccgagcgggggcttcccacccccaccccgctcctccccgggctccggcccgggatccctcgctgctcccggcgacctccgccggcttcccggtccacccgccgcggaacggacgggacccggggtccgcgcccttcccctccccccacggggggctgggtcacggaccccggttcctaggctcgttccgcggtgggcgaccggggatcccccacccagctccccttcccggcccgccccgctggcttttgggcccctccgggctttttttccggctgggggtcgcggcgctcggccgacgacgacggtaggtgggccgggtggacggtggtggggacgggcgacgccccggctcgacggcagtcggtcccggaaggttgggggctgggggcccggtcaggagctccgggagcggggtcgaccgcgacggcttccgggtctcgcggcggctccctctcggcggctccggttgggctcccctcccccctctcgagggtccggccgccagtcgtgaccgggggtccctcggcctagccgccggctctcggtccgccttatcctgggcgttggccggtcccgtgacgctcccctcccccgctgctccccaaaaaactccgcccgaaccgtcgcggcttgctggccctgggcgtggtcccccactcccctccccccatcggccgcccagccggggtcggcgcctcggaccccaccaggctgtggcgtgtgtgctggccgatgcggcggcgaggttgggtgtggccggaagcgctcggggtcgacggtgggccgtcatgacacctcaattgccgtcagtacgcccctccacaatcaccgtccctacacgatgggcccggcaggtcacccaacgttggttcaggcccagtcgggtttttccccggcacaaacgcacgtccccgtgggctccacgcgttttccaccctttcctggaggggtccggaacaccgtgaatccgcggggagggtctcggcacgggccgaggagaccacgaccgtcccacccggcgtgtcgacccgtccgagacccgggaagggaacaggccccacccttttttttcccttctccgatttgccgtggaaaacccgtgaaccgatacgggtacagacggccgaaaaaattcgagacgacaatacgacggcagggcgtgattttcttccccatccgacaaaaccgtgtccctcaaaattccccacctttctctgttcaaatggccccgaaactgtaaaacaccgttcgaccgcaccccaaccggcgccatcttggtgaccttctcgacggttctctcgctcgtcatgccgttctgagctccgacatggcggacgagagaaaatggcgtcgagagcataggagcgttttcgctccaggcgggtaaaagaatagcacgataacttttctgtgctttttttgagacgttttagaagagctttttttctgctcagagcgaaaaaatgatagccctgaaaatctcgacgagtctggccgagcggcgccatcttggaggaggggcgagtcgcgggcaccgcctcggtaccccctggccgaggcgagtccgcggtcgccgcctgttccgtgatgctacctagagggcgccgtcgaggcgactcttcctgttttcgccctgagggctaacggtcgctgacgtcaaaccatctcgtgctcgctgagtcacatccggttgttgacaagcgatggaggaccgcacccaaagtgcgccctctagtcatcgcgcctgaccccttttataaactgctcgaagaaaagaacaccttatgtgaaaaaatacagaatgatgacaagttcatccaacacaaccgctcaacaacgccatatctatcagtgtccaaaaactatcttctatcctttgaaactataaatgctgcctatatacatatttagtatccaagactcttaccacgtagacgaaaagaagtgatacaatgatcttgacgtgtatcgtctatatcgtgctagatatattcagataagacgcgcaaaccatagatttctcatcagtatcatgaaagacctatagctctatatacgaacctagtcattttaggacagccgccggagaagccgacgagggatcgggcgggtgcagccagaacctcacgcccgatcccgcctccggtaggcgatttgcatctgtttggtaaaaagctcataagtctgtatgtgacctatatatatattatacgctatgtacaccgaactgtcgctgttgtataagaagaaaaaactctccatatttatatcgtctgaatttttgcttgatagacacgtgtttggaactctgtccccccacgttttcactgtgtataacaaaaatatgtgtttctcaaaagatcttgaggtgtttgaaaacgggggaaacccgcgtttgggtgcgctaagccccggactgggacgtagccggcgtccggcacctatatttttctattttttttacaaaatatatgatgaaccaagaataaaactctagctctcgtctatttttaatatgctctacttagaacctttttaatgacagaatgaactccatgttatacgctctttatatagtttctctgcactaacctttaaaatcgtatccttccctgttgtacaaatcatcttttgatacacaatgatgacctgatatccctccatatatatgatcggatattattccgttagacttgtcctccttttttttcctcatctcctgtatctggagatatatgttgaccaccaccgccatgaccaccaaaaagctagccgtcacgactagaaatgtgtaggattcggactttccgttcgagaagaaagagaccgcgtctctggacgctctttttgtcggtctgaatcgacccgggatacgtaagagagcggccctacatcggggggcgctcgagaccgacgacgttccatctgaccagaaaaaaaaaaggcacccctcggtagcgacctctcaccatcgtttgcccgtccgcccgtccttcgtagccatcatcatcatctcaggctctatcggtaccatcgttgtcatctgaaaaaaaaaaactgcctcacccacctgcgtaaaaacaccatctttccggaggtgcggtaagacgggcaaatacggtcgtgccgaggcaaaaaaacgcaccatcgacaccacaccctcatgagcaccacctgtcggtgttggtcgtcctccatcgttctctacgaacatctcgacgcccgggtgacggacgacggcaagacgtcccggagaagacggtgttctctcgggcggtacgctctctggatctataatatctatagtagctaaacgagactgtgagtacgacgaaccacatcatcttttttttatgttgctcctttagaaaatgacttatgtcgacgacactcggcatcagccatctcgtgaaacacgctcgcttttcgtctctccaaggaacactgggtccgctgaaagggaccgtgtaccgaccaaagcaaaaaacacacacgtagtaacatgatcaaccacgtctgaatgacacgaaaacacaatcgtataacgctctattcatggaacgaacttggaataaaaaaaccatcgcaggccagaggctaagccgaaaccgtccggggaagcgggcgcgagttttccgacttagtctctggtgctcgttgagcctctttttttttcctgattctctgaagaatcaccgtcacagccctatgacgcgaaatcaattgctagaacataaacgttctcaacaggtatgaaatgaacaaactagatgatgctataaccttatattgtgtgtatatagataggtgtgaaatttgtaggataaaaagtgtcgttgtatgatgcacaacgatcgtgaaactggagactgtagctctctaccgaatgcaaatacacaaatgacatcgattcccgtccccacataaagaaatgtgctttactgtgaaagaatgaagaagattcttgttcctcgtacgacggggccctcgctcgtcgtacctcttcccccctccgggagaggggacgtcggggccctccgtcgcaccgggccgaagccagtgaaatgtttactacactgtcatcagaatatatgatgtatattatttcctccaaactcctcaccatagccaccaattcgcatcacttaagaaagtagtagcaaccgcggcggcggcgaccggccggtcgtcgtctcctcgtcctcaaatgttgtacatgtgcagaaaaatgtgtaaatacgtgttatttatcccatgcgtcttgtacatagatatatgtttttatatacgctatttatactttatatatccttttgcataaccatagacagtcaaggattttaatgatttgctcatccgcctttgagccatcgcttaggagttagttcctctatgttctcggcccaccttttcgactacagtagcaaacccttgtactaccaccccgataaaaaccacatcatcatcgtcaccacgacctggaaacgacacacgttcccccccaatcttgggcatgtgtatatatataaagaatgggagggagaggacgtggggctcgagaagaaataaacgccaagctcgattcgaaccaaaaaaccacatgtgtattgtgctttttttgtttttacggtggggaaaaggagggggccgtcattaacgaaaaccgtgtatggggtccggacacgaacagtacacagcttatggggaaaaaagctcacagagagaaaaaaacaccaagctcaggcacgcgtacatcattatcatcatcggatatctcaccacgagtcatagtagtaccaaggagtgtgtaacaccattttttcttttttctttgtaacgggataagggacagcaatcatcacgcacaacacccttcactctctttttagtcatccatatcatcgctgtaacacagcatgtcctcgtaatcgggcgtctggcagcgcattaccaccgagtcgtcttcttgcggtaccggtggtggcggcggcggcggcggctgctgctgggttaccgtcgtactgtgattaccgttggcggactgcaccgggatgataggctgcttgtggggaacctggggtggactgccgccgtgagaaggcgacggcgtcatcaagttaagctcaccacggtgactccggacaccggcgaggggccccgggggactgggagggaccgcggtcgtcttgtagacgacggtgtccccgtgtcgatccgtggctcgtaccagatcttgactgctagcgtcgtcactgtcttcgtcctcttccagctcgccctcagagtagtgctgctgcggttgcgacggtggctgggcgggaggagcggcggcgatcattggagagggatgtcgatgactcccttctctgtcctttttatcgtaggctgtcagcgttgctgggtccgtcctgctttccatatttgcgcattgctcatcggtgggatgaatttggtctcctccccgctgttgtccgccggcagtggcgtggttgctggcggttgtcgttgtcgtaccggcaaagacggtgagatccaatagtgactgctcgtcgaagggacagtacgctatcatgaaacgatagggtgccaacgcgcgttggatgcgcagttcgcacatctcgttctgacactcgtggcactgcagggcgcctaggatcaggtccgagacagcgccgcagcggtaggtacccatggcgttgttagtatcgaactggtcaaaaaattggggcgtaccggtgacttgcaacgcgcgacggcgtagcgagacggccacgcgcgagaaagagcacacgtaggccatggcgcggtgcatgggttgcgagaaggtctcgggcggacgcttctgcagatcgcagacgtcgtcgcgtagccaggcgctcatttgacctggctttttgactagccgtttgagcgtgctgcaatggtcgccccagccgtcctggtggtccaggatgcagcccaggtccaggttgttgagtttgttgaagagcagctgacgcatgccgcccaccgtctccagatagggatcgtgcgggttgacgggtagcccgtgcaggtggtggtacttcatgtagctgagcgtttcgtcgatgatggccagcaacgtgtgcaagttgggagcgttgtacacggcgaagatcttttccaccaccagcttgcgcagcaacggttcctccagccaatcgaactgttgacggatgtgcaacaggtagtcggtgtgcatgagctcgtcgtgtgacagcaggatgcgaccgcgcggctgatgatcttgcgggaaggcggtggggaccttgagatcggcggggtagggtgccagacgtagactctcggccgtgtagcgctgaaggtcgtagacgggcgaggtagaactcggtgaggtacccgacgaggcggcgccgcgctgcagacgcgctcttttcttcttttcgatcaaacggctgagttgctgtagttcgtcctcgtccatggcgtccagttcgtcgtcaataagcgccagcatctgttgttgttgcggtccggtggacgatccgtgatgattattggctgaagaggggtgagaagaaccgaaagtcgtaggacaactgggaactcggcgacgaagatgcgtcgaatcgccgccgtgatggtgcggttcgccgtcatcgttgtcgtaagacttaccgtagtgggggttaaggggcaccgaggcggacgcggccacgcgtcgcttgaaagaggaggacgccctatgtccgccacggaagcccgcggtgcccatgatgatgtgtccgccggtgcccccgagtgcgtggcgggaggagggtggaaggggaggaggatagtggtccggatcgccttcggtatcatcgtctttgctgtagcggggtcgtcgtgcggggacgcagggtcggtgatgatgcgaggcggcgccgacggtatcttccgcgagatggtattcgctggcggctgctccgttccgtgtcgacggcgaggttggacttcgctcgcgtcggaacttccgtggcacgggttcgtaatctagacagaagcgccgtgcgcgacgggcgcggcgttcgcgctcgctcagggaagataacgacggagcgtcgtgacggccgcgtgagtgcagctccatggccgccgtcgctaggaaggtcacgttcgggcacgctgatgtatatatagatgagaccgctgccggggggcgggtcaccggcgccgtggaaagtgaggctcagacggcggtcgccggcggcatgggcgcgtcgggcggtctgattttgatggaaatgtggacgtttttggcgttggagtgacactttttggtgaaacagcggctccagaggctggcccagagcgcgtagctgtgctcggtgcgcaggtcgatgaacacctgcacggtctcttgcgggttgcggtgcgtgtagttgagacagcgaaaatcccgcgtgcgcgcgccgtcgcgccgcttgacggccacgcagcaggcgccgtggggctgaaagaggaggacgtggggtgcggtaaactgctcgctgacgtgcggctcgtagtgttgcgtgaggtgctcgagcagcggcggccacacgcgggtgacgacgagccgctgcaagtccgtgtcggaaatcgcagcggcagtggcgccgtcgccaccgtacaggtgataggcgagcacctcggtgagaccgcggcgtcgataacgcgtcacgttaagcgagcgcgtctcgataaagttggcttcggtcgaggggcagattttgtcgcgcacgctgagaatgacgcgtggcggcggcgacaggggcaacgcgggcaggtcgtgcggcgggtggtggtgaagcaggttacgcagatccagttgggcgcgcacaaagcctagcgggtgttcgcggtaggcgtcgggcacgatgaacagcggcaacagacggcgatgcatgaaatagccgtcgtcttggtccattttatacatgtagggcagacgtacagagcgtccatggtggtagatgcctgtgtctaggctgctctcgggatgcgagatggggtccagcagcgtgtgcagttcggcgtcgagacagacggcgtgattgagcacctgcgccacggcgcgtaaaacgctggggtgtacggctacggtgcaggcggggaacggcgtgatgatgcgcagccccagtttgcccttgcagcggcagtaagggggtgacgtgtcaacggaggacgttggtttttgaaaaacgccgttatcagggacgttatttttgtcctctttcccgtcttcgtcttcctctgtgtcgcgctcgtcccggtaatcgagatagtcgtcgtcatcgaaaggcgcgccggccgcgtccacgggcacgctgttgggtgggcacgcgcttttgaagaaatagaccgggtgccggtcggggtgcgtgtagccaaagaggctcgcccatacggtcatccagacgcgtcgtagtccgcgacataattcaaagacggtgtgtcgcgccagaccggagacgccgtcgcgcagtcgtaaatcaaagtcggccacaaaattgaagacgggcagacgttcgttgaagacttcgtgtcgcgtgtagtagaactgtgtctcggggctggtgctggccacgtcgtcgtcgtgtagccacacggtctcggtcagggcctcgtccgagaaacggctgtcgggtacgtgacggagcaggtcgcgcggaaagaggctgcgatgccaggtttcggaggccacggcgcagaagacgtgctggtcattgggcaggtgtacgcggtagacgggcagcggtcgctccagcagcggtgccagcgcgggctcgggtagcaggtagcgacgttgcgagtaacgcgttagcgtgccggtggtgtaggtctgggctgtgcgcagcgaggcgcatagacgtaacaagccggacagggagcgttccagtggcgagaagacagactcggaaagcgtgttgatgcgttcgagctggcgcgccagctgcgtggaggtgccaaagaagcccgccaggtgcgtgccgtcgatgcggccgccgtagccggccagccccaggccgtgcgggctggtcgccgagtggggggattcgtcgagacccagtaggtgcgtctccacgtagtcgtgcagaaagttgtcgagcgagaagtatttttgcatgacgtccagcagctcggtggaaagccggcggcccagaaaacccggttcgcgcgtgcactgcgcttcgggcgccgcgtcagcgtcgtaagccaccacgcgccggtactcgagcaaccgcgcgcgtgccagcgccgtgcggtaggccaggtagacgtagtgcacgcagaccgtgtcgggcagacgcgcacgttcgcggaacgcgttgatctgcgtgtccacctgctctagctcggtgtagtcgcggcggttgcgcgccacggcgtacgccacgaaagcggacacgcgctgacggaagggcgagcccagtagcagacgcgcgaactcgcccatggaggcgtgcgtggggatgatggtgcccaggtcgcgcgtgcagaagctgcgcacgtactcctccacggtggagatggtgctgtactggccctcgaataggtagtaggccatggtcagcagcacctggccctcggtgtgcccgaagacgctgatgaaccacgagggcgaggtggggcagaggaagacctggttgagatgacgtagcacggccgcgtggtgaaagtacaccaggtgcttgaattcgcgcacctcgccgccgtgttcgggcgagagcacgggcgtgcggaagagatgccggtagagcggttgcgtctcggcctcgtccagactggcgatgagcgccgagagggggatgggctggcgcgcggccaggtagcgcgagagctgcagcgtttcgttgttcacggcgaagacgggcgccacccgccgcgagtccgagcacttttgcgtttgtaggcagaaataaacacgtcgcgagacctggtgtttgaccagcagggggaagacgcagtggtccgtcggtgtctgcgagagtacgttggcgactatatgagcagaatcatactctgttgcgaacagaacgagcgtcatcgtcgcgccggcacgatgcagctggcccagcgcctgtgcgagctgctgatgtgccgtcgcaaagccgcgcctgtggccgattacgtgctgctgcagcctagcgaggacgtggagctgcgcgagctgcaggcgtttctggacgagaactttaagcagctggagatcaccccggccgacctgcgaaccttttctcgcgacacggacgtggtgaaccacctgctgaagctgctgccgctctataggcaatgccagagcaagtgcgcgttcctcaagggctatctctcggagggctgtttgcctcacacgcggccggcggccgaggtggagtgcaagaaatcgcagcgtatcctagaggccctggacattctcatcctcaaactggtggtgggcgagtttgccatgtccgaggccgacagcctggagatgttgctggacaagttctccacggatcaggcctcgctggtggaggtgcagcgcgttatgggcctggtggacatggactgcgagaaaagcgcgtacatgctcgaggccggcgcggctgcgacggttgcaccaccgacgccaccggcggtcgttcagggggaaagcggcgtccgcgaggacggggaaacggtcgccgccgtgtcggcctttgcctgtccctcggtttcggactcgctgatccccgaggaaacgggggtcacgcgtcctatgatgagtttggctcacattaacaccgtctcctgtcccaccgttatgaggttcgaccagcggctgctggaagagggcgacgaggaggatgaagtgaccgtgatgtcgccgtcacccgagcccgtgcaacagcagccgccggtcgagcccgtgcagcagcagccccagggacgcgggtctcaccgtcggcgttacaaggagtcggcgccgcaggagacgctgcctacgaatcacgaacgcgagattttggatctcatgcgacacagccccgacgtgcctcgggaggcggtgatgtcaccgaccatggtcaccatacctcctccccagataccctttgtgggttccgcgcgtgaactcaggggcgtgaagaaaaagaaacccacggcggcggccttgctgtcctccgcgtgaacagcctggcacgttttggaaaacgtacgtgatcacggacacgacgagcacggggtttctcatagacgtactttattaggtcagggatgacggggaggtttcgggccgacgtcaaaaataacgtcactcgtgttgacagggctttctgcgtcggagctcttttcatcttcttctgtctcgtcgacgtcatcgtctaccggcgagggtgtccgttgcagcaacgcgtgctcgggcgtgtgggtgaaaccgatgtcgggggtgggcggcacgatcatctgtcctagggggtgactgcccaccggcagataggtaaagcggtgggtggtaaaaaccgctttggctacggtggtgtgtggggagatgcagacggtggtgtgcgaagtgttgaccaccgtcacgccggccgcggtacccgggagccagatggtgggtcgaatgatgagatccgattgactaaactggcgcacgcccactatgagggcgcagataccgggcgcgtgcacgtaggccgcgtcaaaatagacggtttgcgtgtgacccggaccgatcaccagcgtctgacgggtacgtaatgaaaagaaacggtgttcgttgggcggcggcaagttcatgagctgccagggttctggcacaaaacaggggaaaacgccgatatcgccttcgatggtgcccggaaagatggactgaaaagtgtcgttgaggttgacgacatccaactgcgggacttgcagcccggattccagcagctcgggcatgcaaacgaattgcgcgtccaggcatttgtaaaaggtaatgccaaaaaaaccttcggggatatagaggctgactcccagcgaggtgggcactttgcgctcgcgtgatagccaaatgatgtgtttattgtaaaaagccagctgcgtgtggcattgtttaacgatgaaactggaaggcatccacttgtagggaactttgagcggcgacggtaatggcgacgacgcttcatcctctcccggatgctgctctttgtcgtatttctcctcggtcgattggggcagcgtaaatgtggtttgaaaatcgctatcgctagcgaaacgcacgcagtaacgcatgttgacggatttctcggctaggatgatggagcctgatgacggtgcggactcttccttcattattaacgtaggggtctcccagaatcgctgaaaacgggagcgcggcagccgcgacagtaccagttgagagtcgattctgtcggtcaacattgtaagcatcgtggcggtggtgtgatggagtggaaaacagtgatactaggtgtttttgttttatcggtggcagcggggagttctggtaacagctcatccacgtcaacctccgcaactacgttaaaatcgtccagttctagcgtgtcaacaagcaaattgacgacaactgcgacaactacgacaactacgatgagtacgacctcatcgacaactaccactaaaccaagttccactactcacgaccctaatgtgatgaaacgacatactcacgatgatttttacaaggcacattgtacatcgcatatgtatgagctttcactgtccagcttcgcggcttggtggactatgcttaacgctctcattctcatgggagctttttgtatcgtattacgacattgctgtttccagaactttactgcaaccaccaccaaaggctattaagggtggacagatttacagctcgacggtgttccggcggggtaaggtttccataagtgggtgactggagactaaagttacggatctcatctagaaatagcagcgagtctagatagtcccacaggggatctataaacgttctctgaaatcccgttgatggtgacgtaggtgtagtttcggaagccgttttgttttccacgaacatggtttcgttgtaatataaggagctcatatcaagagtaccgtaaatagtgtacggtgtttcattacggattagtacatgcgtgtttttcataaattctgatacggcggttcggttgcggcttgattcacaaaaagggttttgccggtaacgtagagtggtatacacccacgtcgctaggtcccttaattgcgtggtcataatggacttcataaagctactatcaggacgataagcaattgtagacgtggaaacccgccttgcggtggtagtaacactataagttgcgttagtagtgacgttcagagcggttgacgttgtatagggagaatatggcgtagtagtactttgagatttcttactctttttttctgattgttctttgactggagcttgtttacgcttgagttttcgcatagtgtttttcaacttagtaccgttaatatacttagggacgcgaaataaatttcggctcatggcgttaaccaggtagaaactgtgcgtacagttgcgttgcgcgtaacgtagaagcaaggcggttaggcctaaaaagtagatcgtttgactatccacgtttactttcttggaacctacatataacttcgtgttccaacgtggcacattgaaaaacatggggttgaacgtggtgaaattgccgcagccttgttcgccagtatcattacgtttggaaacgtttagcatttcggaaagacaagtcatggaaggcaccgtaccgcaagatgggggtctgaatgttattgttttagccgtatgattgtattctgagaaaacgtacttagccggttttcgaagctgagtgctataaaaatcgaaccaaagataggtaacactgttattttgaatgggtcccgctaaaatgtaataccgtggaaactcggtcatgttcatagtcagatttttaatgtgttgtctggtcatattaaagtattttgtatagatatccttttctagttgtttcaaaatctctaatttgaacttgtctagtctttgcttgcctatcgtagacagtactttacctgaccagtaacgtcctacggataatcgtaccgcagccctacagtttatgaaagagaatagcaggaaagttagcgacataaggaagaataaattaaaaacacctctcatctctccttttctccccatgacagaggaggagaccccgcaccgtccgtctgccttgtggtttggcttgcctgcgtgtactcactgctgattctggtcgttttgctgctcatctaccgctgttgcatcggcttccaagacgacctagtttcccgcaccttggctgtgtaccgagcttgtatccagggaccgatatgtaaccagacccacaacagtacctcgtaaataaagacgcacacacctcacgcatatagtaccatcacaccgtgtggcgtgtactttattacaacgagcaagagtgccccctaactattggggcccgtaccgttttagaaggttttgtgtgaatgtctttaacttctctgtcccttttctcataaactgtcaggtcctacagtcagcatgtcttgagcatgcggtagagcagatagatgccgatgatggccgatagcgcgtagacggacatcatgaggagacgactgtcggtggcgtccacgacaacgtcagttacttctaggaccgtaccgtttttcaaaagcatgaggtagtgagttcgcggagatgagaccaccacttcgttgtagggatccagggcgaaaaggacgtcgtccgagtcgtgcatgtacatgatgttgatgacgccttgcgtgtcgtcgtattctagcagggcgctttggcaaaaggcgcagttttctagggaaatgttgagcgccgctgtgatgctgtgtgtggtatgcatgttgcgcgtcagttcgcatttagtttgactgtccgtctgggtgatgatgaggctttggcctacgacggtggtggagacagggtaggagatacctttgatcaggtactggtttgttacgacataactgacgtgttcggagacggtcagcgcggagaaggattcgcctagtggcagacaaaacaggtcggggaaggtttccaacgtgcttggttgcatggtagataggatggagagggcggcgggaacggtagtggggacggtggcatcggggaagagacgtgtgaggcgttcgagcgagtgatcgcgtcgcccgctactggaacagggtgtgtacaggtcgctgaggtattcgtggtgcggatgagctagcaactgcgtaaagtgtgatagctcggccaatgaacagaggcccgtttctacgatgaagatttcgcgtctctccgtcgtatgtaccagcatggagtggacgaggctgcccatgaggtagagttcttgacgcgcgaaggctgaaagaaaagaggccaggtgcgttttgtgtagttttagggcaaagtcggcgatctgtcgtagtgcccactgggggatgagatgttgctgattctgtttagagagtatgtagaccaggcgtacgaggctggtgatgtcggtgatctgattcggtgtccaaagggctcgtttggccaggtccacggccgtgggatacagtagcaacgtggtgcgtggtggtgtttgtgagaggcaggtgatcataaattcttgtatttgtaagagtgcggcctggcggtctagggcccgtgggacggagacttgggcgccggcctcttcttgtcgggctgctgcgaacagtgctaatgcgtaggcgaaggccatttctaccgtgcggcggtccagcatctgacatcgaccgctcttgagtacatccacggcgtaacggtgaaagctgttacgtagtagtgcgctgaggtctaggtagttgaagtcaagtgcggcgtcaagaaagtccgggtctttgagataagagtgacggttcagttgatctttcttaactagcaccaggagctcgtgtttttcagtttgtcgtagtataaagttgtcgcgttgatagggcgctttgaaaagtacgcgtggaagatggccgaagataagcagcatgggtgtgtcgtcgtctatggacaccgtaactacgaagaagtcctcggtcagtgtgattttaacgtaacgtagttcgtcgatgaggtaaaagccttggtgcaaacaaggtgtgacggtgctgaatagtagatcgtgtccatcaaagaggatacaggtctggttaaagtgtggtcggtgtagtcctgaggtggtatgtgattctgtccagccgtgtggagtggtttgcggtggcatccaaacgtgaggtattgacaggtcaatgggcggtggcacagtggtgggctgttcacctaggctgtcttgtgcctttagctgctgcgaaaaagatcggtagctggccaggtctttggataccagcgcgtaagtgttaagtctctgttggtatctttccagggtttcggtcagatctacctggttcagaaactgctccgccagaggacccgcaaaaagacatcgaggcatatggaatacatagtattgattatagctttggaaaaagttgaaactgatggcgttttccctgacgaccgtgctgttacggaggctgctgttgtaggtgcactgggtggtgttttcacgcaggaagcggatgggtctcccgtaggtgttgagtagtaggtgaaacgcgtgagggtccagcgcttcggatgcggcgtctgcgccatatcgttgcgaaggtaggtgactgaggaggtagacggcgaagacggtgaggtaggaggggaggccgggccgcatagcgcggccgcgccgctgggttcagcggcgtgatccaggtggtggttggcgttacacccgagagaaggagaaaaaggatcccaggaaggagcacccgggtgcggcgctacgggttacaaaagtcgcgtctccgtctatttaatacgatgtcattggccgctgcgaagggagaagaggggacacgcgaataagccatgccgtccgggcgtggggacgacgctgatttgacggggaacgctctgcggagattgcctcacgtgcgtaagcgaatcggtaagcgcaagcacctggacatctaccgtcgtctgctgcgggtctttccctcgtttgtggcgctcaaccgcctgttgggaggccttttcccacccgagttgcaaaagtaccgtcgccgtcttttcatcgaagtacgattaagtcggcggattcccgactgcgtgttggtgtttttaccgccggactctgggtcgcgcggcatcgtgtattgctacgtgattgagttcaaaaccacgtactcagacgccgacgatcagtccgtgcggtggcacgccacccacagcctgcagtacgccgagggcctgcgccagctcaagggcgcactggtggactttgattttctgcgtctgccacgcggtggcggtcaagtctggagcgtggtgcccagtctggttttttttcagcaaaaggccgatcgcccatccttttatcgggctttccgctcaggccgttttaacctgtgtaccgattctgtcctggactatctagggaggcgtcaggatgagtctgttgcacaccttttggcggctacccgtcgccgtcttcttcgagccgcacgaggaaaacgtgctgcgctgccccgagcgcgtgcttcggcggttgctggaggacgcggcggtggcaacgcgcggcgggggctggcgcgaggacgtgctcatggaccgggtgcgcaaacggtatctgcgtcaggagctcagggatctgggtcacagggtgcagacttactgcgaggatctcgaagggcgcgtgtccgaggcggaggcgttgttgaaccagcagtgcgagctcgacgaaggaccgtcgccgcggacgctgctacaaccaccgtgtcgtccgcgttcgtcgtccccagggaccggcgtggcaggagcttccgccgtcccacacggtctttatagtcggcacgatgccatcacgggacccgccgccgccccgtctgacgcggcgaccgcgtcagcggccgccggtgcttcttctacctggctggcgcagtgcgccgagcggccgttgcccgggaacgtacctagctactttggaatcacgcagaacgatccctttatccgctttcacaccgattttcgtggcgaggtggttaacaccatgttcgaaaacgcctccacttggactttctcctttggtatctggtactatcggctcaagcgggggttgtacacgcaaccacggtggaaacgagtgtaccatctggcgcagatggacaacttttccatttcgcaggagctgctgcttggcgtggtcaacgctttggaaaacgtgacggtgtatccgacgtacgactgcgtactctccgatttggaagccgccgcctgtctgctggccgcctacggacacgcgctttgggagggccgcgatccgccggactccgtgacggcggtgttgagtgagctacctcagctgttgccgcgtctggccgacgacgtgagtcgtgagattgccgcttgggaaggccccgtcgccgtgggtaacaactattacgcgtatcgcgactcgcccgatctacgctactacatgcccctaagcggtggtcgccactatcacccgggcacttttgatcgtcacgtgctggtgcggcttttccacaaacgcggcgtcctccagcatttgccgggctacgggacgataacggaggagctggtgcaagagcgtctgtcgggccaggtgcgcgacgacgtgctttctctctggagtcgacgtctgctggtcggcaagctgggtcgcgacgtgcccgtctttgtgcacgaacagcaatatctgcgttcgggcctgacctgcctggctggcctgctgttgttgtggaaggtgaccaacgcggatagcgtcttcgctccgcgcacgggcaaatttacgttggccgacctgctgggttcggatgccgtagccagcggcgggttgcccggggggcgcgcgggcggcgaagaggagggctacgggggacggcacgggcgggtacgtaactttgagtttctggtgcagtactacatcgggccgtggtacgcgcgcgaccccgcggtcacgctgtcgcagctctttcccggcctggctctgttggccgtgaccgaaagcgtgcgcagcggctgggatccctcacgtcgcgaggacagcgccggaggtggcgacggcggcggcgccgtgctcatgcagctcagcaagagcaaccccgtggccgactacatgttcgcgcagagctccaaacagtacggcgatttacgtcgcttggaggtacacgacgctctgctctttcactacgaacacgggctagggcggctgttgtcagtgaccctgccgcgtcatcgtgtgtccactctgggctcgtccctctttaacgtcaacgatatttacgaactgttgtactttttagtgttgggttttcttccgagcgtggcggtgttgtaatttccaccacgtgtcgctcgctgcataaagggcgagcgtccccggagagggtatattcgtttggcgagagcgggcagcggtggtgggtatgtccccttctgcggagaagactacctcagtcaccgattccatcatgctcgctatcgtgaatttcaaatacatgggcccgttcgaaggctactctatgtcggccgatcgcgccgcctcggatctactcatcggcatgttcggctccgttagcctggtcaacctgctgactatcatcggttgcctctgggtgttgcgtgttacgcggccgcccgtgtccgtgatgatttttacttggaatctggtacttagtcagtttttttccatcgtggccaccatgttgtccaagggtatcatgctgcgtggcgctctaaatctcagcctctgtcgcttagtgctctttgttgacgacgtgggcctatattcgacggcgttgtttttcctctttctgatactggatcgtctgtcggccatctcttacggccgtgatctctggcatcatgagacgcgcgaaaacgccggcgtggcgctctacgcggtcgcctttgcctgggttctttccatcgtagccgctgtgcccaccgccgctacgggttcactggactaccgttggctaggctgtcagatccctatacagtatgccgcggtggacctcaccatcaagatgtggtttttgctgggggcgcccatgatcgccgtactggctaacgtggtagagttggcctacagcgatcggcgtgaccacgtctggtcctacgtgggtcgtgtctgcaccttctacgtgacgtgtctcatgctttttgtgccttactactgcttcagagtcctacgcggtgtactgcagcccgctagcgcggccggcaccggtttcggcattatggattacgtggaattggctacgcgtacccttctcaccatgcgtcttggcattctgccgctctttatcattgcgttcttctcccgcgagcccaccaaggatctggatgactcctttgattatctggtcgagagatgtcagcaaagctgccacggtcatttcgtacgtcggttggtgcaggcgttgaagcgggctatgtatagcgtggagctggccgcgtgttacttttctacgtccgtccgagacgtcgccgaggcggtgaaaaagtcctccagccgttgttacgccgacgcgacgtcggcgaccgttgtggtaacgacggccacgtctgagaaagccacgttggtggagcacgcggaaggtatggcttccgaaatgtgtcctgggactacgatcgacgtttcggccgagagttcctccgtcctctgcaccgacggcgaaaacaccgtcgcgtcggacgcgacggtgacggcattatgagcggcggcgctgtacgccagcggggagaaaagtggcagataaatcacgtcaggttcacacgtcgttagccagcgtcggcatatgaagggcgcgggcggccagtacggcctctgggctgagacaggacgaggcagggtgagaaagaggaggatgggggggaccggggtggtggtgctgctgctgttgtgggtgtggacggtgcggatgccgggacagcgtgccggcgaacgttctgtaatcttccataataaaggtaaaaatgcccgtctcgtgtcgactccgctggatctcgaaggcgtcgggggtaatgcgcatcttgccggtgccgatgagataaaagtaccacattttttgacagatgatgcgaatcaagggttcgtacgcttcggcaccccagtggcgcgtgaagaaggccgccagacgaaacaagcggtgtccgtagagcgtgcctagggagaagaggatgttgccgttgcgcgccaggtcttcggggaaaacgaccggcaggccggtgtggcgctgcacaaagcgcgtcagcagtccgccgctcaagcgcgggtgacacaggcgctggctgagacgggcggcgcgcgtttcatcgaacacggccgcctcaaagtccagccccgggaaggcctgacgcagttcgcggtacagatgaggccagtagggttgcggcgtcttgcgactaagcacggcgtggtccgagacgcccaggttgttcatggtttcgcgcagtagcagcgtttcgagaccgcggtgaaagaggaggacgcagatgaggcgtacgattttgagttcttccaaacgcagcgagctcagcggctgtccgcgcgacatcttctcgctaatctgtaatattagatgattggcgcaagtaaaggagaatttgcccgtgcggacccgcgggacggcggggttctcttcgtcgcgggccatcatcgttcgctcggtgagcgggtagcgacggtgacgacaatgacgatggacgagcagcagtcgcaggctgtggcgccggtctacgtgggcggctttctcgcccgctacgaccagtctccggacgaggccgaattgctgttgccgcgggacgtagtggagcactggttgcacgcgcagggccagggacagccttcgttgtcggtcgcgctcccgctcaatatcaaccacgacgacacggccgttgtaggacacgttgcggcgatgcagagcgtccgcgacggtcttttttgcctgggctgcgtcacttcgcccaggtttctggagattgtacgccgcgcttcggaaaagtccgagctggtttcgcgcgggcccgtcagtccgctgcagccggacaaggtggtggagtttctcagcggcagttacgccggcctctcgctctccagccggcgctgcgacgacgtggaggccgcgacgtcgctttcgggctcggaaaccacgccgttcaaacacgtggctttgtgcagcgtgggtcggcgtcgcggtacgttggccgtgtacgggcgcgatcccgagtgggtcactcagcggtttccagacctcacggcggccgaccgcgacgggctacgtgcacagtggcagcgctgcggcagcactgctgtcgacgcgtcgggcgatccctttcgctcagacagctacggcctgttgggcaacagcgtggacgcgctctacatccgtgagcgactgcccaagctgcgctacgacaagcaactagtcggcgtgacggagcgcgagtcgtacgtcaaggcgagcgtttcgcctgaggcggcgtgcgatattaaagcggcgcccgccgagcgttcgggcgacagccgcagtcgggccgccacgccggcggctggggcgcgcgttccctcttcatccccgtcacctccagtcgaaccgccatctcctgttcagtcgcctgcgcttccagtgtcgccgtccgttctccccgcggaatcaccgccgtcgctttctccctcggagtcggcagaggcggcgtccatgtcgcaccctctgagtgctgcggttaccgccgctacggctcctccaggtgctaccgtggcaggtgcgtcgccggctgtgccgtctctagcgtggcctcacgacggagtttatttacccaaagacgcttttttctcgctacttggggccagtcgctcggcagcgcccgtcatgtatcccggcgccgtagcggcccctccttctgcttcgccagcaccgctgcctttgccgtcttatcccgcgtcctacggcgcccccgtcgtgggttacgaccagttggcggcacgtcactttgcggactacgtggatccccattatcccgggtggggtcggcgttacgagcccacgccgcctttgcattcgtcttatcccgtgccgccgccaccatcaccggcctattaccgtcggcgcgactctccgggcggtatggatgaaccaccgtccggatgggagcgttacgacggtggtcaccgtggtcagtcgcagaagcagcaccgtcacgggggcagcggcggacacaacaaacgccgtaaggaagccgcggcggcgtcgtcgtcgtcctcggacgaagacttgagtttccccggcgaggccgagcacggccgggcgcgaaagcgtctaaaaagtcacgtcaatagcgacggtggaagtggcgggcacgcgggttccaatcagcagcagcaacaacgttacgatgaactgcgggatgccattcacgagctgaaacgcgatctgtttgccgcgcggcagagttctacgttactttcggcggctctccccgctgcggcctcttcctccccaactactactaccgtgtgtactcccaccggcgagctgacgagcggcggaggagaaacaccgacggcacttctatccggaggtgccaaggtagctgagcgcgctcaggccggcgtggtgaacgccagttgccgcctcgctaccgcgtcgggttctgaggcggcaacggccgggccctcgatggcaggttcttcttcctgcccggctagtgtcgtgttagccgccgctgctgctcaagccgccgcagcttcccagagcccgcccaaagacatggtagatctgaatcggcggatttttgtggctgcgctcaataagctcgagtaagagagacgctatatttagggtttccctctcttttttttttctacaccgtgataccctaataaagcacactgcggttattatcaacgtctctgtgtttttattatttagaaataaatacagggaatgggaaaaacacgcgggggaaaaacaaagaagtctctctctagatgcggggtcgactgcgtggggtgctggaagtggaagcggtgctgatgggtgagggtcgtggcgcgggcacggaccgcaacgtgctgctgatgtctgccgcggtacgcacgtcgccgtccatgtcgctgcgcagataagaggtaggtcgtaatgcggcgtgctgcacgctcaccgttaatggtaccaagtcgtcaaggctcgcaaagacgtgccacgaggggatgacgagcgtgagagccccgttgttaccgcttcgacgtctttgtccggtcaggatcagtgcccgggacagtccggcttgggtgtccgagtcctcgtcgccgctggcctcctcgaagccggcaaacatggcttcggacaggggggtcggcgtcggtgtggaggagaggtcatcttcgtcgtcctcttcctcttcttcctcctcttcctcggtgggtggtaatccgggggactgcgggagaaactcggagacggcgccgcgcacgacgtcgctccgtggaaagagaccggcgcgcagctgcacctggggacgcttgattttgtccggtttaccgggtgtgagagtccaaaacccacggcggaaaaagtggatgcggcctagcggctgtcggtgttccaaatgaacggcctggtcgccggtcagcgtgacgcggagggtgattcgcacacgatcgggtagcgggccggcttctatggagacgcccgggatgttttccgggaaaaagatggtgtcgtgagtctgattggtttcgaaagcattctggatctgcacgatgtactcgggatgtatgcgcgtcagcgtaaaacttttgggaatcaacagctggaagccgttgtccggcaagcgtcgtaggtgcgggtacggattgtgtcgcgccaccacctcggcgcgatgcgtgtaaaccgaaaagtgcagaaacacgctggtcggcgggtgcggtgagtcgtgatgcagaaacagcatgatccattggcctcgttcgtccgtctccgttttgtggatgtacgtgttagggtccgaacaggccagctgctccagggcgtctaccagcgtcagcgggatggcgccggcgcgaaaggcgaactggctgacaaagatctgccctgcctccaaactgctgtcggttctgcggcgccagttcggcgtcacggtcagtcgcacggcccagtggtgagccgtgcggcggatgatggcgcgcgcctccattcgcggccgattttcttcgccgccgcgccgctggctctgaaagaggtgcagtccgctaacgggcacgcggtctagcggcagcgcaaaggccagcaccgagaccgtgttgttttctgagcctggcgtcaggcgtcgtgggccaaagttgttgaggtccaccagcagtcggtcccgttcgcccaccacgcagcggcccttgatgtttaggtcggtcaggtctacggtgtcgtgcggagatttgttctcctgaaaacagcagagaaccgagggtcggctcacctctatgttggtacgcaggtccaggagtcgcagacgaccggcttccagcgagccgccttccacgttggtgatgagccgaagcacctggcagtgcaggcgaccaaagctgccgctggcggcttcggcctcgctgatcgcggccgcttccgacgagggtccctcaccgggcgaggacgatgcctgagacattgcgaaggcgggatggggggagggtcaggggatgcgcaaaggtgaacgggtcttcgtgggaggtcgggaagggttccggcaactgtcgcaaatatagcagcggcgacaggtgtggcgcccaaaagtcgcgtgtctgagtggacgtgggtttttatagagtcgtcttaagcgcgtgcgcggcgggtggctcaacctcgatgctttttgggcgtcgaggcgatgcatggcccgggcagggcttcttgccggtggcggcgacgtttgggttgcgcagcgggctgccatacgccttccaattcggcgaagatgcggtagatgtcgttggcgtcccagaagaactcctggtacttcagattctgaccctgaaccgtagccaccatgggcaccaggttgcgggccaggatgccggcctgccagggcggccaggtgaacacggccggattgtggatttcgttgtcggaatcctcgtcggtgtcctcttcgggcgcgacggtggactcggccttaaggcggccgcgtgtcataacgcccgccgtgcacgccgtcgccgaggatgctgatttgcgtttgcggcccgcggaagtggaggcgcccgccatggcgccgccgccggtaacgcggggcgtcttgcgctcggtggttacgagttcttcgtcggagtccgatccgctggtccagacgtcgtcgtcgccctgggcggcaccctcgtcgtgccggtcccaggtgtgtcggtactcaagcttgccctggatgcgatactggctggtgaaggtggggtgctcgctgtactgaggcccgcgctgcagcagcaagtcgatatcgaaaaagaagagcgcagccacgggatcgtactgacgcagttccacggtctcgcgtatcgcttgtacctccaggaagatctgctgcccgttcatcaacaggttacctgagatgctcaggcccgggatgctcttgggacacagcagcccaaaatgctcgtgtgaggtaaaagccacatccagcatgatgtgcgagatcttgcccggtttgattatcatatttttgggacacaacaccgtaaagccgttgcgctcgtgggggcgcatgaagggttgcgggttgcgggtcatcgtcaggtcctcttccacgtcagagcccagcgtgacgtgcataaagagcttgccggagggcacgtcctcgcagaaggactccaggtacaccttgacgtactggtcacctatcacctgcatcttggttgcgcgcgtgttctccatggagcaaaccagctcgtgcgcgcacaccacgtgccgcagtgccacgtccttggtgggaaacacgaacgctgacgtgtagtagacgtcgggctctttccactggttctgctgacgcgtccaggccagtcccgagaccgtgagacgcgcctgccacatctgcttgcccgacgcgtgaatcacagcgtcagctacgggcaggtgtcggtgtttgcgctcggccgccgacgggtagtggtgcacgttgatgctggggatgttcagcatcttgagcggcagcgcgtacacatagatcgacatgggctcctggctggggcagatgcttcggcccgtggggttgtgcacgttgaccgacacgttctccacctcgctgcccgtaaagtacgtgtgctgcacctgcagctgattgtcgccgcggtggcatggcgtcgagtcgggcgtgtactgcgacaccaggatcagcgagggctggctcacgcgtacgtggatacccgtctgcaggagtcgcgtctcgtgcggcagcaccggcgtgtcgccgcgactaaacacggctttcagcacgtgccccgaaatgggacccagtacggatatcatttcgggacaacggcgaccgcgcgactccatgctgcctgcgcgtacgggtgtaggcgactgagcggcgcgccctttgcggccgccgccttacataggcaggcgaccaaacgcggaacccgaaataaaaacgttctacacagagacaaccgcggattattgagtgtctttttttattacaaaaaaaaagaggcaaagccccaccgtcaccacaccccatcacacaccaccaccgattttttttgttttaaccccgtatcgcgcggacgcctagtgtccgtttcccatcaccagggtcctctgtttagagatcgccgcagaccatggctaaagtgacaggactcgttttctctgtcgtattttccgtgagcttacagtcttgcggttccgtctccggggacgccagtcgcatgggcagcaggtcctccagcgcgatggaagcgcccagcaccgagagctgctgttgcgacggcgaatgggacgtggaccgcgagtgtagcgtggatttgacttggtgcgtcattgctgacaggcaaccgcgattcagcgtatgctttgacgagataaaatagaggcgtcccaggagcgcgtcccgtgggaacgtggcgccgttctcgtcgctcaccagtacggttaattccaaccaggagcgcggtagccagaccgtaacgggcattttgagtccctgacggttgtgtggtacaaaaacacccagataaggcccgtaaaagcggcggtagatacgtaacgtgtgcgagtttttcagcgtcaattcgtaagggacgcgcacctccagtccctcgtccgccgcaccggagcgtggcggtacaaagtaaggcagtggcgcgtccgaaaagaagggtcgtcgcaccgtttcgcgtcgcagccgcaggcgaaacgccactgggtcggctggcgcctcggtgcggtcgcaggtcacgttgaaacgtaacatgccgtcttggtatagcgtgagtgacgacagcgtcaggtccggcggtgattcgttcgggtctagctccaatcgtccaaagacggagggtcccaatgtcttggcagtggtttccgagaggcgcgccgagatacggctggtgagtccacgcggccccgagatgccgccttccactcgatgccagcacagcgcgtgtcgtacgcgcaccgtcagcgtgggcgtcagatccgcgtccgttgattccgcggtatcagcgacggaagccgcgttctccgttacgttgtttatatccagcgtcggctcgaacgtgagttctggcagatgcagcgcaagacagtcgtgtaacgccgtgtgatgcgcggctttacgtcgtagcggtagccgtttcagcagcggcgtgatgatacggagcgcgaagagattgagtgataagcgcacgatggccatgcgcgtcagttgctggtcgattactgagcgcaggatatggcagcctgggcgtgcgggaaagagagagaaggccgggcgtacgtcagaatcctcgttagataccacgcatagaatgccgcgttcacgatcgtcgttgcggtcatcctcgtcctcttcttttttcttctctttttccttttttttctcgggctcatgggaagccgccgtttcttcttcttgcgacgtcgcggagtcggtttgagactcgccgttcgcttcccccaattgcagcggcgtagagagcagaatctggaagggatcccgcaattcttcgggtcggaggtcgaggtgcaactggatcagatggtaggtgccgcggtgcacccgaggctgacggatgtcgtgtttatccgtcagtgtgaggatggtctgcggcgagccgctgtgcttgtccagctcgtccggcgttttcaggaggaggctgtcgtcgtcggtactggcgacgcccatcatggtcgtggtggtagtggtggcgaggaaagtgagcggcggcgctgacagagctcggcgttggcggcggcatttgccgctgtgtcggctgctattgctgccaacgccaccgccgccgcctcgtctggctcgtggccggcgggcccgattccgaaggttggggtcgacgcgtggcatgcttggtgtctgcgggcgcgagagggctggctcagcctttaaatatgcaggtcgcggatttgttatcgggtgaaacgtcacacaccgtgaagacgacctgttcgcggatgaggtcatccagctgtcgcagcatgacgaaaagcgccgacagccgcgcgatctcgtcgtcgggcgacacgtgctgcggccgcgcgggcgtgcgcggctcgccgacgctgcgctcgcggtccagccgcatcagcagctcctggcacttgacgagcagcatggagctgtcctctagcgccaacttgcgcacgtaggtcatggtcagctccgaggctaggttggccaccatggacatggagaggcaggcggtcttcatgtcgatcagcaggtgctggtcgatgaccggatcggggatggtgaaggtggcgtcgcgaaaagtaatggtctgcagctgctgcacggcagcctttacctcctcgtacgaacggtcgagcgagaagaggcccatgatgagtagtcgctggttgatttccagcgccagtggcatgggtacgatccagggcagcaccagctcccactggcccagcgtcagcaggttctcgcgcgccagcggtccgtggaagagcggcggcagcacgcatagcgcgtcgcccttctcccaagtcacgggtcccgtgttgaggacggtgtagagcagtccgtgcgtcggtacgtgtaggaggatctggttgccttctacgcgccgcatcaacgtcagcgtcatattgcgcagcaggccgcgcagtcgtacgtagccgcgggtgtgatctacgaactggtgtaggcccagctggtagtgtttgatgagatgtagacgctgcggaatgggcacaacggccgctactagcttggtcagtttgcctacgtcggcgatgctgagcttgtggtcgaaagtgcagaagatgttggcctccatggccgccatagcggcggtgaaatcctggccgcgacggaggagaagcagagacgaacaacgtctgcaccgggcgcggcgtcagagcgagcgtggcgcgtccgggcccgcgtttgcgtctaggtgattcgccgttaacctgcggtcgtcgccgtcctcctcaccggacggcctcacgagttaaataacatggattgctgtagcgggatgatttcgcctacgacgtagttaccaaagtgcgtttcggacgtggcaaaagccccggcgccacccttgagtttggtctccatcagcgccagcgtggtggtgctgaggatcggtagcgcttcctgcgtcagacggcacgggttttcgatgagttgttccgtgccttcgacgcagacgtactgcgtgtccgtgtcgccgcggatgcagtccttggcgcgtagcaggtactcgtcgatggttttgaagagcgttttgttggccgcgataatctcttccgtgttaaagtactgcgcgcaggggctgtagaatttggagttgtagcctagacgttcgcgatgtcgggtgttgtagagtacgtcgctcagacagccggcttgcgaggcccaggggttgtgtgtggccgcgaaagtctgtgcgtccgcttcgcgatggtcgtagatggccttggtggcggcctccgtgtcgtacggatcgacggccagcatgcaggaggcacgcccgcgcgggttgttggggatcttaaagtaattaacgtccatcgtcaccggcgtaaggattagttcgcacgcggccttttgtccgtgcaccgtggcggcggcattgcgctcggacatgctgccgaacgtcagcatggagatggtctccgtgtctaacagttgcggccgttctacgccggccgcgtgccggatccagcggtccacctcgtcgtgccggtacacgttcatagggaagacgcgaaagaggtcctgcacgcggacgcccatgtcggttcgcacgcggtttacgtaggctacgcaggtatttgacgtgtaacccagacccatgtctacggtgttaatgttctgcgtgacgtggtacgtggtgctgatgtcgcgttcctccttggtcacgatagggttgttgatgataactgacgtgcacgatttgccgctgtagagcagcatgtccacctcgaaggtgtcggtgcgtacggccgtgagtgcgaatcccgggtggatgtgcgccttggtctgcagcaccagtgaaactggtgagattttgtataacatggcggccagcgtcatgactgagtgcaacacgttgggacaggtggccgagtaacgcgaaaagggcgagcgcagccagttgtggtactcgtgtgcgaaggctgtgggtagcgggaaaccaccgtcgtgacggtgatagtgcgggaactcggtcacgtagcgtttaatgtcgtcgctcaacgccgcgcagatggtggggtttgagtagaaacggtggaaaggtacgggtaggctgtactcgatcaacgtcttaggcgccgtcacgacgcagcagccgttgtaaagcacgtgctgacgtgagataaagtccggcaggccctgacgttgcgcgtggtccagaggcgcgcgcacttcgagcaccttgacgtgctcgcccacgaattgcacggccaaaaacagttcacgacaggcctgcagcagcggcgtgtgcgcgtcggtggcgacgtcctccaccagctcggtcagcatctcgcctacggcttgacgttgcgccgctatcgagtcttcgggggtgacgccgcttgtgctctctttcgacgtcgtacctgacgtggagaccgcggtggcggccggcatcaggagaaacgccggtcggtaaaagaggtctactagcagcgtcttgaggttgagtcccaggccgcaggcccggttgttggtcatggcgggcatgaggcagagataaaagaccttttgtaacgtccattcgtcgtcggtggcacggtaatcgtccacaaacagcggctcgtcggcatccatggcgcccaaacgcggtacgtcagaaacgccgtggtgtcgcgcctcgatgttggccgggttcaacggttgccggtcggccactacctgtacgccttccatgttacgcggcaggtgcgtaacgaaggggggccacagccggtggtcgtgcagcgcgttcacgtaagccgatagcggttcctcagccagttgaccgttgttaagtcccggcagcgctgagatgcgcgttaccagacgcagcacggcgaccagattgcggtagtgaaagagcaactgcggtggtagggcgccatcagccaggtgttcggcgatcaacgtcaccagcgcgtagctgtgcgcaaaaaccagcagctgacgtgtgtgaaacatgttgacgatacaacgtgctacgaaagtgcggattagcaaaaaagcgtcgacgttgccgtgtaccagcacgtcgaccaggtagcagagctcggggtaattggggcttgtcacggtggttttgaaaagtcgcaacgtctcttcgtagtcgggtggtggccgcagtcgcatgtgttccatgatctcccaggtgcgcagttcgtggaaggggcccggtgccagtccatctggcaaattaccgatgacgatacgcggtgtacacagcgccaccgtttcgctgttttcctggcagtgcgtaaagtcgaagaaggggtgcagctcggtgtagagcgtgatgttgcccaccttgtagaagtcggtgaccacaaagtcctgcttcatttcgttcaccgtgcgcgggacctcgcgtcgtacgcggtaaaaatgcggtatgcggcgcgccgcaccgcccatgggttcctgctgaaaacgacactcgagcagtcgttgcatggcgggttccgagggcggtccgcgttccgtgaaggtctgtagacagggcgcgggctcgtgcagcaccgggtggcacagcgtcttgagcgcgtccacaaagtctatcttttgtacggcacggtcccggtttagcaggtaggccgtggtgggcaacgcgttgcgaacggtgtcgttaagcttaactttgctttccaccgtggtgtaaccgcgatcctcgggcagatacagccctacggggaagaaaaacgtcaggtccacgttacgttctagcggatctttggtatcggtgtttttgtagacgcgccgcaagttttccataatcaccgttttttcgcccagtcggatcacgtccatgctcagcggcgttaagctgtgcgccccggcctgcgaaagcgagtcgttgggcaaatgcggttggcccgaagtcagatgagccttgtacgagttgaaatcggccaggatcgagtgataggatatggcagtgacggcattttcgggactgagtacaaaattgccgtaggtggccggcgccgagaccgtttctttggtgatgtggcttgagagcagcgacatgatgatctgcataacgttggccgtgcttaccatcacgccgctgatcttggcccccgagctcgtggtgtacgtcgtggggttgtctaggatgctatcggtggccgcttcggctagacgcgtgaggaacttgagcacatagtcgcgatcgcgcgtgcgattcagcaaaaagagcgtggccagcattttggccttgaagctctgcaagatgttgcttcgctggatgcggttcagcgcctgtcgcgccagcgtggcgttctctaccagcgtctgcactacaaagtacggcggcgccttgcgtagcagtgtctgtaaaaagctgtgaatcaagccgcgttccatggcgtcggccgtgtttttgagcgcgcgcagcaccgtgtgcatagcttccacgttgaggatcttgtccaggatggtgccttcgaacgtctcgcgcagatacgtgaggcaggctgcgctgagctcaaaggggatggtgatgggggatttttcactgtatttggtgaccataatggtggtctgacgactggtgggcaaaccggcgccgctggccacacgcggcacctgcacgtggaacagcatttttcccgtagtcagtttattgaggtcgtggaacttgatggcgtgcgccgccgcggccaagccgctggtcaaaaaataaacccattccaggcgattgcagaaggtgccgaagatggcttcgaagtgaatattgtaacgctcggggtcgtcgccgtagtagatgcgtaaggcctcgaacatctcctcgccggcgctggtcttgacgtgcgtcagaaagtcagtgggaatgcctactttaggcaggagctcgagcgccgaccagttctccatcgcggcggcggcgtgagcgcgaggcgtcggagctcggggaaagcagcgcgacccggagaatggccggcgctgcgccgcgccgcctcggctgtgacgctctaatagtcgtcggcggctccgctacgccgcgccgggttttacacgtccccgtgcacgttcgcgcctgcaacctcacccaagagctatcgacgggcgaggacgcccgcttctgtcgtccgcgacccgttaacgtcgaacgggtgcgcgctgtttttgcggctctctaccgtgcctgtccgatacacgtgaggaccgagcccgagcgtgtcaagctggtactgggtcgtctgttactgggacccgtggccgtaccctgtttttgcgacggtgaagtggagggccacggtgaacatctggtacctacgacgcagttttgtcgcgggccgctgctctacgtgcaccgacgttgttgttgcggatccgtgaccgccgggcgcgcgctgtcctaccacgttctcgaaaaccacgtggccacgcatgtgctacgcggattgctctcgctgacggaatggaatcgagaattgccgagcctcttttgcgactgtcctggcggcggtggcgcctcgggaaccgaggaacgctacgccatggcctgcctgccgcgcgacctcagcctgcacctggacgactatccttacctgatggtggaaatcggacgcgtactcagtgtcagcgaggtagacgactacgtaaccgccgtctccggctacctgggcgaggccgcggcgccgcgcattcaggttcactacaagctgctctttggactcaacgtgcgtccgcaagcgccgtgcgcgttggacgctacacgcgacttttttctgctggagctgcaaaagctttggctgggcgttgaatatcaccacgaagtgacgtcggagtttttcggtcgcgtgctggcccagctgcatcgcgaccgcgcccgcgtcatgatggcgcttcgcttgcccgagcagacggtgtgccacctgagcaccttcgttctcagtcgcttcaagcgacaggtactgtacttcaagttacaggtgagctacggcaagtgccggactggccacgctgacagaagtgggggaggggggaacggtggaaatcagggacaccacaacctactgtgttatcgacgccttagcgtcacatttgccgacacagacacggtgtggagaaaccttttctacgtttattacgaactagctcgggatctggggtcccatgggacagagaaccgacccgtaaaccgcggttacggtgtttcttgcgctccgaggacgtcgcggctatcaccgtcagaatcgacggtggtttcggcgaacggacacgcgctgtcttccaccgcgctcccgacgacgagcgcgggtcacaagctgtcactgccgcgcgacccggccgccgatcgcgttcgacgttacgtgtgcattatctcgcgtctcatgtacgctcggtacggggagagatggcgtaaacaccgtcaacggcggtcggagacgggagaagaggaggaggaagagacgctggaatcgggggagactgacgccacgccgccatttgactttacggggcagcagctgcgccgggcctatcaggaacaccgacgtcgtaaacatctagccgtgcagcgttacgcgccgtgccgtcgtaagctcatcggcgggatggagtttgccgaggtgacgggcgtgagtctggaccgcatcgccgtcaacgctttcaacaccaaccgcgttatcaatatgaaggccgcgctctcgtccatcgccgcgtcgggtctcggcgtgcgcgcgccgcggcttcccaagaacatgacccacagttttgtgatgtacaagcacacctttaaggagcccgcttgcaccgtcagcacctttgtttccaacgacgccgtctacatcaactcgctcaacgtcaatattcgcggttcctaccccgagtttctgtactcgctgggcgtgtaccggctgcacgttaatatcgatcacttttttctgccggccgtggtgtgcaatagcaactcctcgctggacgtgcatggactggaggaccaggcggtgatccgctcggagcgcagcaaggtgtactggaccaccaactttccgtgcatgatctcgcatactaacaacgtcaacgtgggctggttcaaagcggctacggccattgtgccgcgcgtctcgggcgctgacctggaagccattctgctcaaagaactctcgtgcatcaagaacatgcgcgacgtgtgcatcgattacggtctgcaccgcgttttcacgcaactagagctgcgcaattcgtaccagatccccttcctggccaagcagttagtgctgtttctgcgtgcttgcctgctcaagctgcacggtcgagagaagcggctgcagttggaccgcctagtatttgaggcggcacagcggggtctctttgactacagcaagaacctcacggcgcacaccaagatcaagcacacttgtgcgctcatcggcagtcgtctagccaacaacgtgcccaagatcctggcccggaacaaaaaagtcaaattggatcacctgggccggaacgccaacgtgctgacggtgtgtcggcacgtggaagcccacaagatccctcgcacgcgcctcaaagtgttagtcgaggtgctgggcgcgttgcagagtatcagcggtacgccgcacacgcgcgaagtgatccaccagacgttgtttcgattgtgctcggcggccgcagccacatcgggcctgtgttcatcccctcccccattgtgtgtgtcctcatcttcctccgtcccctctgtcccaacctccgtcagcgttgacggcagttctgaacccacgtcgccgcgagcgcggtttgcatcacgatgatggaagccgcggccgctgccgccgcggcgtttcgtccggaggagcgtccgacgccgggttggcacgacgcggcgttgttaatggacgacggtacggtgcgcgagcacgcgtttcgcaacggaccgctgtcgcaactgattcgccgtgtgttaccgccgccgcccgacgccgaagacgacgtggtttttgcatccgagctgtgtttttattgcagcggtcgttttaaccgcaggtcgtccgtcttctccatctattggcagaagcatagcgatctggtgtacgcgcttacgggcattacccattgcgccaagttggtggtggaatgcggtcagttggggagtagtaggctacggtggcgcgacggtgatgcgagtggtgaggagcgccggggagacgacgacagcagggacgagctgtacgacgtgccgggcatttatatgattcgcgtcaacgacggcggcagcaccggtcccagacacgttatttggccgggtaccagcgtgctttgggcgccggacgttgtgatcactacggtgcagcgacgaatctcggcggcgcgcgccctggtgaacacgttccgccaatatttttttttgctggaacggcgctcgcacgaggagctggttctttgtccgcccgagatggaggagcgtctagcgccgttgttgcagagtgccacgcgcggtgattcggacatgtttgacggtgtggtggccagcgcttatcaccgtttgcgaatgagtaatattccgcgttcatccgcccgtctgctggagcactgcgtggggctggcgggtgctaagaagctgctcttgctcgacgtgccgcgtctggagaactattttctttgtcaggtctgtctttacgagctggacgaggacgagatgggcgaggagatgctgggcatgttggccggaaagcccgaggatgccgccgtctcgggcgcaagcggcggttttctgctacatcgcaagacgatgaagctggccgcctgtctgtgtttgttgctcaattcgctgcatttgcaccaggaggcgctggaggccttggatcctccgccgccgcgcgtcgaggagaacgaccttgtcaacgtggtgctgcgccgttattatcgcagtcacggcggcgtgcaggcgcggacgctggcggcggcccgggctttgttagccgactacgctgaaacgttttcgcctttggggagttttacgcgcctgggttacgatcgtctcgtttctgccgatgccggcgtcagtcgccggcacctggtggctctgctgcgtgcctagctgaccctgaaacggatggcgtgtatatcgtcacacaggtaggtggccatgatgacggcgatgataagatcgtccgagatacgattctggcgcttggccgagtagcgtgccgtcgtgccttcggccagcgtgacgcggtgcaggttctgaatctgctccagaagatactcgatggggtcgtggctcagcttgatggtgtaggagacgagctcttgcgaggctttgatgtagcccgagttgaaacgcgagatgaactgttccacggccagcgccttgtcgcggcccatgaggtagaagggctgttcgatgtggttctggtcgggcgtgtggtagaagagcacgcggatgagcgtgctgctctgcacgctctgtcggatgaggcaggcgatgcgcacggccgccgcctggttggtgttgccctccacggcgatacgcagttcgtccaggtaagggtgcaggctcagcaccgagatgatcatgtgcgccgcgcactcggcgatggctacctcagaactctcggagaggtcgcgcaaaaagaaatgctctaggccgtaaatgagaaactggtgtcggtaggcgcctacggccgccacgcccgtgcccgaggccttgcggttggtggtgaaggccgggtccagatacacgtaaagcgtcttgccgaaataatcgtaggcgttggtgttgagcgtgctgtaacgcaaaatatcgaactcttcgcggctctggtccgtgatgagcacggtgttctgcgagattttattggtaccgccgatgatctcgtccatgaaagcgcccggcataaacatgttggccgtcttgcgcacctgcgagttgaggctgatgaaggtgggcttgtgcagtcggtagcaaggacacgccgtggcgtcgcccttctccgtgaagctgtgcaggtgctcttcgcacacgtaagagaccacgttgagcatgtcaaagggcgcattgttgaggcgcgtcaagaaacacgtggcgtcactggtagtgttggtggacgatatgaagatgatcttggtggtattctgggccaggaaccccagaatggtgttgaaggcctctttcttgatgaagtgcgcctcgtccaccagcagcaagtggaagttttgtcctcggatgctctgtgtagagaggagacagaaaagggactcttataattacgcacgctcggctggaagcctacagagtcggggtggggccggacaggtgagccaggtgagccgccaggtgaggcgggatcaccgtgtgccaaccgggctgcgacctgaaaaccggaaccaatccgccgacaccggcgccgcgtgacgcgcgcccataaaaacgaaagtgtcgtcgtcgcgacccgccacagccgccatgaactcgttgctggcggaactcaaccgactgggggtcgcgcacgccactacggaggatgtttttatctttgtcgaccgcctctttcaacacttttccttccttttccaggccgaggagtcaggcccgcgccgcttggaactggtcgcgtccgtgttcgagcacctgacggtggagtgcgtcaacgacatcctggacgcctgcagccatccggacgtgaacgtcgcggagacaagcaacacctgtcgtccctgcccttctcctgccccctccgcccccaaaactgtcagcgacgctcagacgtcatgtgcgacgcctcgggcgcctgtgacatgaggcacgtccagaacgcgtttaccgaggagatccagttacattcgctctacgcgtgcacgcgctgctttcgcacgcacctgtgtgatctgggcagcggctgcgcgctcgtctccacgctcgagggctccgtctgcgtcaagacgggcctggtatacgaggctctctatccggtggcgcgtagccacctgttggaacccatggaggaggcctcactggacgacgtcaacatcatcagcgccgtgctcagcggcgtgtacagctacctcatgacgcacgcaggccgttacgccgacgtgatccaagaggtggtcgagcgcgaccgcctcaaaaagcaggtggaggacagtatttacttcacctttaataaggttttccgttctatgcataacgtcaaccgtatttcggtgcccgtcatcagccaactttttattcagcttatcatcggtatctactcaaagcagaccaagtacgacgcgtgtgtcatcaaggttagtcgtaagaagcgcgaggacgcgcttctgaaacagatgcgttccgaatatggaaacgcacctgtattcggatctggcgtttgaagcgcggttcgctgacgatgagcaattgcctctacatctggtgctcgaccaggaggtgctgagtaacgaggaggccgagacgctgcgctacgtctactatcgtaatgtagacagcgctggccgatccgcgggccgcgctccgggcggagatgaggacgacgcaccggcctccgacgacgccgaggacgccgtgggcggcgatcgcgcttttgatcgcgagcggcggacttggcagcgggcctgttttcgtgtattaccgcgcccactggagttgcttgattacctacgtcaaagcggtctcactgtgacgttagagaaagagcagcgcgtgcgcatgttctatgccgtcttcactacgttgggtctgcgctgccccgataatcggctctcaggcgcgcagacgctacacctgagactggtctggcccgacggcagctatcgtgactgggagtttttagcgcgtgacctgttacgagaagaaatggaagcgaataagcgcgaccggcagcaccagttggccacgaccacgaatcaccgtcggcggggcggactgcgtaataacttagacaatgggtcggatcgccgtttgcccgaagcggctgtggcttctctggagacggccgtcagtactccattttttgaaattccgaacggagcaggaacctcctccgcgaacggcggcggcagattcagtaacctggagcagcgggtagcgcgtttgttgcgcggcgacgaggaattcatctatcacgcgggtccattggagccgccttccaagatacgcggtcatgagttggtgcagctgcgcctggacgtaaatccagacctcatgtacgccaccgatccgcacgaccgcgacgaggtcgcgcgtacggacgagtggaagggtgccggtgtctcgcgtctccgcgaggtctgggatgtgcagcatcgcgtgcgcctccgtgtgctgtggtacgtcaattccttttggcgcagtcgcgagctgagctacgatgaccacgaagtcgaactataccgggcgttggacgcttatcgggcgcgcatcgccgtcgagtacgtgctgattcgcgccgtgcgcgacgagatctacgctgtactacgacgggacagcggcgcgttgccacagcgtttcgcctgctacgtgccacggaacatgtcctggcgcgttgtttgggaactttgccgtcatgccttggcgctctggatggatcgggcggacgtgcgtagctgtattattaaggcgctaacgcctcgtctgagccggggtgccgccgctgccgctcagcgagctcgtcgccagcgcgagcgctcggcgcccaaaccgcaggagctgcttttcggaccgcggaacgagagcggtccgcccgccgaacggacttggtacgctgacgtggtgcgctgcgttcgcgcgcaagtggatttgggcgtggaagtgcgcgcggcgcgttgtcctcgcaccgggctttggatcgtccgtgatcgtcgcggacgcttgcgacgttggctctcgcaggccgaggtgtgcgtgctctacgtcacgccagacttggacttttactgggtgctgccgggcggctttgccgtctcttcgcgcgtcactcttcatggcttggcgcagcgggctttgcgagaccgattccagaactttgaagcagttcttgcaagaggaatgcatgtggaagctggtcggcaagagccggaaacaccgcgagtatcgggccgtcgcttgccgttcgacgatctttagtccggaggacgacggctcgtgtatcttgtgccaattgctgttgctctaccgcgacggcgaatggatcctctgtctttgctgcaacggccgttatcaaggccactatggcgtgggccacgtacatcggcgtcgtcgacgcatctgtcatttacctaccttgtaccaactgagcttcggaggtcctttgggtccagccagcattgatttcttgccaagctttagccaggtgaccagcagtatgacgtgcgatggtattacgcccgacgtgatttacgaggtctgcatgttggtgccccaggatgaagccaagcgcatcctggtcaagggtcacggtgccatggacctgacctgtcagaaggcagtgacgctaggcggcgccggcgcctggttgctgccgcgtcccgaaggctacacgcttttcttttacattctgtgctacgacctgtttacctcatgcggcaatcggtgcgatatcccttccatgacgcggctcatggcggcggccacggcctgcgggcaggcgggttgcagcttttgcacggatcacgagggacatgtagatcccactggcaattacgtgggttgcacccccgatatgggccgctgtctttgttacgtgccctgtgggcccatgacgcagtcgctcatccacaacgatgaacccgcgacttttttctgtgagagcgatgacgccaagtacctatgcgccgtaggttctaagaccgcggcgcaggtcacactgggagacggcctggattatcacatcggtgtcaaggattctgagggccgatggctgcccgtcaagaccgatgtgtgggacctggtcaaggtagaggaacctgtgtcacgtatgatagtgtgttcctgtccggtgcttaagaacctagtgcactaacggggtctgacagttcacggggagaagaaacaagaaataacaaaaaaaaaaagaggacatggactcgccacggtttgtggcaaggcgtatgttatcatcatggagctactcacgttggtgttgtagcaactggcaaaaagcgccgtgctcttggcgccgcggtggtcgatgctgatcacgttgtccttgttctcgaccacgtagtcgcgcgcgaaggtgtggcggcagcggaactcgacctctttgagcacaaactgcgacacgtgcttttggtgcgccacgtagccgatgctgatgccgatcatgtgcttaagcagaaacgagataatggggatgatgaaccaagtcttgccgtgacgtcgcggcaccaggaacacggtggctttctgcttaaagatgtcgatggaggtctgcgagaggaagtcgatctggaaggcgtggatgaggtactgcagcacgcgattggccagcacggggatcttggtcacggctataaaaaagatgacgtgtatcaataaattcttttgaaacggttcgagtcggatggcttttgcgtcgccctcgacggcggtactgaagccgccgtcgagccactttttaaagtcggtcatgaagttgttgatctgctgaaactgcggatcgcggtagagctcggtcaacgcgtccagcttctggtaggaggcgcgctgctcctcggagcacgggcgaaacgtcagttcatcgagcgcgctcttgaggcgctcgtgaaacagcagctcgcgctggctttcctcgggcgagttgtagtcgcggtggcggccgcagaaggccatgagcggcaggaaggcctcgttgcacgagtgggccagcccgagttcggggtgcatcatctggtagcgcttgcggcacagcgccgccacattggtgaaggccgtggagatgcaggaggtggggtggctcttgcgcttctgcagctccgcgtagcgctcctggatcttggcggccgaatctccgcgcaacatgatggcggcggcggtggtgcgagcggaggttaggcggcagcggcgagaggagaggaaaaagatggcgtccgcgaggacgacggaggatccacccgaaaaccacgttgtcgcggacgtggcttgtgggacgggcgccgtcactcgttcgtcttcgtcgtccttagtggtgtcgtcctcctcggcgtcaggctcagacgaatcttcatccgcctctcctctcagtttccccgtctcctccccctcaactgccgtcaggtctccggggtccgccggggtttcaacgtccctgtgctcggtggaacggatggtcgagctgtcggcgcagtctccggccgccgatttctcggtctccgaggcttggcgcttcgaggaggccgtaaatatggcgctggtggcctgcgaggccgtgtcaccttacgatcgctttcgcctaattgaaacgcccgacgagaatttcttgttggtcactaacgtaattccgcgcgagtcggccgaggtgccggtgttggatagcagtagcagcggtggcgatagcgggccggaggacaaaaagaaaaacgtcgggaataaaaccgcgggggaaaagaacggcggtgggtctcgggccaaacgccgtcgtagacgacgcgctccgaaaaacgacgccgccacgccgtcttttctacgtcgacacgacgtgctggagcgtttcgcggccgcggctgagcctttgccgtcgctttgtgtgcgtgattatgtgttacgcaatgctgaccgtgttacctacgacggcgaattaatctacggcagttacctgttgtatcgcaaggctcacgtggagctgtcactctccagcaacaaggtgcaacacgtggaagccgtgctgcgacaggtgtacacgccgggcttgttagatcatcacaacgtgtgcgacgtggaggccctgctgtggctgctgtactgtggaccgcgaagcttttgcgcgcgtgacacctgtttcggtcgcgaaaagaacggctgtcctttccccgcgttgttgcccaaactcttttacgaacccgtgcgggactatatgacctacatgaatctggctgagctgtacgtctttgtttggtatcgcggctacgaattccctgcgccgacgccgcaggcgacgacggcgggtggtggtggtagtggtggcggcggcggggccggcgcttgtgcggtcgagacgagcgcgtcagcaggccgggtcgatgacgccggcgacgaggtgcatttgcctttaaagcccgtctcgctggaccgtctcagagaggtattgcaggcggtgcgcggccgcttctcggggcgcgaggtgcccgcctggccggcctcgtcgcgcacctgtttgttgtgcgcgctctacagtcagaaccgtctctgtttagatctcgcgcgtgacgaggcgcggaccgtgagttatagccccatcgttatccaagactgcgccgcggctgtcaccgacgtcactttgagccacatcttgcccggccagagcaccgtctcgcttttccccgtctaccacgtcggcaagttgctggacgctctctcgctgaacgacgcgggtctcatcacgttgaatctatgacgtcggtcaacaaacagctcttaaaggacgtgatgcgcgtcgaccttgagcgacagcagcatcagtttctgcggcgtacctacggaccgcagcaccggctcaccacgcagcaggctttgacggtgatgcgtgtggccgctcgggaacagacccgatacagtcagcgaacgacgcagtgcgtggccgcacacctgttggagcaacgggcggccgtgcagcaagagttgcaacgcgcccgacagctgcaatccggtaacgtggacgacgcgctggactctttaaccgagctgaaggacacggtagacgacgtgagagccaccttggtggactcggtttcggcgacgtgcgatttggacctggaggtcgacgacgccgtctaacaggtatagcaatccccgtcacgcctctgttcatattttattaaaaaaaaacacaacataacgacagtgtcggtgtggtagctagtgcagccctaggaacagggaagactgtcgccactatgtcctccgcacttcggtctcgggctcgctcggcctcgctcggaacgacgactcagggctgggatccgccgccattgcgtcgtcccagcagggcgcgtcggcgccagtggatgcgcgaagctgcgcaggccgccgctcaagccgcggtgcaggccgcgcaggccgccgccgctcaggttgcccaggctcacgtcgatgaagacgaggtcgtagatctcatggccgacgaggctggcggcggcgtcaccactttgaccaccctgagttccgtcagcacaaccaccgtgcttggacacgcgactttttccgcatgcgttcgaagtgacgtgatgcgtgacggagaaaaagaggacgcggcttcggacaaggagaacctgcgtcggcccgtggtgccgtccacgtcgtctcgcggcagcgccgccagcggcgacggttaccacggcttgcgctgccgcgaaacctcggccatgtggtcgttcgagtacgatcgcgacggcgacgtgaccagcgtacgccgcgctctcttcaccggcggcagcgacccctcggacagcgtgagcggcgtccgcggtggacgcaaacgcccgttgcgtccgccgttggtgtcgctggcccgcaccccgctgtgccgacgtcgtgtgggcggcgtggacgcggtgctcgaagaaaacgacgtggagctgcgcgcggaaagtcaggacagcgccgtggcatcgggcccgggccgcgttccgcagccgctcagcggtagttccggggaggaatccgccacggcggtggaggccgactccacgtcacacgacgacgtgcattgcacctgttccaacgaccagatcatcaccacgtccatccgcggccttacgtgcgacccgcgtatgttcttgcgccttacgcatcccgagctctgcgagctctctatctcctacctgctggtctacgtgcccaaagaggacgatttttgccacaagatctgttatgccgtggacatgagcgacgagagctaccgcctgggccagggctccttcggcgaggtctggccgctcgatcgctatcgcgtggtcaaggtggcgcgtaagcacagcgagacggtgctcacggtctggatgtcgggcctgatccgcacgcgcgccgctggcgagcaacagcagccgccgtcgctggtgggcacgggcgtgcaccgcggtctgctcacggccacgggctgctgtctgctgcacaacgtcacggtacatcgacgtttccacacagacatgtttcatcacgaccagtggaagctggcgtgcatcgacagctaccgacgtgccttttgcacgttggccgacgctattaaatttctcaatcaccagtgtcgtgtatgccactttgacattacacccatgaacgtgctcatcgacgtgaacccgcacaaccccagcgagatcgtgcgcgccgcgctgtgcgattacagcctcagcgagccctatccggattacaacgagcgctgtgtggccgtctttcaggagacgggcacggcgcgccgcatccccaactgctcgcaccgtctgcgcgaatgttaccaccctgctttccgacccatgccgctgcagaagctgctcatctgcgacccgcacgcgcgtttccccgtagccggcctacggcgttattgcatgtcggagctgtcggcgctgggtaacgtgctgggcttttgcctcatgcggctgttggaccggcgcggtctggacgaggtgcgcatgggcacggaggcgttgctctttaagcacgccggcgcggcctgccgcgcgttggagaacggcaagctcacgcactgctccgacgcctatctgctcattctggcggcgcaaatgagctacggcgcctgtctcctgggcgagcatggcgccgcgctggtgtcgcacacgctgcgctttgtggaggccaagatgtcctcgtgtcgcgtacgcgcctttcgccgcttctaccacgaatgctcgcagaccatgctgcacgaatacgtcagaaagaacgtggagcgtctgttggccacgagcgacgggctgtatttatataacgcctttcggtgcaccaccagcataatctgcgaggaggaccttgacggtgactgccgccaactgttccccgagtaaccgggacgcggaacgtgacggttgctgaggggaaaggcaacagagaaggtacaaacccaccggcggggaaaataccgaggcgccgccatcatcatgtggggcgtctcgagtttggactacgacgacgatgaggagctcacccggctgctggcggtttgggacgatgagcccctcagtctctttctcatgaacacctttttgctgcaccaggagggcttccgtaatctgccctttacggtgctgcgtttgtcttacgcctaccgcatcttcgccaagatgctgcgggcccacggtacgccagtagccgaggactttatgacgcgcgtggccgcgctggctcgcgacgagggtctgcgcgacattttgggtcagcggcacgccgccgaagcctcgcgcgccgagatcgccgaggccctggagcgcgtggccgagcggtgcgacgaccggcacggcggctcggacgactacgtgtggcttagccggttgctggatttggcgcccaactatcggcaggtcgagctcttccagttgctggaaaaggaatcgcgcggacagtcgcgcaactcggtgtggcatctgttgcgtatggacacggtctcggccaccaagttctacgaggccttcgtcagcggctgtctgcccggcgccgcggcggcggacggttcgggtggcggcggctcgcactacacgggctcgcgcgccggcgtctcgccgggcatccagttcggtatcaaacacgagggcttagtcaaaacgctggtggaatgttacgtgatgcacggacgcgagccggtgcgcgacggcctcggtctgctcatcgaccccacgtcggggctgctgggcgcttccatggacctgtgcttcggcgtgctcaagcagggcagcggtcgcaccttgctggtggaaccgtgcgcgcgcgtctacgagatcaagtgccgctacaaatatttgcgcaaaaaggaggacccctttgtgcagaacgtgctgcggaggcacgacgcggcggccgtggcctcgctgttgcagtcacacccggtgccgggcgtggagtttcgcggtgaacgcgagaccccgtcggcacgcgagtttctgctttcgcacgacgcggcgctcttcagggccacgctcaagcgcgcgcgcccgctcaagccgcccgaaccgctgcgcgagtacctggccgatctgctgtatctcaataaggccgagtgttcggaagtgattgtgtttgacgccaagcacctgaatgacgacaacagcgacggggacgccacgaccactattaacgcgagtctcgacctagccgcgggcgacgccgctggcggcggcgctgatcaccacctgcggggcagcccgggcgattcgccgccgccgatacctttcgaggacgaaaacacgcccgagctgctgggccggctcaacgtgtacgaggtagcgcgcttttcactgccggcttttgtcaatccgcgtcaccagtattactttcagatgctcattcagcagtacgtgctcagccaatactatataaagaagcatccggacccggagcggatcgatttccgtgacctgcctaccgtctacctggtctcggccatcttccgcgagcgcgaggaaagcgaactgggctgcgagttgctggccggcggtcgcgttttccactgcgaccacattccgctcctgctcatcgtcacgcccgtggtctttgaccctcagtttacgcgccatgccgtctctaccgtgctagaccgttggagtcgcgacctgtcccgcaagacgaacctaccgatatgggtgccgaactctgcaaacgaatatgttgtgagttcggtaccacgcccggtgagcccctgaaagatgctctgggtcgccaggtgtctctacgctcctacgacaacatccctccgacttcctcctcggacgaaggggaggacgatgacgacggggaggatgacgataacgaggagcggcaacagaagctgcggctctgcggtagtggctgcgggggaaacgacagtagtagcggcagccaccgcgaggccgcccacgacagctccaagaaaaacgcggtgcgctcgacgtttcgcgaggacaaggctccgaaaccgagcaagcggtcaaaaaagaaaaagaaaccctcaaaacatcaccaccatcagcaaagctccattatgcaggagacggacgacctagacgaagaggacacctcaatttacctgtccccgcccccggtcccccccgtccaggtggtggctaagcgactgccgcggcccgacacacccaggactccgcgccaaaagaagatttcacaacgtccacccacccccgggacaaaaaagcccgccgcctccttgcccttttaactcataaactttcaggtctcgcgtacgattcgcgagtcgggaatgggacacccgtgggtgtttctccgtgtgtatattatttttttttgtgtgtgtgtgtgtttgcgcccccgtgtgtctaatgtgctgtttgaaacacgtaaagtagctggtggaagaacagataaacctttaataaaaaaaaagtatgtgctcccgacccacggtctgcgtgtctcttttttatgtccatgtctccaagtctggtgcgggtggcggcggggtcaagcgtcctcgaagtcttcatcatcgtcgtcgtcctcttgttcgcggaggcgacggctttccaagctgtcgtggtgactgagcgcagcgacttcttcgccggaggctgtggccagcgcctggtacttgacactgccgctaccgcgtccgcgaaagtagcggacggcgcgacacgtcgtaaacatggcccatatgaaaaagagcatgccgaacgaccagctgatgccggtgcggtattcgttgctgaggaaggtatcgtactgcacgatggggtagatgaggccgcagagtccaaagaaggcgcccaggtggtagccgaattgcaccttgacgtattgaaaaaagacggcctcgatcagtaaaaagtagatgatggagatgatagcgtagaccacgaagacggctaacaccatgtggcctgtacgcacgaaaaagttgtttccgaagccgtagcacagggccatggctaccacggtggtgttgaaaccaagcgctacctccaccaggttgacgatgagcgtgcggaactgcaccgtacctttgagcttggggtgcagacgcgagaagaaaaagagtgagcgtttgtagctgcggtactgcgtgaccatgctcacgttgaaaatggtcaggcagaaaaagtgcacggcggccatgaaggcgatcatgctgggcagccgaaatgacatggtcagtgtgaatagttggaacgtgtccatgctgagaatgaagaggaaggctgtgaggctgtcgcccatgtacgaaatgtcgcgtgtcgactggtttaggctcatgcctttgtccttgcgcatgctgatcttgatccagcataccaggtagtagatggtcacggctaaaaagacgagctgcatgaacacggcgtagcacaccaactgcaccgagtctaagaaaagcataggcgtgtgcaggtgcattacgttgtaggccgacatgttgagcctttcaaagtccacgacgtgatagtagacgcaggggtagcccaggtgcggaaaattgctcagcactagatgcacgctgacgttgacaaaagtgagcaccatgaaaacgatagaagcgctccatgtccgtgtattcactttatccacgtgcgagggggccatggcgatagcggcggcccgctcgctcgggaggcgatgggggcgcgccgatgacgacaggctcgcgggtcgttaaatactacgatgggagccgccgcggctcacgacgcggtttgagcacgtccgggcgatcggtgaaaaaagaccccgcgggccttcgcgactctcttctgtccgaggatgaccgctcagccgccgctgcaccaccgccaccacccgtacaccctgttcgggaccagctgtcatctcagctggtacggccttctggaggcctcggtgcctatcgtacaatgtctgtttttggatctgggtggcggccgtgccgagccgcggcttcacacgttcgtggtgcgcggtgaccgtctgccgccggctgaggtgcgtgctgtgcatcgtgccagctacgccgcgctggcctcggccgtgactacggacgccgacgagcgccggcgcggcctagagcagcgtagcgccgtgttggcgcgcgtgttgctagaaggcagcgcgttaatccgcgtgttggcgcgcaccttcacgccggtgcagattcagacggacgctagcggcgtggagattttggaggccgcaccggcactgggcgtggaaaccgcagcgctatcgaacgcgcttagtcttttccacgtagccaagctagtggtcatcggctcgtatcccgaagtgcacgagccgcgtgtggtcacgcatgccgcggaacgcgtctccgaagagtatggcacccacgcgcacaaaaaattgcgtcgcggttactacgcctacgatttggccatgtcgtttcgcgtcggcactcacaagtatgtgctggagcgcgacgacgaggccgtcctggcacgcctctttgaggtgcgcgaggtgtgttttttgcgcacctgtctgcgtctggtcacgcctgtcggtttcgtggccgtggcagtgaccgacgagcagtgttgtttattgctgcagtcggcctggactcacctttacgacgtgcttttccgtggtttcgctgggcagccgccgttacgcgactacctggggccggacctttttgagacgggcggcgcccgttctttcttttttcccggtttcccacccgtgcccgtctacgcggtccacggtctgcacacgttaatgcgcgagacggcgttggacgcggcggctgaggtgctctcgtggtgcggcctgcccgacatcgtgggctcggccggcaagctggaggtggaaccctgcgcgctctcgctcggcgtgcccgaggatgagtggcaggtcttcggcaccgaggccggcggcggcgccgtgcgtctcaatgccacggcttttcgcgagcgaccggccggcggcgatcgtcgctggctgttgccgccgctgccgcgtgacgacggcgacggtgaaaacaacgtcgtggaagtcagcagcagcaccggcggtgcgcacccgccgagcgacgacgctactttcaccgtgcacgttcgcgacgccacgctacatcgagtgctcatcgtggatttggtcgagcgcgtgctggccaagtgtgtacgcgcgcgcgacttcaatccctacgtgcgttatagtcatcgactccacacttatgcggtttgtgaaaagtttattgaaaatctgcgttttcgctcgcgacgcgccttctggcagatccagagtctgctgggctacatctccgagcacgttacgtcagcctgcgcttcggccggccttttgtgggttctgtcgcgtggacaccgcgagttttatgtctacgacggctattcgggtcacggacccgtctcggccgaagtgtgcgtgcggactgtggtcgactgttattggcgcaaactttttggcggcgacgatccgggtcccacctgtcgtgttcaagagagcgcgcccggcgtgctgttggtttggggcgacgagcggttggtgggtcccttcaacttcttctacggcaacggcggcgccggtggtagtccgctccacggggtggtgggtggtttcgcggcgggacattgtggcggcgcttgttgcgcgggctgcgtcgtcactcaccgccattctagcggtggcggcggcggtggtggtggcgtgggcgacacggaccacgcgagtggcggcggtctagatgccgctgccgggagtggtcataacggcggtagtgatcgggtttctccctccacgccgcccgcggcgttaggtggctgttgctgcgcggccggtggcgactggctctcggccgtgggtcatgttctgggccggctgccggcgctgttacgggagcgcgtgagcgtgtccgagctggaagccgtgtaccgcgagatcctctttcgcttcgtggctcgccgcaacgacgtggacttttggttactgcgcttccagcccggtgaaaacgaagtaaggccgcacgccggggtgattgactgcgcgcccttccacggcgtgtgggccgagcagggccagatcatcgtacagtcacgcgatacggcgttagcggccgatatcggctacggcgtctatgtggacaaggcctttgccatgctcacggcttgcgtggaggtctgggcgcgagagttattgtcgtcctccaccgcttccaccaccgcttgttcttcttcttccgttctctcttccgccttgccgtccgtcacttcgtcctcttcgggcacggcgacggtgtctcctccgtcttgttcttcttcgtcggcgacttggctcgaggagcgcgacgagtgggtgcgttcgctggcggttgacgcgcaacacgctgctaagcgggtggcttccgagggcctgcggtttttccggctcaacgcttaacgagtcacgtaggggaactacgtgggtaagtgacgtggatactagtaaaaaaagtgcgtcaaagttctcagcgtgtgacgtggatactagtaaaagggacgtcaaagctcactacgtgttgcgtgttttttttttttctatgatatgcgtgtctagttcgcttctcactcttcctctccccgttcccagcgcggtggcagcttggggggtgagggcaaattggggtagttggcgttgagcacgtctagcaggcccaggcccacgggccaaccgtccacggtcttacgctcggtcagcttgaggctaaacgagtgtgcctcgtcttgaccggtaaggcggaaaaagaagcgtgctaccagctgcaggcaggtatgccgcgtctgctggaagagcacgaaggtagcgggcacgtactgcacaatgtgcggttctttttcctcaaagagtaggtagagcgcgctgcagatcagccgccgggcgctgtggtgcagcagccggccgaagctttcgcgcacgttcactgcgtccaggtactggagcaggtcgtgcaggcacttgcgcgttaagttgcaattttccacgcatgaaataacggtacagagcgcgaagtgcagcaggttgtcggccttgacgatgccgcagcggtgtttgagccgcagatccgagagcctcacctgcgtgacgacgtcttcggtctcgagcaaaaacacggcggagtagcccagaaaggccgaggtgcacagcaactcgctgcggtactcggccatggaaaccagcagcccgtgctccgtgtgcagccacagcttgtcgccgcgcaccgtaaagtcgagcacttgcggctccatgatcatcacattctgtctagtgaaatccgtatggacctccagcacgccgcggatcatcagggcctccatttcgaaatcggccgacacgctctgggccgcgccgctcctcgtctgccgtgatcaagcggcgcggcgcggacctttcaagcgttcctgggccgccgctcgaggcagttcccctttctggcactccgcccgccgcttcgcggctcatttggcgccggcgcgccttctcgcggctgcaaatcagctccacgtatcggcaaaacttgctgtcgtcgtaggcggcggccacgatctcgccgaaggagagctgcaggtaggcttcgggtacggggtccagcgtgcctagcgccaggatgtgacacagatagggcagggtcacgcgctctaccgtgtaattggagtagacgatggcctcttcggccccttgatgcgtgaccagacgccgtaggcgaaaggtgcggaaatactcgttttcccacaactgcgtgaggaagcgttctagcgactcggtgccaggcacgaactgcgagaagaagctgttggccaccaggcggttgtcttccaccgccagcggacggaagggcgccgcgtcgcgcgccttgcgcacggcctccaacacgggcaggtggtagagttcggcgtcgcgcgcgcccaggctcatggagtcctcgcgccgcgaggcgtagcgcgtgagcaggtcgcgcagctcgcgcacgcgattctcccaggtctggttgagcgtgcgcaggtcctggatctcgtccacctgcgactggatctgctcctccaggcacttgatgacctgcttcttaaacaggtcgcggatgtcccgctcgggcgccgccgggccgggtggcggcggcagcagcccgacgtggcccgcgggtcctcccaccacggcgccgccgggtcccaccacgccgggtccacccggaccacgcgcgggtagtagacggttttggtccaccagcgagggggtcaggtcctgcagaaaggactcgacgctgtcctcgatgccgatgcgcgatttgctgtccgagacgttaagcaaaaacttcataatggactttttggcgtcgctgccccggtcgtgctgctccatcatctccaccagcttcttgcagttgagctcgtggcggctggcggtcaccactttcacaggaaaggtattgagcagctggcagatcttttggtggcggcagagcccgtcgtagcgcagaatctcctcgtgcaggtgtgccaccggcgtggtgaacagcagcttgtcgcgctcataagccagcggttcggccgccacgtacaagcggatgtgcttgccgcgcagctgcgcctccagccgctccgagcgcaccttcttgaagacgcgtacctcgggcgcgttggctacgcgcacggcgcccaggcgctcggccacctgcagcagcagcgccaggttagcctgcagcaggtcctgcgccagcgggtgtgtctcggtggcccgctgcacggccgcgcgtacaaattgcgcccgctcggccgcctcgctcggcttggttttcacgtccagcagcggtaccagtcccaccgttacgcaccaatccacgtagagaccatagtcgtcgttatcggcgtactgatataaaatgtcgcggagcgcgcccagcacgcccgtttgcacgctctggcgcaacgaggcgctccacaccaacagatactgctccaggtcctcttcgtccagcgcgcggtagggaaacagcgccgcgtgtaacttccactcctcggccacgcgccgcaccgtgatggtgtcaaagagcgtcttgcacactccgtagagcagctgcttgcgcagcacgcacgggtcgcgcagcacctggtgcatgctctggccgcgacacgtccccagaaagccgtgcagcaaccgcaggaagctcatcgtctggcccgtggggaaaatgtcgatgacggcctcgtcatccacgccgcggcccacgcccaagtacgacgacgccttgatcctcaacctctcgtcggctgccaagatcgaacggatcgtcgacaaggtcaagtctctctcgcgcgagcgctttgcgcccgaggatttttcgttccagtggtttcgctccatcagtcgcgttgaacgaacgacagataacaacccctctgccgcaactaccgccgcggcaacgacgaccgttcactcctccgcctcctcttctgccgccgctgccgcttcgtccgaggccggcggcacgcgcgtaccctgcgtcgaccgttggcccttctttcccttccgcgcgctgctcgtcaccggcacggcgggcgccggcaagacttccagcatccaggtgctggcggccaatctagattgcgtgatcaccggtaccacggtgatcgccgcgcagaacctcagcgcgatcctcaaccgcactcgctcggcgcaggtcaagaccatctaccgcgtcttcggtttcgtcagcaagcacgtgccgctggctgatagcgccgttagccacgagacgctggaacgctaccgcgtgtgcgagccgcacgaggagaccaccatccagcgcctgcagatcaacgatctgctcgcctactggccggtcatcgccgacatcgtggacaaatgcttaaatatgtgggagcgcaaggccgcttcggcctccgccgcggccgcggccgccgcctgcgaggacctctcggagctgtgcgagagcaatatcatcgtcatcgacgagtgcggccttatgctgcgctacatgctgcaggtggtggtgtttttttactacttttacaacgccctgggcgacacgcgactttaccgcgaacgccgcgtgccctgcatcatctgcgtcggttcgcccacgcagaccgaggcgctggagagccgctacgaccactacacgcaaaacaagagcgtgcgcaagggcgttgacgtgctctcggcgctgattcagaacgaggtgctcatcaactactgcgacatcgccgacaactgggtcatgtttattcacaacaagcgttgcaccgacctggactttggcgacctgctcaagtacatggagttcggtatcccgctcaaggaggagcacgtggcctacgtggaccgcttcgtgcggccgcccagctccatccgcaacccctcgtacgccgccgagatgacgcggctttttctctcgcacgtcgaggtgcaggcttacttcaagcggctgcacgagcagatccgcctgagcgagcgccaccgtctcttcgatctgcccgtctactgcgtggtcaacaaccgcgcgtaccaggagctctgcgagctggccgacccgctgggcgactcgccgcagcccgtcgagctctggttccgccagaacttggcgcgcatcattaactactcgcagtttgtcgaccacaacctctccagcgagatcaccaaggaggcgctgcgccccgcggccgacgtcgttgccaccaacaactcctccgtccaggctcacggagggggaggatctgtcatcgggagcaccggcggcaacgacgagacggcgtttttccaggacgatgataccaccaccgcgcccgatagccgtgagacgctgctcaccttgcgcattacctacatcaagggcagttcggtgggagtcaactctaaggtgcgggcctgtgttatcggataccagggcacggtcgaacgtttcgtggacatcttgcaaaaggacacgtttatcgaacgcacgccctgcgagcaggcggcctacgcctactcgttagtttcgggcctgctcttctcggccatgtactacttctacgtgtcgccctacacgaccgaggagatgttgcgtgagctggcgcgcgttgagctgcccgacgtgagttcgctctgcgccgctgccgccgccacggccgccgctcccgcttggagcgggggagagaatccgataaataatcacgtcgacgcggattcttctcagggcggccagagcgtgccggtatctcaacggatggaacatggccaagaggaaacccacgacatcccctgcctgtccagccaccatgacgactcggacgccatcacggacgccgaactcatggatcacaccagtctgtacgcggatcccttttttctcaaatacgtcaagccacctagcctggcgctgctttctttcgaggagacggtgcacatgtacactaccttccgcgacatttttctcaagcgctaccagctcatgcagcgtctcacgggcggtcgcttcgccacgttgccgctcgttacctacaatcgccgtaacgtggtgttcaaggccaactgtcagatcagctcgcaaaccggctccttcgtgggcatgctttcgcatgtgtcgccggcgcagacgtacacgctcgagggctacaccagcgacaacgtgctcagtctgcccagtgaccgccaccgcatccaccccgaggtggtgcagcgcggtctttcgcggctggtactacgcgatgcgctcgggttcctctttgtgctcgacgttaacgtctcgcgcttcgtcgagtcggcgcagggcaagagtctgcacgtgtgcaccaccgtggactacggcctcacttcgcgcacggccatgaccatcgccaagagtcagggcctgtcgctcgagaaggtggccgtggactttggggaccatcccaagaacctcaagatgagccacatctacgtggccatgtcgcgagtcacggaccccgagcacctcatgatgaacgttaacccgttgcgactgccctatgagaagaacaccgctatcaccccctatatctgtcgcgcgctcaaagacaaacgcaccacgcttattttttgacacaacaccgtgtaagcaaaacgtgactttattgagcagggtaaaaaccacgtacaagaaccacgttgtctatccccccaaaaaaaaacacaccgtcagggaacacatcgcctatagatagcggcactttacataaaaccaccgtacctgcatcacggtggctcgatacactggaaattcaataaaaaccaccgtgtccacgttacggtacttgccgggtcagcgtccttctcttgagatttctgttcgcaaacttatccgtttccccggtccgcggtgtctcctcgcgaggctgacagtctacgagtggtatctacaagagaaagaaacccgggtgggagcgacgccgtcgctgggtatcaaccccgcggctgaccgtcgtccggtaaaggaacaacccgtcgtcgcaagccgggttcgaccaagagaaaaaaacccgggtgcggggggagacgggtcgtcctttggtcgttcgcggacggcgtacatgccgcgtgggtcagtcgacggcgtcgctccgtgcggtcggtcatcattctgcttcacatatatgggttgtttgtgttttttttataatgaatacgcactcatcctatccgtgactgcgcgtgtggcagagaggatgccttataacatgtattttgaaaaattgccaacagctataatttctctcatgtagcagaatagagaccttttgtcgtctttttgtttgtcattacttgttttccagggaattagagagagggaaccgcgcctccggcggcggtgcccgcggaccccggccccttctcgcgtgcgcggtgtgactggttgagcgaatgagcagctaggcttggtggtgctccgcgtgcgggggagaagacgattaacaacaaaaaataagtggaagtggccggtgggtctttgtccgcgtgcgcgcccatccgtcgccgggaccgagcagaaagtgatgtggtggtacattgattttttccttgacaggaaagaaaaaaaagagttttgttttcctatgtgagaggagaaaggtatgtgaggagatgttcgatgatcgtatgttacagttatgctgtaaggaagcttttatcgtgcgtcctgtttttcatttgatgtatatgacacaattgaaacctatcgataggcgtatatcgaggattcatcaattcttagaatcgtcgtctttttggctaattggactttgcccatgttggttgtcattcgtggcctgaggtcatcgtcgtccacgacgacgtgtctatagcgtgcggtgtgatcattgtgtcgagccagagaaagcgcgcctcgcacgacgtttgcggatcggctcgcgggtgtgtggaattcctaagaacataatcagctggtcgtctttctttgatgtgttgttgtcgtcgaggtcttgcttcgttttcttttttctttttagtcgatggaacttttcttcggtacgggttcttgttatggaagcttgtgttttcgaacatgaattcgaaaaaataaaaaggcctatcttcgtttcaaaaaaaggacagatatcaatcttcttaacttatatcatggtaaattcagaatcctatggtgtcttattatctctaaagtagtcaacattatggtctaacttgtatttccctgacgagatatatatgatccttataacctggctactatcatgaacaacaatatccttacttacagtcatcttcgtgagttaatgaagtataatatcggtcatctatcaacttatctgctatgtaacgtacccttttaggtattttgcgtttcttaacgagtgtacccgcctgtgtgaggcgaaactctgagaagtctaccgagtcgagttacaagtcactaaaacacttacacgagttatctatactaaaatcactatctatgttgtttgcttacctaattattatcctacatgacgaagctacctcccaacgtaaggtagggggagaggagacagaacaataaaaagtaactaatgtttcttagaacttacccgctaaggacttaccaaactatattcaccaaaaaacaacagctacgtgtttcatttgttttaatctaccgaagtaaaaaaaaaaaagatgattagctatccagaacctacttacttcttaatgttttaactaaggatgcctatgggattggaaaaaaaatcacagcaacttgctactaatcagttgacagcgaagagactcataacaaagatttctgggtaatacggttataataatgcttatggactaaaggatacttggaaaaaaagaacgggctatgactatagagattcgtcgagatattaaacttcaaataggcggctatcattcatggttgtggtgactatatcgtggagaaaaaatgtgatcgttagttagctaggtgagacttacagctatccatccgtctagtttttcgttgtaatgatgatagtacgtctatggtggtgatcgattttggttaacaatttgttcgtttaaaggcttaatgtacttatgctacatgatgtattattctttgattcatcgttcctcctaagggggtgtatgtatgtatgtactagtcgtatagtgttcctaacatcatgattattcagactatggcttcatctatcgtgtctaaagttcacttattctactattactatatatatgcactactatgtaactaggatatggtcctataaggtgtcttctatcacggtggcttgtttatcgcttggcggttacgagcaagagttcatcacggaccagccgtgaggcagggcacacgcgggtcggcggcgatgatgtcccccgcgaaggggacaacaaaaacaagacaagaggccgccggccgcggccacggacgcgtagcggttacacaatgtttggttgagcgttttgtttcatcgtcgtggtggtggttttgttgttctctgtatatatcgtgtggtggctttatcgtcatcattattatcatcattcttgtttccatcatcacgatgagttttctccgttttcctctcctccagtggtagtcgtgtatcatcatcaatcatcgtagtgacgtcgttgctgctgctgctcttgccttcatggcggtatttctcttcctcccccctaaccccatattaactcgtgagtgtgatggttagagtggctgcttgtttttttttcttttctctttggaacaacaaaagaggataaagatggtcggtgaatgtattattattattatcatcattatgatacggtcgcggtcttcttctccgatgacgaaacctgcgcacatcgaagaaaagacgagcgcgcgaaccgatagccgtccgtctgggacgaaggagaagatgatggggagaggaggagagccccagaagccagagcgagaagggagacgacagacatacgtcgtcaccgtcctctggaggaggcacggcggcgctgtttgttgtttggatgcttgattatatcctgttctatggggtagattattatcaataggcttggttttcaaaggtcagcctgtgtattgtcgtgtcttttttttcgttctcatgatcgcggagaccacacagacgtgcgcgtctcccaatggctaggcgttctttttaggtagtaattttttgatcttttttttttcttaacaagtctggcttgatttcttttatctatgatcgattcttctttttctcgggggttgcatcttccgtgaaagtaaagtgacactactctaaatggtaaccatattatctgttgattaggagaaaaaataattttttcgcacgaaatcgatcctaagtgaggtgatttacttgctatcacacgaaatgattatcttttgctgctaacgtactgaattttttaacagaattgcttctccgtaactatttccgcagattcagacagattgtcaaaaaaaaatacggcacagaaatagtgggtctgtggcttttggttcgtgtacattcgcgtttgcgtgtcgagatttctacggtatgtttattcttcctgcgatgatgtagggtccttggtgtaagtaggatttcgagtatctctcttagagcgaacaaaataatcaaaaaacaacagctaggaaatcgagggttactctacgataaagtgtctctacaaagtgaagaatgttacgttgtggtggaataataagactcgcgtgatcgatgagtgatcgagagcggctcgaaccttctttaagagctttgtttagtgcaactttaaattacaaggagtagaaagctgaaatgaatctatgaaggtgctattctttgaatatcttactttgtacgcttcacattcgttatttggatagagagttgtctagagaaaatctgtgattctctatgagtgttatttttattatccttttggggactacgatttttcttcttgttctacataccactactactcgtaatcacatacatggacgaaaaaaaaattcgtcaggcagtagataccagattctccgacgttacggcgtctttttttcttttgagagagtatctgctgagattgtccgtggtgtatctagtcgctatttttgttgttactagtagttttgcacacagtttattcagtataatttttcttcttgccatgatcaattgagcccaccaccttttttttttagagaggaggaatttcgtcttgatctccagccggagacaacggcggcggtggtggtggcgggagagatttcaaggcaatgaaaaaaaaaatttcgttttgccatcaagtggtgacgataacccgtcagattgataattggttcctacagaaactattctaaccgcggaagaaagaaattgaaaaaaaaaattgacaaaaacatcataacataaaggaccacctacctgggacgcgcagttgggcggcggactggggcggcatgctgcggcgatgctgtcggtgatggtctcttcctctctggtcctgatcgtcttttttctaggcgcttccgaggaggcgaagccggcgacgacgacgacgacgataaagaatacaaagccgcggtgtcgtccggaggattacgcgaccagattgcaagatctccgcgtcacctttcatcgagtaaaacctacgttggtaggtcacgtaggtacggtttattgcgacggtctttcttttccgcgtgtcgggtgacgtagttttcctcttgtagcaacgtgaggacgactactccgtgtggctcgacggtacggtggtcaaaggctgttggggatgcagcgtcatggactggttgttgaggcggtatctggagatcgtgttccccgcaggcgaccacgtctatcctggacttaagacggaattgcatagtatgcgctcgacgctagaatccatctacaaagacatgcggcaatgcgtaagtgtctctgtggcggcgctgtccgcgcagaggtaacaacgtgttcatagcacggtgttttacttttgtcgggctcccagcctctgttaggttgcggagataagtccgtgattagtcggctgtctcaggaggcggaaaggaaatcggataacggcacgcggaaaggtctcagcgagttggacacgttgtttagccgtctcgaagagtatctgcactcgagaaagtagcgttgcgatttgcagtccgctccggtgtcgttcacccagttactttaataaacgtactgtttaaccacgttgcgtcgtgacgttgtttgtgggtgttgctaggcgggctggaaagatgatgtataaatagagtctgcgacggggttcggcgctctgccggctgcggcggcactcgctccacggcctccgacgagcgttgcgctcgcgctttgcgccgccgcgtcatggatctgcctactaccgtcgtgcgaaaatactggacttttacgaatcctaaccgcatcctgcatcagagcgtcaatcagactttcgacgtgcgccagttcgtctttgacaacgcccgtctggtcaactgcgtggacggcgatggcaaggtgctgcaccttaacaagggctggctctgcgctaccattatgcagcacggcgaggcttcggccggcgccaagacgcagcagggcttcatgtccattgacattacgggcgacggggaacttcaggagcacctctttgtacgcggcggtatcgtctttaacaaatccgtctcctcggtggtgggctccagcggacccaatgagagcgcgctgctcactatgatttccgagaacggtaatttgcaagtgacttacgtgcggcattacctgaaaaaccacggcgaatcctccagcggaggcggtggttgcggtgccgcgtctaccgcctccgccgtctgcgtgtcctcgctgggtggcagcggcgggactcgcgacggcccttctgcggaggaacagcaacggcgaaggcaggaacagcgtcacgaagaacggcgcaaaaaatcgtcctcgtctgccggtggtggtggaggcggcggcactggtggtggcggtggcggcggcgggagcggcggtcagcactcctcggactccgccaacggactgctgcgggatccccggttgatgaaccggcagaaggagcggcggccgcctccctcctccgagaacgacggtgagtcccggccctcctcgcgtcacggtgctttccgagtggactcgtgagccccccgtagcgcacgagcgagcaggcgagcggtgttggtgcgctggtggttgtgtggatgataaccatgtgctttttcgtgcgctatgtgtcgtcccgtctgtaggctctcctcccctccgggaggcgaagagacaaaagaccaccgcacagcacgaaggccatggcggcggcggcaagaacgagacggagcagcagtccggtggtgctggcggtggtggtggcggcggcagcggccgcatgtcgctgccgctggacacgtctgaagcggtggcctttctcaattactcgtcctcatcctccgcggtctcttcttcctccaacaaccaccaccaccatcatcaccaccataacgccgtgacggacgtggccgccggcaccgacggtgcgttacttctacccattgagcgcggagcggtggtttcgtcgccgtcgtcgacgtcgccgtcgtcacttctttcgctccctcgacccagcagcgcccacagcgcgggcgagacggtgcaggagtccgaggcggcggcgacggcggcggctgcggggttaatgatgatgaggaggatgaggagggctccggctgaggcggcggaggcaccaccgcagtcggaggaggagaatgattccaccactccagtctctaactgccgtgttcctccgaattcgcaggaatccgcggcgcctcagcctcctcgcagtccgcgttttgatgacattatacagtcattgaccaaaatgctcaatgattgtaaggagaaaagattgtgcgatctccccctggtttccagcagactcttgccagagacgtcgggcgggactgtcgtcgtcaaccacagcagcgtcgcgaggaccgccgcagctgtctccacagccggcgttggccccccagcagccgcatgtccgccactcgtcaccaccggtgttgtaccctcaggttccgtcgccggtgtcgcgcccgttgccgccgcagtcgaaacaccagctgctcctccccggcccgtgtgtgaaatcaagccctacgtggtaaaccccgttgtcgccaccgccgcggctgccagtaactcttcctcgtcttcttcggctccactgccgccgccgccaccaccgccgggcggacgtcggggtcgggcccggaacaatacccgaggaggcggcggtggtggcggtggtagaaacagccggcggcaggccgcatcgtcgtcgtcctcctcctctcggagatcgcgacggagaaacaaccgccacgaggacgaggacaacgatcctctgctccggttgtcgcaagtcgccggcagcggccgccggcgagggccctcgttcctcgaggacggactcgaaattatcgatcccagcgaggaggctgcgatcgccgccgcctcgatcgcggcgtttttcgacgattaaaaaaccgagccgagaccggaaaaattatgaaacaggacgcgcttggacatttgggtttccacccctttcggtgtgtgtctatatatattgtggtcactgattttttttttacaataaagagatagacatcacagttcaccatcttgtctccccggtgtgtctattatcatcaatcacccacagagtcgccagtccatggtctctcggtaatgcgtgtccagatacgcgttggccagtataaagtggtcgttgcccacgaaggcgcgggtggtgttgcgcggcgacgggtggcaggacttaagtaccaagtgccgccgtcggtcgatcaggtactcgcaggtgtgcgcgtcggcgccccacagcatgaacaccagatgctcccggcgctctgacagcctccggatcacatggttactcagcgtctgccagcctaagtgacggtgagatccaggctgtccgtgcaccacggtgaacacggtgttgagcagcagcacgccgcgtcgcgcccaggcgtccaggcaacccgaggccggacgctgaaacccgtccaccgtacgcgccagttcgcgaaacacgttgttgagggagggcggcggcggtcggcccgccagcgtgccgaaggccaggccgctggcgctgccgtcgcagtacgggtcctggcccacgatcaccacgcgcacctgctcgggcggacacagatagctccagcggtgtacgtgctcgggtgccgggtacaccatctcgagttgccgcgcgccttccaccgccgccaccgtgtcgcgcagcagcaccgtgtcgtggtcgggcaagctgaggaagcggatccagtcggcgctcagacaaaacacgcgagcctgctcgtcgggggttaacagagagcctttattatcagcaatgttagcgagcatccactgcttgagggccatagcgcgagtgagccggcaggttgacgcgcgtctgcttcagctcgggcggcagtccggcgtagtatttatctaggtggcgtagcagcggcgggtccagctggtgacgcaggcagaattccttcaccgcgttgtacaggccgtaaaagagcgtgatgccctcgggcgcggcagcggtgctcacgggcagacgcacggcgcggttggtacgcgtggcttcgttgcgtatggccaccaccacgttaaagagagacggtggcaccagctcgaagcctaacacgtgttccgtgaagatgctgcgcccgtatgacagtcgcgtgaggtcgtagccgcggcacaggtcgtccacgcacgtgtacacggccggcgagccatcgccgcactcgctgtagccgcgcattaccgtcatccagcgcggcgctgtgtccgagcttaacagcgtcagcagggcccgcaattgatccggattgttgtacagcagggccagagtgtccaggaaagcatcgtccaacagcacggagttggcggcctccggcgtaacgggacggtaacggataagttgcgatagcgggccatcgcgcccggtaacattcaccaacgggcgcagccaactttcatacttgtcaccctgaaacacctcacccaacaggcatcggcgcgttagttcggggcactccgcggggactttctcggcggcggtaggagcgacgctgacggcggctgaggaaacaatggacagcagaaggcaacaccacagcagtatcaccggtccaggtgagaaagagaagccgcaatccgggcggcggcacatcaagtctgcggcacgatgagagtgtgacggtaaggagccagttggcgccgaaagttggcactcaggtcttcgatccctaaaacgttatatattgcatccagcaggtgagccaggctaaacggattcacgtaccaggtttggttacccgcgacgatgacggccagaccgtgggcgctacagttggagaggttcctgggtacgaaggtaactgagtcgatgtcgcgccacggggggaatgagacagacgactggcgcacgctgtaatcacaactgtgattgacgtattgtagcgtgtaatttaggttgcactcagcctcgaagtagagggggaaccacagttcgtcgtactcgtcgtcgtcctccagttctggctcttcttcatccaccgcaatgtctacgctgctttgagattcctcttcgtacaggatgattgacaggttatggctacaaaggtcctgggcgggaggacgcgtgggagcgcgggtggtggtaatgttttccagatcaaaagttggagtgtagtcggatgttacatccccgttgttggaggtggtagaagttgcggccggtgtcgcggtggtaagtatggatacagaaggggagggggaagtagcgttcgtaccgatggttgtggtattattattccctgtgtttcttgttccagaaaccgttgacgttgagatgggaatcgacgtggtgctggacgtcagattgctgaccgaggaaaccgtggtgggagtggtgacggtgttactcgtggttgaagtgacgttaggggaggtagtagtggtaccggtggtggcgacggtagtgtttgtcgtggcggcggcagcggtggtaccggtaacggtggtcgcgttggtttccaccgcttcacacagtaagcaaaagcacagagccaggaaaagcaaccagccccgccatcgccgccgccgcttcatgaggtgggcaggcgaaagctggtgaattcgttgtacagcggcaagtggggcgccgcgatcgaagggtacgtcaacaagctgacgttgatattaaatacgtctggctgcttttctacgatggaagcgcacagggttacggcgtcaaacaggtctttcttggtggcgcccgagacccacatctggtatacacccgtctcgtggtacgaagtagagcgcggcaccaccggacggatgcagtccagaacgcggttgggatcttggtgaaagaatttgaacgtggctacggcctgtggcgtgtgcggcatcgtctgcgtgatgagctgctggcccgctaacacggtgacgttgtgcaacttgagcagggcactcttgagggcctggaaagcgttgccgcacgaggcgctgatctgcagctgcacggccgtggagtcgtgcagccgcatgagacgtgacacctcttcgaagacgtacttatacttactggcaaagagtggcgcgtatcgacagtcggccggcaaaatgtaggtggcgttgccgccgttggtagccacggcgggcgcagcggccgcggaggccggcgtaaacagcgtcagcggccggtggtggctggtaaggtcgatcatgggcggcgtggtgaccgtggcggtggcgggcatgacggggtttgcggcgacgggcactccggccacagcggcggccgcggcggccacggcggcgctggccgagcccacacccgccggcagtcctccgctacccatgacgccgccgggcagagcgtcgcccagacagacttccacagtggcgggcgcgctctcggcggtcagtacggtttgccgatcgacctcgcgacgaaagctggtgaggaactcactatgatccatggccgcagggcccgagatcccgggattctgcgggtgctgaccgagtgcgggccgagttatatggaagacgattagcttggagcggagttttgcgtccctagctgacctgcggatcagcgacgtaccatagggatagactgtgagcggcggccgcaacggcggggtcggccgccgttcgtcgtcacggggcggcgcgagggaggaggaggtggtgggtacgatcttgacgtggttgacgtcctgcccgtccgggggaatacgcaaaaaaacccgtcgcggcgctaccacgatggtgcgatgggtctttctcttgttggccggggccagggacttgcagatgcgtgtggagccgtagacgatctggacgtggtcctgggagaacatgaccatcgccgccaacgctcagcggggggacgtattgggaacacagaggatgagggaaaactccgtagaagtcagcgaaataaagacaacacagcagccactcctctcgtctcgggccctaccactgcttgaagtagggcaccgggtgtttcttttcctcaacgggctcctccagtctcttataggaccagtcccgccggcgcgccagcatgtaggtcacgtacaaaagaataatcaccatgaacaccaggaaagccagcacgccgtaggccagcagccggtcctcgaacagcgggtcgctcttgataaacacgtaggtggtggtaaaacttcggcccgcgatctgaacgtggagacgcacgacagtatacgtgccgttgaggtagaagacaaactcgcgtaaccgttgtccgttatacgtcacgttactaatattccacggcggaatgagctggttgccctgatgcagatgcacggtgctgttggggtgatagaggctgctaccgttgagcaagcagtgttcgtgttcctgaagcagcacgcggacccgcatcgtggtagcgttcaagcgagtcccgtacacggcgtagatgggataggtgaaaaggtcccaagtggcgttgtgatggcggccccagctgaagaaagagcacgtgtactcagtggtctcctgcggcctgagtcccgagataagcagctcttgagcagtagcgttgtaggagagatgtagttttcctgtggaaaaaattaatgagttgtttattttgttagcaggttggcgagggaggaaggagaacaaaacagaaaggtacgtgttacttacctttatcgttggagggaaaagcgctaagataccccacctgagtgaagggacccttgcagtctgtccgtgcataacaagtaactgataaaatgtctggatttttggtattattcaacaggattactttgcaggtggcgtttagagacacttggtcgtagctgtagctggcttcgcaattcacagtatacaggtgcccctctttctgcgtcgtggctatcacggaggtggaggcggacgaggtagaggtttgtaccgtggtggtgacagcagaagtgacgttgttagaggtacttattgacgtagtagacgtgacggtggtattactaggggaagtgacggcgcttgtggtgctacttttcactctcgggtgcatgtcgcccaagagcgcaactacgagcgcgatcgccagcacggaacacatgttgccgtgtgacgagacggcgtgtggacgagctatatgtggcaggaggtcgcgtcacctcttgtgacgcctaaacgtccagctccagataaaagaggcgttaataatgaagaccacaaaaaccacttgcgtcagtatgacaatcataaaggctcggtgattgctacgcctaaagtacgcgggattatccaccagttcatcctgctgaacaaagtggatgattgacgtgctggtgttaccggccgtcgtattgatcatggattttactaagaaagttttggcaccaaaagtcccgttagagccccagcaggtaacgctgccgttcacataggctcccggtgcccctgtcagcatgcgtttcagttcatgagtataatttttcctatcgttatacatatcatcactgtagttgactttgctggtgagaaactgtgtgttctgtggaatactgatcatcatccccgaggccaaaaagggcgaatcgcaagctgtagtgttacagaaaatagtcaggttagtgtcattatgctcatacatataagccacgctaacctggggctcataccacccaatcgcaaccgccagcacgtcccatctcccgacatttatcaccgccaccactaacaacgtcacccccgcacggtacatagttaccctctcgacgtcgccggctgtcaatgacgtgcctgcgtcagtggctatgatttatagcttttggacacaaccgcaacggatctgtcgtaatctaccttccacagggccgccgcgacgatgctgaacgacaggatcagacagacggcgtataggagtcctaggtcggcgtcgacgcggcaagtgcggatgtctcgcagggtgggtagatgggcgatgcacaactctttctccccccgcacgtacatcccatctcgtatcagcagccgtagcgtagcattaatggtcagcggggtaaccaaagaaatcacatagggatgtgtacaggaagtacagtgacgggtatccgtgagatgtaagtcatcacccttctcactgttatcatgaaagaccaggactcgggtaagacgacccgatgaatactggatctcccaccacagtctttggtccaacaccgagagggcacaagagattctaagtctccctgggttgggggagcagatgtaagccccgtgtgtgcccctcgccatcagaaccatacacatgagggggaaaaggacaagtatccgggaccacccgcacccccacatcacgagaccagagacggagatgtataaaaaaaagctacttttattaaacagcattctcaccacacgttaatactgtcacggggaatcactatgtacaagagtccatgtctctttccagtttttcacttactgagacttgttcctcaggtcctggatggctgcctcgatggctaggctcagggtgtccaggtcttcgggaggggtctcggtgggctgctcaaactgccccacgtcgtaggccttcgcggccgtctcgtagataggcagcatgaacccaccctggttggtggagaagatgcgcaccatgacctgtttgggaaacttttgcatcaggggcaggcacaggttgagagcgcccaacaggtccacgggggtggcagcgtggatgatcatgttgcggtaatcggaagaacgggggcataattggtgggtgtgcaattctttgaggctccacgcggccttgacgccttcgttacaagcatcggccgtgcgctgcgccacttcgggtgggtgtgtcacaggcatggtgtgctccatgagaaagggagtggagagggccaggttgcacatggtgcccaggcgacaccgcaccgcatccacctcactcttcacctcatgattgcgggtgtagatgatctggatgcccttgttgttcacctgcatggttttgcaagctttgatggcctcatctaacacctggtgcatactgggaatcatgaagggcaggttcttgtattcaagagagcgattggtgttgcggaacatgcggctcacctcgtcaatcttgacgcgaccccgccgagtctgcacgttgggtgtgcagaagggggtgttcttatctttcatgatattgcgcaccttctcgttgtccaactcggagatgcgtttgctcttcttcttgcggggtccggtgctcgccccgccgctgctctgatggccgcagctcagcagagaggaggaggccgcgccaccaaaaccgccgcgcccatggtggctcgaggtcacggatgctcctccgccactgctgcatttcatctcctcggactcactctccgagtccgaagccgaactgcaggaggaggaagacgaagaggaactatcttcatcgggccggcccaagggatcgggaagaggagggtggttcatctgggagagcgggtgcgtgggagaggtcactcgcggcgtgccgctgccggtggaaggggaagacgcggtagcaccgcgggtttcgacttcttcaccctgttcttcctcgctatcagagatcacgatacagccggcggtatcgataatcttgttgcggtactggatggtaaagtcgggctcgggcttgatgtcttcctgtttgatgaggaggggcagcatgataggcgcgggaggcacgggcggtttaataatcaccttgaaaggacgcgtggttttgcgcggtttcttacgcgggctgagctcgggagtagcggatgccccggggagaggagtgttagtaaccgcgacgctggtgggggtcggcttgttaagaggggcgctgctaacgctgcaagagtgggttgtcagcgtgtggccggtgctactggaatcgataccggcatgattgacagcctgggcgaggatgtcacctgatggtgataagaagacacgggagacttagtacggtttcacaggcgtaacacgtttattgagtaggattacagagtataacatagagtataatatagagtatacaatagtgacgtgggatccataacagtaactgatatatatacaatagtttactggtcagccttgcttctagtcaccatagggtgggtgctcttgcctccagaggtggtgggttcctcagcaccatcctcttcttcctctgaggcaacttcccctatctcagacactggctcagacttgacagacacagtgtcctcccgctcctcctgagcaccctccccctgttcctcatcactctgctcactttcttcctgatcactgttctcagccacaatcactgaggacagagggatagtggcgggtacaggggactctgggggtgacaccagagaatcagaggagctagcaccagcggtggccaaagtgtaggctgcaatagcatcttcctcatctgactcctcagcgatggcccgtaggtcatccacactaggagagcagactctcagaggatcggcccccagaatgtactgggcaaagaccttcatgcagatctcctcaatgcggcgcttcatgacattgataacctcaggcttggttatcagaggccgcttggccagcatcacactagtctcctctaagatatagcagcacagcacccgacaaaactcacttaagagagagatggacccgtacatggtcatcatgcaagcgtcactggtgaccttgtactcattacacatggtttccacacatgtagtgaggatatccataaatatgtgatcaatgtgcgtgagcaccttgtctctctcctcatccaaaatcttaaagattttctgggcataagctataatctcatcaggggagcactgaggcaagttctgcaatgccgccatggcctgactgcagccattggtggtcttagggaaggctgagttcttggtaaagaactctatattcctgtagcacatataaatcatttttctcttaagttcatccttcttagcacgggccttagccttcagtgcaccccctaacttgttagcggcgcccttggtcacatcatgcagctccttaatacaagccatccacatctcccgcttatcctcgggtacaatgtagttctcatacatgctctgcatagttagcccaatacacttcatctcctcgaaaggctcatgaaccttatctaagatatctaaggcattctgcaaacatccccccatcatattaaaggcgccagtgaatttctcttccgtctgggtatattttttcagcatgtgctccttgattctatgccgcaccatgtccactcgaaccttaatctgtttgactgtagaggaggataacaacacatataagtatccgtcctcctgactcatttatcgctatctcgatgccccgctcacatgcaagagttaatcttcactctatctgacatacacaagtaaatccacgtcccatgcaggttagtatatatcacatacatgtcaacagacttaccgagttctgccaggacatctttttcggggttctcgttgcaatcctcggtcacttgttcaaaggttttgagagattcttcggccaattctgggaacagcgggtctcccaggctcagctgactgttaacctccttccttaacatagtctgcaggaacgtcgtggccttggtcacgggtgtctcgggcctaaacacatgataaacaaagtcataagcacatgggtcacatacaggaaatatgtatataacattaaagatataactttttattaaaaaaaggggaacacaagtcccgacacgtaccgtggcaccttggaggaagggccctcgtcaggattatcagggtccatctttctcttggcagaggactccatcgtgtcaaggacggtgactgcagaaaagacccatggaaaggaacagtctgttagtctgtcagctattatgtctggtggcgcgcgcggcagcaacgagtactgctcagactacactgccctccaccgttaacagcaccgcaacaggagttacctctgactctcaacagaacacaactcagctgcctgcttcttctgctgctgctgccttaaatcttccatctgcgtcagcggtgcaagcccattccccgagctcattttcagacacataccctaccgccacggccttgtgcggcacactggtggtggtgggcatcgtgctgtgcctaagtctggcctccactgttaggagcaaggagctgccgagcgaccatgagccgctggaggcatgggagcagggctcggatgtagaagctccaccgctaccggagaagagcccatgtccggaacacgtacccgagattcgcgtggagatcccacgctatgtttaataaaaactgcgggcactggggacggtggtgttgtatatgtgaatttgtaaataataaatgagaccccatcctgtaaaaatacagagtccgtgtcagtctctgaaggacagagtattggcatatagccaataaagatagttgtggcaaagagccatgttatggattagtaatggaaagtatcgtcaccaataggggagtggtcaataatggtcaataacccacacctataggctaagctataccatcacctatagcataaggaagcgggggtgtatagaccccaagccaaaaacagtatagcatgcataagaagccaagggggtgggcctatagagtctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctctgcttatatagacctcccatcgtacacgcctaccgcccatttgcgtcaatggggcggagttattacgacattttggaaagtcccgttgaatttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccgtaaggtcatgtactgggcataatgccaggcgggccatttaccgtcattgacgtcaatagggggcgtacttggcatatgatacacttgatgtactgccaagtgggcagtttaccgtaaatactcctcccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaccatggcggtcatattggacatgagccaatataaatgtacatattatgatatggatacaacgtatgcaatggccattagccaatattgatttatgctatataaccaatgactaatatggctaatggccaatattgattcaatgtatatatcgatatggattggccatgtgccaacttgatgtcgcctctatcggcgatatggcctcatatcgtctgtcacctatatcgaaactgcgatatttgcgacacacagaatcgcccaggtcgccaaagtcgtctatcgccatcccccgtaaacgatataagcgctatcgccagatatcgcgtatgcccaaaaatcacttttggaaaaatggcgatatcagttacacagagactcacatcggcgacattttcaatatgccatattttcaaatatcgatttttccaatatcgccatctctatcggcgataaacaccactatcgcgcgacatgaatttagtcggcgacagaaatctcaaaacgcgtatttcggacaaacacacattttattattcactgcagcatatagcccattttagcgcggcacacatccagccgtttgtgtttcttaacgctctccaggtactgatccaggcccacgatccgggttatcttgtcgtattccaggttgatccatcgatagggaacgctgccagcggcgcccagcaggtactgcgccttgtcgttcactttgccgcagcgtattcgcccgtcagcttcgaggtataacctacaacacggaagggaaggggggtacaaaacgtgaaattagactttttttttaatgatgttttgtccctctctgtcttactctcccataggctgtaaggccctcgaggaagagacttacggattgtagttgcagctcgtcagtttgttgtgtacgacctggcgtgtcaatgaatgggtcatggtggtgatgatcccgcgaatctcagccgttttctcgggactgtagcagacttcgccgtccggacaccgcagcctgtggattcatgaaaatctactctggcattcccgaggatcgtcgatggaacatggctatcagaaacgtcgagagacagatccagacgcaccacagaacgcagacaatcatgaaaatacgtacgcgacggtgaagcgattgcacattttgaaatcgtaacagcgttccggcgggtggttgacgtttatgaattcgcaacattcttctgcgcgtacccgcggcacgcggctgtgacccagtagcaaccacaacgtcgtcaagaacggcgtcaggtctttgggactcatgacgcgcggttttcaaaattccctgcgcgcgcgacgggctcaaacgatgagattgggatgggtgcagaaggtgtaagtctggttattggcctcggtgaacgtcaatcgcacctgaaaagacacgctgtagtcccggaagacgtgggcccagctctccagtttcatcacacacatctgataacgtgtgccatcgttgacgacgaagcgtagcagcttggtctgcttgggcaccatgtgcgctccaaaaatcttggcgtcttccacgctgatctgcacgtttccgtcgctcggtttcgaagccgttcggggcatccgttggaggatggtctggttgcgaccgctcagataccagatcacctttttcacccaggtggagcttttctccaccaaggtctggccttcccggttgtacagcagatacagggtctcgttgcgacactcgggacccgttgatacccgctggaaccccgagaattgcgagggggaccgtgggggcgagggatagagaaaaggacagtaaaacgtcgccgcgtcatgcggtttggaatacgtcagtttagaccatggcggggacggattctggttcgccgttagcgtcgaccacgaagacgccagacagggcgttgcccaaaccgcgcacagaagcaggcagtgaaagtagtgacgaagcagaagccgcagcatattatttcccgtgacgcaggctagttggcaaagagccgcacgctgaactcgaggctccgggcgtgcggcgccagcgaaccggcggcgttgaacgtggtccttttgttggtgccgccgcgacggttctgacgtctaaagtcgctgatgagcaacgacacctcggtcacgttgattctgcaagcacaggttccgaacgtcatttcacaccccatgcggttacctacccgttacccgttcgcccttaccttcccgttgtcatacacctttagcgcgtaccctcacctcttgagcacgtcaaagttgtccaagccgtggctcgcatcgtagtggtagttcaacgtgaggtccacgagctgttccacatacttgtaacgggtttggtcgggcagcgcgcgagagcacgcgtcccagtaatgcggtactcggtaataatcgtttttttctgcggtctcccgctggcactgacccagcaccacggcgcacagacaaacagacagccacacccgatacagccgcatgttgcagactgagaaagagagctttattatgagacatcatacacatagtataggcgaggtaatggggcggggaaagagttggaaccgaaagacaaaaaaaaaagcctagtcgtactcgggatctctgagcgagacggattgcgtagcaactttcattagtttgggaatctgccagctggtgctgttggaaggttcttccatttccgaggcggtcagttcatcgtacaccgagacgtagtacctgatggggtcctcctcattgtccgagaggtgagattcgatggtcaaaggcgagcctctcccataattgggattcacgaacgacgtgtccaagttgccatcctttctgaaatagatgacgttctcaggatcatgtttcatgcgctcgcgggccgcggacgcctcctcctcctcgtcccagtcccgagtttccaaccgctgataagggctcgaggaacaaaatccggcggggatctgagaacctcgtcgggaaccgctgccaaacgggctgctgccgccactatcgtccgtgtcgtccaacaggttgacggcctcttcgtcggcgaaacgaaagcggcccgggtgcttgcaacacgaggagtaaactaccgcgatgagtaccgctatgaagctgaaaatggaggtgcctgtcacaatgtagaagaggatagccagcactttcatgatttcgtcattgcgcgcgtcgtgaacggaagattcgcgggcggtggtcatgttggtttcggttgtaggttcgctactcgtagtgctctcgacggtatttctgctgctggtgctagtagggacgtttgtgctgctggtcatatttgtagcgtcgctgaagtccatgtgaagcagcaacccgaacgcgaccaggaccaggaatgttgcgcgaaggagaccccgcggggccggcattcttgagacgtggcgacgtggatttcttgttatgtccgcgaacgacgtgtgacgaggacgtggtttccgcaagcctctaccgacgccgcgacaccaggtaggttatgaaaacgcgagcccatatcgccgccatcattgtaatcagcaatgtgttgaggtactgcacgatgaatctgtctagtgacaccagccaaccctctgcttttgcgggcaagcgcgctttcggtgacagggtgtatcgtacgtagccgcgggtcaggcgcgcgttgtagcggtacacgcagaaatctatccacaggccaacgcccggctgtagcttcggatggtggataatagcgcggtgacgtacgccgcggggctttagaatctccacctgtaaggccatctcctccaggtagtgggtctgactgcgacgcagcgtccagttcatgtaaaagtcggtctcgccgtgtccggccacgaagaggctgcttactaaatcgggcgccagagctaggtcaggcgtatcaaattccactgccaggcgacctgattctaacggttccacgatccgggagagcgtttctagatatagagcaaagcgtaccacgtctacctgcggtgtaaaaaactgttgtgggcgttcaccgtcgttgaccacgtaggccacgtagaggccaacattttccaccacgggttctagctgcaggcggcacgtaaagcttagaaacgacggctgtacggtttggttcccgtgaagctgaagcgtcacttccttgccggggctcaccgtgctgtaacgtcgcaccgagtcggtcatctgctccagatcggtagaccagaaaggcgtgcaatgcatactgtcccagtcgcgacacacagcccagcctagctcggtgaagggtcgacgcacacccgaaaaagtgtgcttgaagaccagggggtcgcctcggtagctcagtagccgaacatgcacatagtcgcggctagcgttgacagacggcccgtggagggccagtaggacgagcgtgaacagcaagcgcaacatgctgcgcgggttaggaaatgcggcgtgccggccaccgcccgactcataaacgctaccagcatgacgtctcagatcacacaagtgacgaggagcgtaccgcaaatcactagggaaaaggccagcagagcccgatagtcttgctcttcgcgaacgatctcgtccggttcctcgcagtcttcgtggtccacagaagatgaggagcaggattcttcgttaatctctgccaggatactagtgctataccacaccagagcgctcagcgtgcccagggctaccgcacggtaaaatagggacatgatcaccagcgcagtctaaagtagtggtaattaagtttcttggcgtatttccagagaaaggctttgtaggccgtagggactggccaggcaccgaactcaatattggtagacactacgtcgtaaatgcgttgttcctcatctaagattaaccgaaaaaatagccggttgatgtgacggcgcacggcttgcgcgttaggattgagacacttggtgcccttgtcctttaaaatagccagcacttcctgacgattgcagctttcgctcgctgcgattggcttaagcagttgagttccgactggcagggtattcaacagaatttggttgttgcaacggcagcgcctgtcgtaatcttctagttctaaaacatggacggctaggggacatatggtaagtaacatatatgcgattaatgacaggtatcgtaccgataacagattgatatgcgagtttgaaaccggatggtgcaaccatgttagtaccatattaaacacatactgtaatattttgttttaacgaacttgtctgtttgaaaacatacattaaatattatcctctaacacctatcaaggttatatttattcgtctcggttctggtgatttcgttatgttaacattataccacctattatcgttgcgtttgtctaaccattttgagaagaggtgatcgggcgataaacatactccatgtccaggcggcttccttccgtctggatacaataaatgttcatttttatcgcatccgggccctctgggatcgcgatgaagccaataattacccaatataattttattaggcggccattttctatgaagacatctgcagcgtaattctgttccattcacctcataatgatacacatatgctaaaaaaataatcaacgcaccaaaaattaatcgcattataattttattatctacgtcactaccagtaattcgtaatatccggtattcccggaaaatcactcaaaactgcgtccatgacacatcaattcccgataagtacccccctttgaaatcggatccccccacataccaatcaatcacacaacacacaggtttaaaaatcgatcacacgtcaattaggtttcaaaatcgatactgtttattatcaggaatctagactaattctacaatgacagctctgaatttctctcttgtctttcttgtcaggttctcatcatcagtcatcacttccacccatcgaggagtcatcgtcgctccaaaatcctttggggtcgctagttggaaaagtctctgacacgatccaggcaccccgcacccagtccgactgatctagcttgcggagcatctcaacaggcatgagctgcagggccacggctgtcacggcactgtatcgatgtaacactagggactttctttgcgatgtagccatcaacacggcgtatgccccatagttcgcgtgatacgacgcatgatgggttaaacgttcccatccggcagtgccgtctcgggtccgtgcacacaacagctgcacagcgttatgatgcttaaaattaaccataacgctgggactactgatgaaggagtagtaatgagccaggacgccgtacatcgaaggcaacaagaaagagtgacagcacgatagcaccgggctcttatgtaggcgacagcttatttttcctgacgtcggcaaaaagtacctaaattccccacagatattcagacacggttccgtaaagtgcttctttttttagtgcaggaattggaaaaaataataaaaaatatgaacagctcatctgtaattatctgtgtgacttcatcgtaccgtgatgtaaaaacaacaacaggaagcttacagggtgcggtagaaaaatttgccgattgtgcaacactgttggcatctctcactccgataggcggctataagatagagaattaaaagtatgatacccacaagaaagatgaagagggacaaccaggctagagtatgacgaccgcttttcctttgtttgacggttacatgtgcggtatgattttgctgtcgttgcttgtgatgttggacacctggagtggaaaacgacgtatgattcttagatgcgcatatggtgttattagtggaagtgcagttacgaaccgtgatctgagtgtcgttacattgagtacaattagtacagttgtaaagccctgtgagataagtaccgtttgggcacagtgtacacgttatgccactattctctgtacacacttttgtaactttttgtcctgatccgcatggcgggcaacattgattacccagcttcacctcatcgggcttacacattttacttcccccaagctgtagtaaaaacataccgaagcagatgagcatcaccagaggcttcatgcctcctaccggaagaataaaaataactcatagggccgaacggtgtcatcctctccgcggtttgtaatacgagattgcaaacgtaaataaatgacataacttcactaacacgcatactacaaagtccacctacgacgctgaaagttcttccaggacagaacaggatagtcagccatcttcacagtctacctcttaggccgtatccaggagcataggtaatcagtttccagccacagtacagcgagcccaggaaaccgcacacggtccctgccgggaacacgtaccaccacatcgattcgtcgtgccgtagaaccgtagagttttccgaacttttatacacgccggtggcgttagggccgtgtgtgctgctgtgattggaggttttgtgagctaggtaacagctgtgatttcacctgtcgccaacactgacagcgattacccaggtggagcacaatcacatagctgatggacgttggttgatccgttgattcccatggacattttaacggcgacagtacagctcccgttaaacattagaataatagacgttagtggataacagcatgttattcgcccaagtgtgatcgtggttatacactttcttgttttttgctcatatgctgtaaggtgttcgaggatcgtggggagtatatgtgttgaatcggaatcatgtttactgaccgcgccatacttcgtatacgaacctaaccggcgtaaagtgttttccgatatataaactggcgcctattgtggctgtagcgcccataggtatggcgtatacccacggtgatgttgtgttattcgttttttgtgataaaacgtagcttatgtttaacgtgtgttccgtcacgttatgtgtgtcgttaaaagacggcgcctgtacagtatggctttgagttgtatcttgaattgttattgcatctggaggtgttgtgtacagagtggttgttgcgtgttgaggtgttgttacgttttgaggcacagttgcggtgtacacgggctccaaggtgtagttacggagtctttctatgcaggtagtgttgagatatttttgaatgctggttatgttcgattctgtgaggttaaagtgtgtactatttatgacggtgtaatttagacggtcttgccatcccgaggatattagtgttaggtaattcgtgttgttcacgtttgcttgatatgtataggtaggtgtactgtttgtgaggtcgcaagtgtgattttcttgcagagattttatccatcttgtgtgaaaatattgagatacgcgatgaatgttttcgctatctatattataaagcgtttcagtgtcacctaggggttgtttgttgtaacttttattttggaccctgggtgtgaaccatgattccaatgtttgtatagtaaggtgtcctactaataaagacgaactgattcctaccgtaatgttataccgcacacccagggtgccgtttacaaacacggaaatgtttccgttacaaaccacgttggcagatgaattagattccaggtggtaacgataggataatgaccgttcgctcccaacggatgacacaaagtatccgaataaccaacacgcccattcaatccgcatattttaatcacactattcacacctcacacactgcattttttaacatcttatttttttattttatgcgtgttctcacctcttcatctttttaacaccggggtaactatcgtaagtcggtaggcgtcgatagccctcaccacctcgtcgtccccttcccggcgtggggcaccagcgtccacagcactgcaggtaacacaggtagcataggaaacatacggtgaaaatactccaaaatcccaaaaatgccgcgattccccgagtggcccagggagacatcccggtgtctatgtcggccggcggtgctggcgtcaccggtaaaaatttcggcgggtgtggctgcgaacggtagcagtcgccggggagccggtaacgctgtatcactgtccaacagcggtcgggttcctcgtccggacatgcgggtttccagcaatcctcggcgtcggcgcgtccgatatagaagtagttgcgctgaaaaccgcggtacatcccgcagtcgtgattccgtagacgccagggcgtcggcgaccagatctggtctcccagcgagtagcgacctaacgccggcgtgcagcaaggttcgtcgggccggctgagcgtctccagttgcgtgagaattacgaagcgttgcatgatgaggccgtggctgtagttgcgcagcacgcattcgtacatgccggccgtgtccgtcgatacgttgaaagtcagcgagaatatttggccgagatgcaattgcgagaaattccaagtggcgtacggcaggcggtactggagtccgttcatcagccgatggcctttgacggcgtccaggatgagctcgtcgctgccgtcgtgggaacgacagaaacgtgcgcgaatggagaccatgggccaggagtgtgtcatgaccgtgcaggggatggtaacttgctctccctcggcgaccaacaccggcgccggcgacgtggtctcataattctcggcccacatcttttcggcaatgtcagcggtggcgaaggggaacgaagaggaagaatattcgaggagtcgcgggcagctcaacagcacccagaacagccacggcagagttcggagcgactcccggcggcacatgatgattctttccttccctttttcgcagagacgctgcgcgcctgctcctgctccgtgtgtcggccgctcaaacgtcgggccggcgtggtggtgaccaccgtgcgacgcagcttctcgcccgggatgcccgcgactgagcgtccggtttttttgcaggtcttttttgctgcctcctcctcgccgtcgccgtcgcggccgacgtggtggaccagcaccgcgcaggaactctcgcgtcgccggcggtacgcgacctgtctcattgctacctcggatgtttaagaaggaacgttcatctgcgtcacagggtctgatgaagctgccaagagtcgtggctgtggcgcagcgcgttctgtacggcgcgtttcaccgctttctgcatggccgctaccacgtcgggcgggagcggctccggcggaagctcgatgagcagttgctgcgagtctcggcgctcggcgtccgccgtttcgtcggacgtggcgtagaaaaccgaggtggtcgcccagtcgtccacgctgtcgacggcctctgtcagtgccgggttgtcaaaaccgccatcggacgcgggtgataaaagaacgtacgatgacacgctgttagtacgattctcgtcgtcgctctgggaacgacgtgatggacgacggtagatgacctcgtcttgccacgcgtcgaagcgatcgcagcagcgctggatccaagcgcagcgaagcagcttacggaacacgtcgttgttccaaaagtagagcataaagagaaagaaaagtagcgtaacgatgaagccgaaaacgacgagggtcggcagggcactaccgccgctgccgttttttgtgtcgtgcgggtgcacggtggtagtggcgttagtctgagctggggtcatgacaagtctgaagagatgagagcgtgggtgctcatcagggacagttgaggtctctccctaccgaagccttagcctctacggtgttttatgatcaacgtgtctacgaacgtcattgtgaaagtgacgtctcaggctttccgaaaccgcgtcagattcaacgtgggtttcggtttagcctgcgtcaccgaggcggaggtggaaatgagccgtcctgtgggggagtgtacgaccctgtagtgcccatgggtaacgtcgcgtcggaagaagtgaatgcggcattggtgtacgcgtgggttgttttgctctctgactcggaggagttgccgcagcagctgcagattttacgtactagccaaaagcagcaaaagcagcaggtaaataagagaaggagtccagataatgtccagccgctagcggcaaacagcgcaagttgcgcgactgtccaattactaccaccaaaactctcaacacattgaatcgacgctgaggttggtgttgcagtgctgttgctactagtggatgaagacgaagtagattgactggaattagagctggtacctgtagtggtttcacttgccgatgcggcaagtgcaaataaaactaatatccacagcatgttcgttactatataattgatatacgaacccgtttgtcgtaacaatcagcgttatatacgctgtatcggcatcgttttaccggaaagtttatcgtaatgtaacccgcgttgtgtacattcgtactgaaagggaacccccggtgatgtgcacattatactctttcattctggggtttcccaatgacgtaaaaatttccactatacaataaaattacggaatcatgtgaaaagtgtgctttttattaacagagcagagggtttacagtagatatatgtttgccagggccactgttttctaacaccgatcaccgccaccattaccacccgttgaactccacacccgggagccgcctgatcgccagggactcctcaccgtccatcgtccgaacaagctcccgccaccgatgctgccaccatcaccgagagaaagaaccgcttgctgcagatacgcttgggctcgcctccgtgcggacgccgtttcgtgcagacgctgagtagatcgagcagagaatgtcaaaacgacattaccgcgatccgctcccctcttttttctttttctcattcacgtgtattcttgatgataatgtaccatggctacggtggtgaactgcgtcgcggatcccgtcacgggtttcaacagatcgacgtcggtcagcggcgccgtcaccgccatgtccggcggaggcacgctgtttctctggttagcgacgtggaccgacgacgaagacgatgaacccgcgcggcggtctgttatccgcgacgacgcgtagctgcactgggaagacacttcctcccaacggaccaagatctcatcgggccgttcggagaaacggtatcgtctgtccgactcccgccgtacggcgccgaggcccagcgacgacaggtccgcgaaccggcgctcgtattccccgtacagctcgcaacagcggatcagccagcggtagctcaaaaacatgcgcaccagtttgaaggtgtcgtgccaatggtaagctagatagcagagaatggccacgatcagcacgagcatcacgccgatgatgggtaacccgacgttcagcggcagatcgtccatggtgaccgtcctctgtccggatctacgtcccagtctctctcttttgtacagcactcgcgcgggaacggccccctcaaccctcttacgtagcgggagatacggcgttctcccgcgggccacttacttgcacggtcgcttgaacggcggcttggactgccacatgcaccgcatccatccatttcggcagcagcgcgttcgacgatgtcgtacgagtcgcggatgatgttaccccgccagcacctccgccggcaaccgcgtcgtcgttgctatcgtcgccggtttcgggcgatgacagcgccggcggcgcgggtctcgtctcgtccaccatttccaccgtgtcgaagcgacagccgctgccgtagtacatagctccgttcaacggccggcgggccgggtcgccgagttccgggtcgggcacatccatggctcgccgtctccttctttgccgctcgtggtgccgacggcacttctcgggataatgacagccgcaaaatagatcgtggagcatgtctcgccaactgtcctggtgataatatcttaagtacgcgatgagcgcgccgatggccataatcataagcgtaagcaaaacggcacagataacgtgaaacaccgcggtcatccaagtcgggcggcgtcggggacgcggtgggtcggtttctcttacgccggcgtcactcagccaccacacccgtagccgacattcccagaatcggtgaatgcgactcaaggcctttcgacgccgccatttatttccaacgtccaagtcccacgtcatttctggcatctccacgcccttgactgacatactctctttctctctcttagctgcggtgaaaaagagggaaggcgtgtgctgctatacaactgtacaacggacgcgctcgctctttcggtctcaggtcatctgcatcgactcggcgtccttcatgacgctctgcaccgccttttccaacagttcctcgatgtccgaccatcgaggaggcggggctaactcggaaaccgacacgataggcagcgtggtcggctccgttggtgtgcggggtcggggacagggacacgagagtcccaccttcgagagattctccagcccgacggtgcgcggcagtctcggattccgcggcggcttttgcggcgtcggcgttttcgggaagggcctgggcgtcaccggcggtgtccagccgaccggcttgggtttcgtgggcggcggtgttttcttggtgagcggcgtgctcaggttcttacgcggcgcgggtatcggcgtcgggggcctgtgcgacgacagccgcgtggtgggggcccggaccggcggcgtaggcggccgcttcttgcgcccgggcggcggaggtggcttccaggatggtggcggctgatgcagcaccgtgtcgacgctggtcgaggacgacaaagagctcgacgaggaacaatgcgacggagatcggccgatgctggttggcgttcccggagtggatacgtcggggatctcgaaccgcgccggaggaaactcgggtttatctatcggcagaccatcctctcctatgtagagcgacgtacaccgcggcacctgcggcgtcggcgggtgggtggccacccgcatgagccccagttccagatccagcggctcgacgacgtcttctttcggattgcgatagcagcacgcgcaggcaccacgcttatcagaagcagcacccgggagccggcctcgcgacgaagtctcgtcggatcgcttgcggcctcggcgctgggtaaataaggaaatggccaggaccagggaagccagtccggtaccgccgaggagcccgacgccgagccacagccacaccatgatcttctctcctgcttggaatctcaaactccgtgtcgggaagggccggtgtacggacatttatgccttggatttctggaaacgtcattttttggcaaggaatgtgtttattgtccaaacactgaggaaggagatgtgggccaagtcggaaaattccttatcacaccgggggcgggttacgttccggtctgatgctgctgctgttgttgtagagccgcggccacggccgtctgcacggcagcttgtaccgcctcggccacgccgggtggcatctgcggcatggcggggggaggcgcgtcgggcggaccgccgggcatcgccgtcggctgtgacggtggttgtgaactcaccgtcggctcgcacggaggtttgttcttcggtctacccctcggtttgtctttcgccctacctttcttcggtttgggttccgatgtcggtgttggcggctgcggtgggatgacgggctggtgggactcctccgacggcggggggacgaacaccgtcggcgccgaaaccgggggactctcgactatctcgcagatcaccctgtcaggatcgtcgccgtgcccgggacgccgtcgatgaccgtattggaccatgtcgtaaatcatcgtctccttgtaacacgctgaacagcagcggctgcaggggcccgagatgcatttacagctgcacttacagctgcagctgcagtagcgcacccatcggcaagttaaaatgtcgattatggaatctttgaaaaattcccggtagcggatgaggtacgcgcagaggaaaatcatgaaaacggaacagacgaccacagccgcgatgccaggtccagaaaaaatattcgctgatgaacccgccaaacaccaaattcccaaggccgcgcatatcatccagatcacaatgatcgcggggacgccccattggcattggcacgaaggatcttgcacatcgcaacccatcgctactgcgttctcccacaaacgccatcgcactatttatccctacagcggctgccgagtcacgtccgccggcgcccatcggccgcggcgatctcctagtaacactcgtccgacacttccaccatctccagctcggccggcggttcggcatcctccaccagcggcgtcgtctcatctttgccgcagcagcggacgcacaccttctccaggcagaacgccaccagctgccgccgaacgtaccacaggtacacgtgcagacctgcgaacaggactacggaggtcatgaccaccacgacgcacacgggaatccaaggatcgagattgtcgctggaactcatggctatcgccaccgacgtgcccgcgtctgtctcaccgccgctcgcccgatgtcgcacggcttgttatacgctagcccgtcgccgcctcggggcacggtgccctcctacccacgtaacttcctccgtgacttaaagtcgcgtgtggtagatctcctgctccgtggacgaaccgttcggcaggatagcggttaaggattcggtgctaaggccgtgtcgccaacgtcgaatgctacgttgcaatagcttcgacggacggccatcctccctctcatcgcaataataaaacaccagcagcgcacacgacgcgatcacggtgacccccatgactagacccacgcagatagccagccccgctagcgtatccagcgccatcccgttcgctcccgtcgtcgtctcctgaacaaagcaactccgcagtccccgttttcaaccgttttcaaccgtttttgtttccttctccgcgactagatgttaacgcccgcggtctttccggccgtgctctacctcctggcgcttgtcgtctgggttgagatgttctgcctcgtcgccgtagccgtcgtcgagcgcgagatcgcctgggcgctgctgctgcggatgctggtcgttggcttgatggtggaagtcggcgccgccgccgcttggaccttcgtgcgttgcctcgcctaccagcgctcctttcccgtgcttacagccttcccctgaaacccgcgtcaatcgactgtcccgaaaacgccggcgttaacacaggaaaaaaaaaccacgcaggaaccgcgtaggaaccacgcggaacatgggacactatctggaaatcctgttgaacgtcatcgtcttcactctgctgctcggcgtcatggtcagcatcgccgcctggtacttcacgtgaaccaccgtcgtcccggtttaaaaaccatcatcgacggccgttataaagccacccggacacgtgccgcggcacttgcctacggcgctgctccagggaaactcctcttccttctgctcttcctccttcaccgcagggaccgtctccctcgaccagggacccgccgaagcaaccgccggaacaacctggaggaggcgcggcatgacggcacccaagtgtgttacgaccactacttatctggtcaagaccaaggaacagccctggtggcccgacaacgccatcaggagatggtggatcagcgttgccatcgtcatcttcatcggagtctgtctggtggccctgatgtactttacgcagcagcaggcacgcaacgggagcggcagcggctagataagtctctggcggctacagctccaagcgccgtagccggcccgcctgccgatcgcgacgtcgtggaccatcgaacagagactcacgcgtacgagaccccgaggtacgccacgcggtgcctaacgcggtataccacacccgtacggtctgcagtgcggcgtacaacgtgtggaaaacgcgttgcgtcgcagagtcagccacgtccccgtcttgtcgctccccaatcggctcccgcacaccccccgcggcacccagagggcgggtgagccaagtattcttaaggccgttctctgttccatatcccataaattgtttattccggagctcgttggcgcggaaatagccggataaggggagcaacaaccgtcggcgaaagccgtcccgctcattcagtccgggtttcgcgtctagtcggaggtgtgaccgttggccaacggaacggcgtttcacgatcaaaatcgtatcgggtagtgtaggagacgtcggcggtgcagaatgcgactcgcggcgtagctcgccgtcgctatgcggctcgtcgccgtgtggcgcggcctggccggctgtctgcgcccagatctgttggccttttgggtcctctggctgctgctgcgtgtgtgctttggcagacgcggtggcaatttgcggtctgcggtaagtgaggatatcgccgagcaagcgcatttgcggcacgtgggcggcacgcgtgttattgttcgttcgttgccagatagcaagtgctgtcgacagcagacgttgtgggcggttggtgtatttttgcgggttgcggtgaaagtcggcagccggcgtcttgtgaagtatcttaaccatctgtgttgctttttgcagcgtccagaaaagcgacgcgactttggggatggcctcgtgctcaccttcgcggagagcgccgccggacctgctcgtcagcagcgagctacgcagacggaatatctggaggagagttacgtgtgtcacaggggagcgcgggtctccggcggtaacgacggcggtatcgtcgacacgtgtgcggcctgctgtgctctgcggaaaagcgccggtctcggagaccgtggacgaaaaagagaacgcagcagctaccgctggcggcggcgtcgttaatgctgccgttgatgatcgacgttgtgagtactcggaaacagcggtgaggcagaagctcggttctccagggaacgaccgtcgatgcgtggtaggcgcagcaggtgaggttggggcggacaacgtgttgcggatcgtggcgagaacgtcgtcctccccttcttcaccgccccacccaccctcggttggtgtttctttttccttgtgttctgcagatagttccacggacagcgacggcaagtccataagcaccggtgtgcaagtggtggagcacgacgaagatatcaccgcgccgcagagtttgtggtgcacggcgttcaaggaagccctgtgggatgtggccctgctggaagtgccgcgttgggtgtggcagggctggaagaggtggcgcaacagcgagtccgggcgtcgatggagtgctgggtctgcgtcggcttccagcttgtctgacttggcgggcgaggccgtgggagaattggtgggctcgctcgtcgcgtacgtcatcctcgaacggctgtggttggcggcccgaggctgggtgtgcgaaacgggtgtgcaagccgaggaggccatggcgcgacggcgacagcgcatgctgtggcggatgttctctcgtggaggcgacggcgaatgcagcacacggtgtgcgatggagatggcgtgcgaggaagaaagcgccgtgttgtgagccgacggcgcgggacgcgggccggcgcagcgcgtgggccacgtgtggtggcaggcggcgtcgtccgcttgcggccgtcgccgcgccgcacagacgcaaacacatgtcgccgtcaagagaaacagtctgagcatagccgtctgcagcggtccgcgtgtagaagcggggggagaacgacgttaataaagaatagcggcggtgccgatagggcgaccgctgaagcgagctgcgtgtgcgtgcctgttttgttccccgtcgccgccgaaaagctacgcgcggcccccgtccctagccttgagcgcgccacagcacgccgcaaactcggcgtcgcgcttacgtcccgcaaacccccctcagcctcgtcccgccaaccaataccgtggcacgcagtgccatagcgccgcgcgtcaaggcgcttacacccccctcagcccggtcccgcaccggcgtcggtctgggtgtggcgggggtgcggctgggtgggtgtgtgccgggtgcggctgggtgtggcgggtgtgtcgcgggtgtgtcggctggctgtgtggcgggcgcgtgccgggtgtgtcgcgggcgtgtgccgggtgtgtcgcgggtgtgtcaggggtgtgtcggcggggtgtgcgcgcggccagatggaagcagtgtgccccggggcccgcgatccccccccccgccccggcgcgggcgcttcttctgcgtgtgtcctcgacgcgggtctgtgcgcctgcctgccggtcccggcagactgggctgcggcttcctcgttttttttttccgcctgtggccgtccccggggacttcctcttttccgcgtccgatcttcgcgtccccagggagtcgcgccgccgtcccctcgggaccgcttcctcttttccccggggactcaaagacacgcaagacagacgcgcgactgaaagagacgcaagacacacgcgcgtctgggtttcgccgtgcgcgccgcacggcgcttttattcgccgtcgccgtcccccgccaccgccaacttcccaaattcccacatttcacccccccgatgaaaacacccccccgcccctcggggacccagcacacggcccggaatggaggtcaggcgtccacctaggtgtgcgcgcgctcggcggcccgttgttggtggcttgtcgcgcatcttctttcggttttttcacggccttccagactgcgcggcggcaaggcggcgccagcaagcgccgtgcacgtcgctgcctataaaagccaggtgcgtgtcgcccgcggcacacgggcgacggaggcgtccgcgtgtgtaaacggcgtggtcgctgacgcgggtttgcttcctatatatacagagtggacgtcggaggcgtccggcggccatggcccagcgcaacggcatgtcgccgcgccccccgcccctcggtcgcggccgcggagccggagggccttcgggggttggttcctctcgttcttcttctttggaagcgacgtcaacagcggggactagtacgagtactgcgggtacggcgacgccggcccacgccgtccaccgggtagaaccccgcgggccgccgggcgcccctccgggtagcggcaacaacagcaccttttggcacggcccggagcgcttgctgctgtctcagattccggtggagcgccaggcgctgacggagctggaataccaggccatgggcgccgtgtggcgcgccgcgtttttggccaacagcacgggccgcgccatgcgcaagtggtcgcagcgcgacgcgggcacgctgctgccgctcggacggccgtacggattctacgcgcgagtgacgccgcgcagccagatgaacggcgtgggcgccacggacctgcgtcagctgtcgccgcgggacgcgtggatcgtgctggtggcgaccgtggtgcacgaggtggaccccgcggccgacccgacggtgggcgacaaggccggccatcccgagggtctgtgcgcgcaggacggactgtacctggcgctgggcgccgggttccgcgtgttcgtgtacgacctggcgaacaacacgctgatcctggcggcgcgcgacgcggacgagtggtttcggcacggcgcgggcgaggtggtgcgcctgtaccgctgcaaccggctgggcgtgggcaccccgcgcgcgacgctgctgcctcagccggcgcttcgccagacgttgctgcgcgccgaggaggcgacggcgctcggacgggagctgcgccggcggtgggccggcacgacggtggcgctgcagacgccgggcaggcgactgcagccgatggtgctgctgggcgcgtggcaggagctggcgcagtacgagccgttcgcgtcggcgccgcaccccgcgtcgctgctgacggccgtgcgtcggcacctgaaccagcgtctgtgctgcggctggctggcgctgggcgcggtgctgccgtcgcggtggctgcgctgcgcggcagggccggcgacagggacgacggcggggacgacgacgacgatgacggcggggacgacggcgatggcgacggggacgacgttgctgccgggggcgagcggcacggagacggaggccgccggcggggacgcgccgtgcgcgatggcgggagccgtggggtctgctgtgactttacctccgcagccgtacggcgccgccggcgggagcgcgatttgcgtgccaaacgcggacgcgcacgcggtggtcggaacggatgcggcagcggcagcagcggcggcgccgacggtgatggtgggtccgacggcgatggcgggtccggcggcgtcggggaccgtgccgcgcgccatgctggtggtggtgctggacgagctgggcgccgtgttcgggtactgcccgctggacgggcacgtgtacccgctggcggcggagctgtcgcactttctgcgcgcgggcgtgttgggcgcgctggcgctggggcgcgagtcggcgcccgccgccgaggccgcgcggcggctgctgcccgagctggaccgcgagcagtgggagcggccgcgctgggacgcgctgcacctgcacccgcgcgccgcgctgtgggcgcgcgagccgcacgggcagtgggagttcatgtttcgcgaacaacgcggtgaccccataaatgatcccgtcgcatttcgtctttcggacgctcgaactctcggtctcgacctcaccaccgtcatgacagagcgtcaaagtcaattgcccgaaaagtatatcggtttctatcagattaggaaacctccttggctcatggaacaacctccacccccatctcgccaaaccaaaccggacgctgcaactctgcccccaccgctcagtgctcaggcaagcgtcagccacgcactccgatacgatgacgagttgtggcgcccgctcagtacagttcacgaccacaaagcctggttggatctcgacgaatcacactgggtcctcggagacagccgacccgacgatataaggcaacgcagactgctgaaggccactcaacgacgaggcgccgaaatcgacagacccatgcctgtcgtgcccgaagaatgttacgaccaacggttcactaccgaaggccaccaggtcatcccgttgtgcgcgtccgaacccgaggatgacgacgaagatcctacctacgacgaattgccgtcgcgcccaccccagaaacataagccgccagacaaacctccgcgcttatgcaaaactggccccggcccacctccgctgccgccaaagcaacggcacggttccaccgacggaaaagtttctgcgccccgacagtcggagcatcataaaagacagacccgaccgccaaggccgccaccgcccaaattcggggatagaaccgcggcccatctctcgcaaaatatgcgagacatgtacctcgatatgtgtacatcttcggcccacaggccacggccgccagcacctccgcggccgaaaaaatgtcaaacacacgcccctcaccacgttcatcattgaaagtctctccagtccatatgttgtcaggacgtgctgtcgttctccgcttgctgcgaagcccgttcttccgagtcgtgtcgctgcgtccagcgtcgcgcccaagatgggaatttgggtctcttcacgcgtagcctcctccaccacggctgctgatcgccgtcactaaggaccgacacggaggatgacgaggagcttctccccgactccgcggtccgcgaccggctacgtagcgcgtgtccctgccagtctccgcagttacaccacacgtcgtgagcagcgtgcacctgctgccgccactgggcctcggcgtgctcgggccacccgccggagcccggtctgagctccgacgcaggatgcgcgtactcaacgtgcgccttccagtccatacagcaacaccataggtcgtgcgagtcgtcggctacccgccgccaggccagttcccgcatgggaaggctggacacgccgaccgagaggtcaccgagcccggacgccatctcttcttcctctccgtcgctgtcattaagcagccaggtcacctcctccgctccgcggtccgccggtctcgacggaccgcgccgccgtcggcaacacggaaaacagtacgccagcccgagccgctaaggccgcatgcccctgccgcccaactgaacacgcatatcccgctcaactgcgttttgccacccctgccagtgctcccgctcgagcaccaccccgcatctcccaacctttttccaataaacgaaaccgacatgacacacgtaatgggtactcgtggctagatttattgaaataaaccgcgatcccgggcgtctcagcacacgaaaaaccgcatccacatcatagacaagttacagtccacagtcacatacacgataaacaataccaacagggtaatgtttatggagtaaaacactattgtccaggccacatgcgtgtatgacttccgcaccatcccgtactgcatgttccacatgtacgcgctagacgtgtaatctactcgcagttcggggacgcaacgcagccagatcacatccccttgcagtattaattaagggccggccgcatcagcttgatatcgaattcctgcagatctgctag

SEQ ID NO: 8 - DNA, 229209 bp, Human cytomegalovirus
gaagctaggcgcgcctgtttaaacatggatccggccgcccttaattaacgtgggagtctgatccaacactgaacgctttcgtcgtgtttttcatgcagcttttacagaccatgacaagcctgacgagagcgttcatcggggcatgaagtacgcattacacaaactccatatatttgttacgatagaatacggaacggaggaggctttcgccacacctatcctgaaagcgttgcattctttatgataggtgtgacgatgtctttaccattcccacggctgctttgcgtgatgatgacattcatcatgtatttccattcacacataccttttgtgcatacggtttatatatgaccatccacgcttataacgaacctaacagtttattagcccttgacaggataggtcaaaagattatatgtaggttttccggtaaaccgaattgtgatatttctctgcaggaaatagaacagcctggtacctataaaacggacaatgcagtactgtagcagcgtaaccaagtaggtccacatgaacacgtacaaaattatggtaagccatcgtttttcataccacagcctgtagctgtcgtacatgaatgaggacggtcgaggaacccagggtagttgtaattgggggcgacattcgtactgtccagaagacaattgcacgggtttcagtgagatgagtactttagcgatgtcggcgggggcgctacgtttcaccgtgacggtgagaacttgaccgtcgttttgtatttcatgaggcacgttatacaagccactggtatcatgaaggatgacctctgatgcgatgtgaggattaaattgtccctcaaaccgccaaacgctggtcatgtttccaccgtcaattacgcagctgacggtgtgagataccacgatgttggacttaggtttgggggctaattgcctttttacaaattcccttctgtattgcaggtcctgctgccactgcttttccgtgcggaaagtcgccatgtcttccacacgtgtggcgacgatagacgccaccaaggtagctaccagaagcagctggatccgcatggcattaccgtatgtcaattagaaagttgagcggacacggttatcgttcctggcggatataagtatataaacgcgagttagcctttcccgtccgttttgtacacccgttccccacacaaatgacgaatacgacctttttttttataaaaataaaccacgtgtattatataaaaacatttacatagaaaagagacacacggatcaacataaggacttttcacacttttggggtacacaggcgtgccaccgcagatagtaagcgctggatacacggtacacagtcctggccagcacgtatcccaacagcagcaccatcgccatctgtatggcgatcacgaccccgagctctaagtgtctgtattcatagtgtagtcgtcgcaggttatccactgaattcccgtaactgaaataacgtatatggtaccgaggctggcaccacatgggtttgcatttggtgcacggcaccaaatgcagagtgagatggtccaagtccgtgggcacccactggcgcaaacggaatacggcttcggtggtctccacgaggcactccggggcgtgcagacggccccactttcgtccgtgacggcccgaccagccgacccgagccactatccctttctcgggatagaacgtaccctgtacacgccacacagcgtccaacacgccgtccttgacgacgcagctggcctgatagctggacacgttgttaagcggcggaaagcgaaactgacgtgccggcggagccacatagttcggttcaccgtgttgtcgcggttcgtcctccctatagtaatagtagtcgtcctcataggggttgccggcgtgagccagcgttacccaacagcagcccaggccgacgaggaggcgcagccaccgcctcatggcggcttcgccagtcaatcgtctttagcctcttcttcccgtgaggtccttccggtggcgcggtgccgacctcggacccagggacgtatccacctcaggtacacacagcaggctacctggacaccgaagctgaacaaggctacgtgtttcacaaactgcaccagtaccacatagaggaatgtcaggtagcgtctctccgcaaacagccgttccaagtctgagggcgttacccgcagcggcaaccagggcagcctggacgccggccggcaatggagcacgctccggttacaggcactgcaggggtaaacggttaacatcacgtaagagagtcgtgcgtccacctgtgggagctcagtttcgtaacgtagagccccgtcattttccagctggggtgcgccgaccttgaaatgggtcgcgctccgctcgttaccccaggtgccgtaggctctcggggccgtatcggagaagttgccacgcacaagccaggcggccacgagtaccccgtgctggacgtaacattcggacacggaactggagacacggtagccggacacgtccccaaacccgcgagggtactggggcagacggacggacttgctatttgacaacggacagatacgagacgacgaggacgcagacgactcgtcgctggaccacgacaaccggagcgactccttggagcggctcgagagtacacttactgcgatcagacaccagtgccagaagaaggaacaggtggacggggaccacaggatcatagccgccggcaccgcggccggccgcaggaagccgcccggcgcgtcgtctgtgtgcgggagccgaaacaccgtgcctctttatatcgtcccgacgtgacgcgagtattacgtgtcaggggaaacccccgtcacgacgaacgtgatttgtaagtgacgcggggtgctgacggggttcggcccgagaggtgacggagcgcctcacgtcagtatgatgtccgatccgcgtcagccccgacgtggttgtggtcaccgaaacccacgtttatatggacgttgagagcagcgcctgaccacatgattcatcataccatttctcggaatcgggcccatgccgggaaagcacattccttttcagtaaacaacaatgacatcataacaaatcattttattcgcgaggtggataataaccgcatatcaggaggagggatcgggtgatgacgcaggccccgcagaacagtccgaaataaatttttagtattgccccatagtcgcctagataccagaggtacgtcaagttcatcaaaacgcccatcggcgtcccggaatcgtataccgggcacacgaagcgttcataacaatcccgggaggcgagtgttagggtagcagagtagtttcggggtcggtttccttccggcgacgacagttccgtgggcagcagaatgtacagcgcctcggtagctgtcgcggtgccttccacgaggatgggctgccggtgcctttcgtgattttccccgtcgtgtagccaagccgaggcccgcaaagtcttaggcgaggggaattgtccatagagtttcaccgcacccttcagtacatggttctgaataacacagccgcacgtgaagtaggtaggttctctcgtctcctccgtggctgccgccaccactcccagccaccacaacaggcagatcgccagagggttccggaggcttccccggcgtagcatggttttgggttaaagcaaaaagtctggtgagtcgtttccgagcgactcgagatgcactccgcttcagtctatatatcaccactggtccgaaaacatccagggaaaatgtcggtgcagccaacctttcacatacagcccccaaaacacttgaatcactgccaccatcatcagcgtatactgcgccgacttaatcgtgagcgcgtagtacgccattagacggcgatcttcgaacaatagtcgttcgatgtcctctaacgagctccacaggggaacccaaggcacgaggcaccggggttcgcactctacataataagtttggcattggtggcagggggaaaagtagaacaacacgagttttgtgcgttgggggacacgatagtcccggagccagtaacgttttgcgacgaggctttcggagacgtcctccaccggcgtcggcactcgatccgcgtagccctccagcgtctggtagtacacccggggtgtcggcgtgggcacggacaggttcccgcgcagggtccacagagcctccaatcgaccgcccgatcggagcacgcagcgcgcctcggaatactctactcggtactccgaaacatcgggcagaggcggtaacggctccgtctccaccaagggcggaggttcatcgaaaagagtcaaggataattcaggcatactacccgcgaccggggcccagagggctagaataagcattacaagattcattctgtcttacaagggaaggctgttcccctgtctagactcaaaagctgtaaggctgtcttatagcatgtagtcttgcacgtcatggggaacagggtggtgatctagtgacgtcgggagaacacggtgttttagggtgcgggggacaaaggacagtacgacagattaggtgatagaaacgttttttttttatttatgaaaaagccagtgtgccgtgcggcctagggccccggcgtagtttggataccagatgggggccgtcaggggtactaccacgagcagaaacataatgacttggtccatgtatagcagcatagcggtgcgcagcaggtcgccgtccgtgtagcaatttgacggtgagcgataaagcaccgttaatgtgtcgcggataagcacgatcttgaggccgtagatgaagctcacagtcagtgctaaaatgatgcgttggtatggttcccaggactgcacggcgatgaagagccagagtatgggaagcatgaagcttagcaaacagaggatggctaaccgtcgttgcatgttccaggccataagccaggctaggcccgtacaccagacgcagagcatggatgacaggacataggcctggattaccacggtgcgatcgaaacacagcccgatggtggacacggatatcgtagtgagggtggtatataccatgaccagcatcagggtcccgggtcggcgccgacgttccagccagtacgcgtggcaacgcagagcgcagggtagcagtgtgctccagaagggcagtgtatcgcgcaggtagggggttgtcacgcgccacggtatgagcatgaaaaggatggtagtggctatggtggcgctggtctggaacacgacggtgccgtagagacgtaccatccagagaaagtgttgaacgctccgcagggtgtcttcatctttggtgattacggtgactcgacggatcggcggtggtgacggtggcgacacgggtgggggtttctctttcttatggccgagtggctcgccttggtgaaactggatctgtaccatgacgggtgctcgacgaacagtcgtcggggcttcaggtacccggcaagttttatagagaaagggggacgatgggtggtggctacgagccaccgccaccttcgcaatacgaggatctgaaggcggcaaagacggtcgtccagggcaggcgccagaggttgggactgagcacgatcagcgtgattttaaacatggtcaccagtcctacgtagattagcagcgagccgcgtaacgtctgagcagccggcagttcgtcgcggatgtaacgcgtgccgtagaaagtcacggtcatcataaggaagacgatggcgccgtagccgtagagtagaatacgctgatgatggaacacggtctggtcgccgataacccagagcgtgatgaaaaaaacgctggtgagcacccgtgagcatatgagctcccaacgcttagcgcgaaagctgtccccaaccatgacagcgccggtgcaagctatccacagcgtgaggaccagtgtgtagtcgatgaggatggcgggcaggtcggagcaccaggtgtagaaaaccgtggtaacggagaggaggcctacgtagcccatggtcaataccacgtcgtcggggtgcctttcgccctgtatcaagaccaaacaccagagaagggagggggcaaaaaccagcagcagaggggaagattcatgttgacatatgttgtgggaatcggggatacccagccaaatcattccgcagaaagccgtactgatggcgatgtgaaagaccactagggcgtagacccggacgaggacagcaaaacggcgcagccacataaggccgtggtgcagctgcaggagggaagcccattgcggcgaatgtagcgacggtagcggcgagtccatgaggcgggtgatgcgcccgagtgaacgggtgagcgtctcggtggagtcttcttataaaccagcggagctcaggcagccttgctctggaacgtcgcagtggtggtgttgaggatgacgctgagcgtgccgttgtcaatcaggtaatgatgataggtgccgagcttggccaggtagctgaacatttggtcccagcgtgccgaccacaccacgggcgtgagcatcaggagtgtggtgtgatagattagtgtttcggtggcgtaaagtatcagggagctgcggatgacgtggctcacgggcattttggtggcgatgtagcgcacgtcttggaaaaggacggccaggatgcagcccacgaacacggtgtagagacacagcaaagtcttatgtaaccaggtgtaagtagaagccaggacgctgaccatcaccgtcaaaagtgtggaggtaaaaagcgcgtcacgccacacggagctgagacggtgctcccaagccacgccgttgcaggccacgaacaacgtccacgttaggatgaggctagaaatgccgatgggcgctgtggcgcacaggttgagcccggcggtggtgaacgagagaagcgccacatacagcgcaaacaccaggccgttgctggggtgtctgtgatcggtgagctccagcgcgcccagaaccaatactggtgtgcagctaagcaatagcggcgagggatcgtcgctgcactcgtagcccagcgaggggtaacccagccaaaccagcgcgctaatgagtacgctgaaagcggtttccagcgtcagcaatccgtagacacgcatgacaatcgcggtccgccgtagccaacacacggcatcttcggaaactgtggacgctgtttccgaataccgggaggagatcgtgcttccctcttccaaggatcggaaagtagcgtccgtcgtttccgcggacgcggcttccctggtacgctccgtttccgacgacgcggtttcccgctgcgtggaaactgtctccatgtcgggaccgcagcgcccggcggcgtatccgcaaggtctcgaagctacagcttgtcagaggaaaagtaggtttgcaaaaaggtgcgcagggtcatgattctcagcaccatcagcagagtgaaaaccagactgagaaacaccttgacggccgccaaaagcgcgcgttccagcggcgtctcgtagcgtacagccagggccgcttcgtggaaatgcgagacggctagacaggtaatgagcacgctgaaggacaagacgatcttaaagcaccaggaccaaccacgcctcaagatgaccaccacgattgccgtgaaggtcaacgtgatcaaagcatggacgaccacgatctgacggcggacggtacgttcgggagccaacaacgctacgccggtgcagctgagaaaggccagtaaggtgaacaacgcggccgagatgaccaacgtaccgtccaggcagagacatatcacgatcaacggcggcacgtgaagcagcgtgtaaaagagcagaacgccgatattgctgggatgcgatgtttcgtaacagtgaatgaagatcactgacgtgacgggtatgacaaagacgaggctgggcgaggactccgtgagacacagacgagaatggtgaaaccacgtcgcgggcgccgcgtagcagaaggcgctgaacaacgcggtcaagccggccagctgccaacccacggcgccataggtgtgcagcgccacgcggcaacagtcgacccaagccagactgcgggtcgccagccgggtctcttggatcccggggggcacgtagatgaccgtgccatcggtgggtacttgaaaccctttttctcttctcatggtgcgctgcgttctctggaaacggctgctctgtccgaaaaccagttccgaacgaaaatctagggcgagagggtggacaacggcgtcgacgacgaagcatgggacaggtcgttcggcgttaacgtcatcgcgtcggacgacggtagttctaagagacgtagatcgctcagcaggtcctgacagttgcggattcgcaagatcagaaaaaaaagggaaatgaacgtaataaagagctgtagcgacgtatgcgccacatcgcgtggcataagaacgtgacggacgaaaaggacctgctgcgaaaagtgaccggcgaagataaggcccaccgtgctgtagaagcccaaaagcagccgcaggggccaagtccagggccgcgtgaagacgatgagaacgttgaccagaaagactacgacccagacgccgttgatgagggtaaattgatcggacagggtgcagttgtcgcgacagatgaagactacttccgcgcagagcaaggtgatgaccaacgtgagcacaaacgacgtcaacacctcgcggggctcctggcaggcacacgtgacacctagcgccgggatgtgcgccaggaggccggcgagtaatagcaccagctgtcggaacggacgacggcagcgcgggtgccggtttcgctgagcgagaaccggtcgctcatagcggaaatacacgaagagcgcggaggccacaggcaccaggaggagcacctcgggcgcccagacaacgtgacaaggaaagcccggacgcgacttgagagtcgctgtagggaagaccagagagaagctacccaagacggccaccgccgcggagatttggaagaggagcaagccggcgattcggacgacaacctcgaagcgatgcacccagcccagcacggccaccacggccgcttcatcatagtcgtcgttgttgccgctgtcgaacagccgccgaaacacgatctgtcgctgggtcgcggtgggaaagcgcagacccatgacagccggaggctatatgaccgcgcgtctaagacgcgagatccgtggggggacttttagatgtttgggcggcccgcggttctaacaggcttgattggtggagacggccggcgcggcgggtgggggaaacgacgagtttttccgttacgccatggttcgcgtgaggtttctctgtacctcccgcaaaaggtcacagcccgaaatggaggccgcgttggtggccccggtggcgcgtgacgataaccaggtcatccaagcgatgagtttgtctaatgagtcctcggtggtgaagaggatgagaatgagcaggtacaggtacaccaggttctcatagagacacaaggtgagcaggtcggcctcggaccacgcgatctcaaacaggcgcgtggtgtcaaagaccgtgacgaccagcatgaagctgagcgccatggcgtaatagcccaaaaaaagtttgtgccccaacggtacgggctgcaggtaaagtgcgatcaagaacgcgataacgccgatcacaaacagcgtgacgatgacctgccatcgacggtgattatggccggctagacccgtgacgcagctgcagaggctaaaaagcacgcaagccaagaggcccgagaaggtcaccagcgtagaggaggagcaggcgctggccacgatcaccgaaagcgtcgtgagcacgctataaatggtgagcaggcccgggctcggcggcgacgtgaacgatccttcatcgcgtttgccgtgcagcagggccaaacagatggtgggcaccatcaaactcaagggcggcataaagccggtgcaacagagaaagacggtgcctttaagatgcggaaaagccagcaccaggcccagacagagcaagaaggtgcaggtgccctgcacggccacggtgctgtagacccgcatacaaagtaaaaagcgacgtacgtcgttcgtcgagacggaggaaatcataatgactccgcgcgagggtcgcgggggtgggggcgcccaggccgtcccggtggcctctgagttcggagacatgacggcggtggctatcaaaaggcgcgtatgagaaaccgtttatagagtgtaatagaattaccgtcattcccacacggcgttcccccataaagtcacgtcacactcgagtaagcgtgaaaaggctttattgttgaataaaaaacacgagtacaacaccgagttgcggtgtcctgtctgtctactgggtgggggaggttcatcgtctgtctctagagggaaggtggggaacgtctaagcgagcgggagcgtgtcatctcccccatctttttacaacaagctgaggagactcacgccgtcgatgcgtccgccgtgtttctcggcgtactgctgcacccagacgtggccgctaaagatggcgacgctcatgtttaggagactcatgacgatggtgtacaacacgacgctgacacagacgctgtttttagacaacgttccacgctggtagatgagatccagggtctcgtaaataagcacggccgaagcggcggtcaccaccaggacgtagagtccgctgtagatcttgctgacccacagcacgggcgaaaagtaaagcaataggtaaaagacgatgacggaccagccgtagccaatcccgatgactttccagcgcgtgggattgttgccggccaggtaggtgagaccgctgcagagaacgaaaaagaccatcaccagggcaaacgacagaccgatgacgcgcctttctccgcaaaagcccgtgcacacggtgatgccggtgttgatcagcaagcacgccaccgtgagatgagcaaaattggtggtgtgtggacgaaactcggcgaaaccgcgtagcatagccagcgtggacacgggtacgatggaggatagggctggcactatgccgttggcgcactgtccctgcacatcggggaaggcgagccaagccagcaagcagaccgtgagggtacaagccagctgccacacgagcccgtgatagacctccatgagcagcttaaagcgtttcaaccattggaagagctgctgttcggccaccagcgcgtggctgcgatggagcggcacgatggtgaccgtcggcgactcatggtgttcggaaaccgaggcggtgtcgcccatgctgccgcttacgaccgctgtcggtctaaggtaggcgtcgatgaaacagtccgtcttatcagcacccggttaccgcggatttgattgacgtcacgagtgtggtcaaaccgtggcggcaccctgtatccgacccgtcgtcatgggctccacaaccagagcctcagaagatggtacatgccgatgaataaagccacattttcgacatagaggcgtagcgagggctgaaaactctccgggaaagaactctgacaggtgatcagggacagatcgtgaattagcatcagcgtcaccgtcaacagcgtcgtcgcgtgtaaaccgagaaagaacggggccgcggcccgcagcagccaaagtcccagcgccgtagcgcagagcagagacaggaccgacggtagccacagccgccggagagacgcgccaggatcgcaacccaaaagcgaggcccccaggcagctgagatctaccgccagggcgagaagagccgcgccgacaaaggcctgcggcgacggctggcacatcagcaaggtcagaaaggctagcgcgtgcggcaggcagtaagccaacaggagtgggagtttgcggggacaacggtcgatcgacggaccgcgtagcagcaggaacaggcagccgacgggcacgacgaggctgagatgagaaagcggcggtgggtcgtcgtcccgtccccgctcgcatagctcggccaccggtggcggcatgagccaccagctgagcacgctgagggcgacggtggcggtaagctggaaggcgacgaggacggaggcgcgcagccataccgccagtctctctaggtaggggactacctcctcgacggtccattctagcgggacgacatgaagcatggcgacaagcgcggctgctgtgaaaacgggcgcggttttataggcattaggacttccccgtcgtactggcggctgtcaaagtcccgttgtccaaaggcgcgccgtccgaaagactaatccaacggggacccgagagcatgagcaacaacgtgagaaagatggccatgctgtccaggtagagacagacggcgtgacggatgcattggttaggtgggcagaaaaagatgaccatgagactgtcgtaggccagaatacccaaaaagaagctgatagagaaggcgcacaacgtcaccactatcttctgcagccaatcggcgtcgcttagcagagcgagcgtgaggaacgaaagcagcatcaccacgtagacgcagctgatgcatttccagcgacgtcggtcacggccacctagaaacgccagccccgtaaaggagataaacaacgccagggtcatcacgtaggaacctactagtacgcggctttcagagcacatttggaagatggccgccgtcaggctgttggccaacagatagatgaaaagcaccgtggcgttactagggtgttcgttgcccaacgtgtacgtgatgaacatgcagacgatgggcacgagcacggtgagaaagaagctgtagttctcgacgcaaaagttgcggttttgtgggaaccccaaccaaaaaacgcttcccaagccgaagctgaaagccagctgaaagatgaagatggcgtacacgcgcagccatacggtgaactttttgaaccactcgagagcctccatgcgggagagcagcagcgcgttagcctcctgcgcctgcatggtggcgacggtctcggcacaaagccgctgcggcgcacctacccttctcttatacacaagcgagcgagtggggcacggtgacgtggtcacgccgcggacacgtcgattaggagacgaactggggcgacgccgctgctgtggcagcgaccgtcgcagcgaccgtcgtctgagcagtgtgggcgctgccgggctcggagggcatgaagtagagcacggagacaaagaggtacatgaggtccatgtacaagcagagcgcgcccgggatataactctcatactcgatgtcgtgcaggatgtcctgcgtatcgcacaccaccgaggtcacgatgacggccaaaccggctatcatcaccaggatctcacttaccgcctcgggaaaaagagaaaatacggcgaatagtaagagaatcagcgtggatgcgcccgtcaatagggaacgctgtaattccacgtcgcgggcaaacagatacgtagcgagcgtgaggaaacaaaatagcgtcactgtggccaccatggcataaatgactgaacgatgactaaagtggaagcctgacgccgtgacagccacgctggtaagcaacgtgtacgtcagtaagatccatacgtttttgggaaagttgggctcggcccaacgcaacagacctaggcacacgatggagatcattaagcaagacagcgtcagacgcacgctggaaaagagctgctccagccggtgcggcaacaccagccagcaaaaggcgcagacgctcataaggatgaggcattgcacccagataaggatgtagatgcgcagcaggaagaccgaccgggctatctggacctgaccgcggagcgacatggcggcaacgccggcggttatcgccgagattcgtctaaatacacgaagcgaactagaaaacgcacacacgtgatttgcaaaaagaaagcagctgccggcttattattttattaaaaatttatctgtgcagaatcataagtttatgatgaataaaaacggggaaagggaatctgcttttagggacccgggtctggtccgtcgtctcccatctggtcgggttcggggatggggacctgtttcagcgtgtgtccgcgggcgtgcatggcttttgctcgccggccgcgctgtaaccaggcctctttctctgtggtcggcgagtcttccgacgggtagggagcctgggagtccatcgtttcaggcccaccgctcgttccctcgaccgtcgtgtcgtcctcgttttcgctattacacggggtttctggagtatcgcctatacggttggcgattctccgggggcggccgctttcgtcctcgtcgctgctatcgccgcccggtaattcgacgccgcattcgttgtacggagcgcggcacatgggcggcggaaagaacttgggcatgcgaaagcagcgttgtccatccacggtctgcgtggtttcatcgttatcctcccataatcccccctgtagcgccggcagcgtttcgacgctgtgagaggggaaggcccagttctggttgtcttgcagcgcgcccgtgggcagtaggtccgtgcggccccaggcgctgctgttgttgggtaccttgtcagtgccgcgagtaggtcgcagaaaccagtccagagcgctctctagctgcgagcgtgtgatggtgcccagtgcgccgtgccagcgcagcacgtctcttttcagcgtgtggtgacagacgggcagctcctccaaccgacactcgccacgcaatccgcggtcgaagcggcagagaccacgcagtttaagcagaccgcacttgagaaacatgtgaaaattatcggcaatgcgatacaggtctgagtcctcgatcttgtgtaggtagaccacgccaaacttgtcgagcagcaccaggccgctgggcacaaaaggcccgtatgccaggtaatagcccacgaggccgacgacgtaccactcgcagcacaagcgttgacgaataaagttcaaaagatcgcgaaagtccgcggccggcatgtggtcaaaaggccggcaggcgcgcaggccctcgatggagcccagcatgagcaacggctccacctcggtgcgacccggcgtgcggatgaccaggttgagaccgctcatttcgcgggccgtcttggccacggccgcagcgtcagtggggtcggtgcagaggaatttttgcacatgatagcgcggttcggtggtggcgaacggcgtttgtgggtgccgatacacatattcgcaccagagtaggccgttcttggaaaaggctttgatatcactggccacctcgtagagcccgtcggtctcccagtcgtagacgtagacggtgccgtaatgacttagcatgagcacgcagggcagttcctgcgcctgcttggtgtttcgtgttagatcgctgtcgggtggacgtacggctagtacaccgacggcttccagggtgtcatcgcagcagagatagtcggcggccagagaacgtgcgtaaatctgcgggatagcggcctgttcgcgcatcactaggaaccagttggcggggttgcgcagtgctacggtggttccctggtggcgctgcacgtaggttctcagcgccggaggatcgtactggcgcagatagaggccttgcagcatcgataacgtcttttgaaagacggtgtttctaaattggaaaacgccgtagtcgcagcggatagcatcttcgcagcgctcgtcgcgctgtcggagataggtgccccaggcttcggcggcggctttggtgagtagggacatgccggcaaagccgtctcgacagcgagtcggataaagcgcgctgcgcgaaagcttaatataggagcagcgtcagacgaatcgcggctggtggcccagggggtgggacgcgccgcctacacaaagtgctcccgaaaatcgaaactcttgacccactccggagacaaatccgtattcagattgatgcgtcgcgcttccacttcggcttccgaaacctcggcctccgtccggtaggcgttaacgatacgctgacccaggtgccaacgttctttctctgccaaacgccgttgctcaaaccattcgtctacgtccttgaggtcaaagacagtgtcctcctcaaggtcaaagcctaggtcttcccactcgtcgtcatcgctctcgtggccggcggccatacgcgcggcaaccgcgtcttcccctcctcttctctcaacgttgggtaccacgttgttttcttcgggttccataggttctgcgccactgtcgtcatcatcctctccctgctcctcatcgtccgccaaggcgtcgtggatcacctccaggttctgattgtcgggtacgacgtggttatcttcgtcgtcgtcgcgtggcatgggcggcggccgacggcggacgaccggcatggcgcggccgtcgtttccttcgtcttcctcttctccgtctcccagggaacgcggtcgacggcgttccgcgaagtcgccgcggaccacgcgcgcctgccagatggtaaacgcgtcccaaccgtcccagttatttagcatttcggcgcggaaacggtcgcctcgacagagccagcgaaactgccgcgcgtagtcgcggtctacgccgctgtcgaacatggtaaagtgaagacgcgccgcctcgcccatgtgtacgcagcctccgttgcgttccagcctggccgcgcgccgcagaccgtgttcgtagcggcgacgcacgtacaccttcatgaggccggcgcgaaagagttcctctaggctgtcggccagacggtagatttcaccggctagacgctgcaggggcggcgagcggtccaggtgcgacttgacgattaccacgtaaaaacgacagaaacggtcgaagatgatgaggaatgacgtgtcaaagaaaccaccggcgcggtaggagcccacggcgcccagcaggtaccagcggcaacgcagttgcagcgtgacgtacatttcgcactcggccaagcgggcggctggcgctacctcgaagggccagcagtccgtcaagcagccgaaactggtcaggagtttcaacgttttggcatggcgtccaggtgtatgaaagttcacgtcgcgtccgtggtgttcgccaacgcaggcggccaacgcgtcggtgtcatgaccgtgacgcagcagcatcgctaccacgtcgtgcggtacccgcgtagcaaacggcgtctgtggctgacggtatacggcttcggtgtacatcataccgtaacgcgccagttcgtccagatgacgcgcgcacagcagcagaatctcttgcgagggttcgtagatgtagaggcgcgtaccgccacccatgcagagcaccagctccgtctcttcatagtgatcgtccaccatgatcacgcatttgcctagcacgataaggcgttcggggcaacaaatcacgtcgtccagcagttggtcgcgcagctccggcatggtgctgccgggccgcacctgcaggaaccagttgtgcggaatgccgagcgacaacacctggtcgacgtggttacggacccagtcgcgaagcacgtcggcgctgtactggcactcaaagatgccctgaaagtcgcccatgacccgcagaaaagtttcgtagcgcgtgtggcaatagaggaattcatcgtttcgcgtaaacgtgggagctccgtcttcccagcgtgtacgccacatgtcaaaagaggccgccagctagacaccccagaaaagaagcagagaaagagagttctttgtgcgatacgttttattccgcgtcctccgctcgacgctcaaatctggatgtactcgcgcacacccgtcaggctctttaagggaaaagggtccgagtacgtcactaaccgcgactgatgcaccagggcggtaatcacccgctctgcgccctcgcgcgtcgacgaacgcgtcgtcaccaggcagtgcagccgcgggcccgtatcgtcctgatgaccagcggcctcgcgctcggctgcttccacaccgacaatgtcgggatccaacacgtagctctgcgagttggtgtcgtagcggtgtagcaccaacgtgttggggtccagacgctcccacgcgccctcgtgcgggtcaaaacgctccgttaaacagagccagtcatactgctgctgcagaatacgccgctcgcgctcgcgtcgctcatcgggcaacgcggcgtcttcgttgaagagaatgtcccgcttgtggtctacggcacgctcgtggtggtgcgggcacagatgacggtgttccatacgcgtctgacgttgacgctcgcgctcaaaacgccggtgtcgaaagaccattttcagcaaccccatgcggaaaaactccgtgatggtgttggcaacgcgccgcacgtagtggttggggtcgtccatctggatggcgtacacggcaccgaaccagtccaacagtaccagcacttcggccacaaaactgcgtcccggccgcggacgtcccgtcacgcctagcacataccacggcgtggccagattagcacggacagcccaccaccaacgacggctctccacctcggtgagcgcacaaaagggccaaatgcggtgtaactgctgcaccgttttcatcagccgcataatcaccgtgccgtaacccggtgtatgcaacttcacgtcgcaacccaggattcgttcggccgtggcgtacgagccctcaggcgttgtgtcattgagaaacaaaacatgcatggtacgcgcgcccttagggtatcgtcgcggaacaggtaccgtcattctccgcagagtggtgtgaatcacgtcgcgatacgcaatctccgaacgtgacacaccgtaacgtgccagttcgtccaggttgtgcgataccaacaccatgtacttttcacgagtgtcgtaggcgtagacgcgagaaaagcgacccataaaaaccacgtacggggtagccaccatgccatcatggtgatcgcgacgtggctcgggcaacaaaataacagcgtatcccaacggcgtcagcggctcgcggcaacagatgagctttgacgccgcctgtttggcggcggtaatgattccgtcctccgtacgtaacatcacatgccagcccttggggggacccaaggacagacagcgtccctcgttacgatgaacgtaacgcgtgatttccattggctccaggcaaaagaacagttccttaaaatcccgcaacacttgtcggtataacgccatgggatcctcagccgccacaggcagcgcggggagctccggcggcacaactgcagcgccgtcagggccagaacccgcagccggatccatcattgcgcgacactctcagccggacaaccggcgtcactgacagaagccgagccaaatacagagaaagcaacgctacaccgtcaccccgctcccaagcgccgcggaaagtgctccgatttttcaccgtcgttcgcgacgttgatttgcctcggtctgagaaccgacctagcgttcggaccggtgcgcagaaacagccggcggtccgagccactgagcggttcacagccccggccgccgatagttaccggagagacgttcgagctgcaggtacatcggcgctccccgctccgccaccccgcgcccgccccagtttatactctccgacgccccgtccaacgcgcctgtggagggccaatcggaccgcgggagctctccaagtggatgacaggcacagccgggtgcccgaccgtgaagagccctcatccacctgaacagaccgctaaccgaaggaccccgaatcgcgtccgtcggtcccgacgtccgtcgccatctggttccctgctgttggctacctctcggatttcaaaaaagagcacgtgccgatgacggtgcacaggaaagagccaaagtgtcacggcgtctttttttatttgtgttcctttcctgttttgtactcgtaaactgttgacgttgtttttacatccaaaagggcaagtaagaaacaggatgaggcatggtaggtttgggcgtggggcggccctccagcacggcggcccgggccgcccggcgggtgagcacccggcgttgcgccgtatctatcttgtgtttcttctgtgtctttttcctatcttgttccgcgacggcctctttcatcacgttcagcatgcgttcctcgacgccctccagggatcctggggaggagggagtcctagtgaggcttccaatgttgttttgtggattttcggtttccttttcttggtcgtcatcgtcggacgtgtcgtcttcctcttgatcctcttcttcgtccgagtagtagacgcatagtccctggttcatcaggctgggattcatcaggttctgacggggaatccgctgttgtagacgtttaaccgcccgttccaggcgagagctcatgccgcaccagacgctgtaacgccgcacgggcccgtagcgggctgtttgttcgcgtacatgatcgttgagctcttgccaatattgtttggcacactccagatcggaggtttgtggatagtcgggtcggatccgcggatcccaactgacatcggcggtgccagagacttcgtccagactgttacgcatagagcaccagtcgggtcggacgataaacctgtccttgcggattaaccatttataacgtagttcgtgatggcgtgtagaggcccgtacacgctccacggtcccaaagcggtcccagaagggaaagttttcgtgagggcagcgacccggcacttccagacgttcggcgtcgtccacggcgtagtgaaaacgccggccggcctggtaaattttgagcagacccacggttaacaacatatccacgctgtcagccaaccgccagatctcgcgtcgagacacgtcaaaatagaaaaattcacaggctcggtcgaccaggatcacgaaatcggcgtgaaagacgccggagggtagcgactcgcccaccacacccattatcatggtttcgcagcataagcggtccacaaagaacttcaacaggtcgttgaattgctccgtctccatacagatgaagggccagacgcctttgaggttctcggcctggccgcagagcagcaacggacgcgtcatctcgcctggagtgcgcagaggcacgcattcgccgcgataacgacaggtcacacgctgcagttcgctgatgctgttgtcgtgcaggcgaaggtcgcagataatatgatccggttgcgtggttagcagcggcgtgcgcatctgctcgccgtagatggcctcgcagtgcaacagtccgtgtcgcgcaaaatcatccagactgtgcgccaggtagtaaagcaccccgcaatcgcggtctaaacaccacacggtttcgtaacgtcctagcaggagcaccagacgggcctggctaggtggctcaatttcctctacatatacgaaaaagtcgtcatcgtccgagtcctcgtcctcagaagaggaccgcggcccgtgtactctgggcaacacggtggtagagaactgcaggacgcccagagactcgagcgactcttcgcagcagatgagctgaccccagggcgtttcgggcccgtcggtgacagccgcgctgccaaagatgtcctcaaactctacaaaatctagacgccatccgggtggcgctgaaacgggaaggctaatgttcatatcagcatagctacgaactaagtggcggatgtcctgccgcaagtcttggcagagaatgagctttcgtaaacccttgagggtcctccgaacaacggccccagacgcgtagcgataggactggcgcatggtgccgcggcgtggagcggcacttggcagcctattttatggagtttcttcagtgacgtggcttgttcacgtcgttcgtgggctgcggttggcagctccggtctgtaaaccacccgaaaagactgacatcgacgtcaaagactcacgtaatttggaacatgtgcgaccgcaaagtgcgtcagaatagcacgtggctttaggacataaaaagtaccgtgaggtctagacgtggtttttgtgattgacacttacaccaggtaagccaagggacggtgaaactgtatgtgaggaacctgggtgcttagacaactaacgtgtaatgctttttacaggaccgttcaacaggtgatactacctgcaaggtaatgactacatctactacaactaccactaatatcatgctacaggtgagcaacgtaacgaatcacaccttgaatagcaccgaaatttatcagttgttcgagtacactcggttcggggtatggttgatgtgcatcgtgggcacgtttctgaacatgctggtgattaccaccatcctgtactaccgtcgtaagaaaaaatctccgagcgatacctacatctgcaacctggctgtagccgatctgttgattgtcgtcggcctgccgttttttctagaatatgccaagcatcaccccaaactcagccgagaggtggtttgttcgggactcaacgcttgtttctacatctgtctttttgccggcgtttgttttctcatcaacctgtcgatggatcgctattgcgtcattgtctggggtgtagaattgaaccgcgttcgaaataacaagcgggctacctgttgggtggtgattttttggatactggccgcgctcatggggatgccacactacctgatgtacagtcataccaataacgagtgtgttggtgaatttgctaacgagacttcaggttggttccccgtctttttgaacaccaaagtcaacatttgcggctacctggcgcccatcgtgctgatggcgtacacgtacaaccgtatggtgcggtttatcattaactacgtgggtaaatggcacatgcagacgctccacgttcttttagttgtggttgtatcttttgccagcttttggttccccttcaatctggcactatttttagaatccatccgtcttttatcgggaacgcaaaacgagactctccaaaccgttattactttctgtctatacgtcggtcagtttttggcctacgttcgcgcttgtctgaatcctgggatctacatcctagtaggcactcaaatgaggaaggacatgtggacaaccctaagggtattcgcctgttgctgcgtgaagcaggagataccttaccaggacattgatattgagctacaaaaggacatacaaagaagggccaaacacaccaaacgtacccattatgacagaaaacatgcacctatggagtccggggaggaggaatttctgttgtaattcgatcctctctcacgcgtccgccgcacatctatttttgctaattgcacgtttcttcgtggtcacgtcggctcgaagaggttggtgtgaaaacgtcatctcgccgacgtggtgaaccgctcatatagaccaaaccggacgctgcctcagtctctcggtgcgtggaccagacggcgtccatgcaccgagggcagaactggtgctatcatgacaccgacgacgacgaccgcggaactcacgacggagtttgactacgatgaagacgcgactccttgtgttttcaccgacgtgcttaatcagtcaaagccagttacgttgtttctgtacggcgttgtctttctcttcggttccatcggcaacttcttggtgatcttcaccatcacctggcgacgtcggattcaatgctccggcgatgtttactttatcaacctcgcggccgccgatttgcttttcgtttgtacactacctctgtggatgcaatacctcctagatcacaactccctagccagcgtgccgtgtacgttactcactgcctgtttctacgtggctatgtttgccagtttgtgttttatcacggagattgcactcgatcgctactacgctattgtttacatgagatatcggcctgtaaaacaggcctgccttttcagtattttttggtggatctttgccgtgatcatcgccattccacactttatggtggtgaccaaaaaagacaatcaatgtatgaccgactacgactacttagaggtcagttacccgatcatcctcaacgtagaactcatgctcggtgctttcgtgatcccgctcagcgtcatcagctattgctactaccgcatttccagaatcgttgcggtgtctcaatcgcgccacaaaggtcgcattgtacgggtacttatagcggtcgtgcttgtctttatcatcttttggctgccgtaccacctgacgctgtttgtggacacgttaaaactcctcaaatggatctccagcagctgcgagttcgaaagatcgctcaaacgtgcgcttatcttgaccgagtcgctcgccttttgtcactgttgtctcaatccgctgctgtacgtcttcgtgggcaccaagtttcggcaagaactgcactgtctgcttgccgagtttcgccagcgactcttttcccgcgatgtatcctggtaccacagcatgagcttttcgcgtcggggctcgccgagtcgaagagagacatcttccgacacgctgtccgacgaggtgtgtcgcgtctcacaaattataccgtaataaaaaagcgctacctcggccttttcatacaaaccccgtgtccgcccctcttttccccgtgcccgatatacacgatattaaacccacgaccatttccgtgcgattagcgaaccggaaaagtttatggggaaaaagacgtaggaaaggatcatgtagaaaaacatgcggtgtttccaatggtggctctacagtgggtggtggtggctcacgtttggatgtgctcggaccgtgacggtgggtttcgtcgcgcccacggtccgggcacaatcaaccgtggtccgctctgagccggctccgccgtcggaaacccgacgagacaacaatgacacgtcttacttcagcagcacctctttccattcttccgtgtcccctgccacctcagtggaccgtcaatttcgacggaccacgtacgaccgttgggacggtcgacgttggctgcgtacccgctacgggaacgccagcgcctgcgtgacgggcacccaatggagcaccaacttttttttctctcagtgtgagcactatcctagtttcgtgaaactcaacggggtgcagcgctggacacctgttcggagacctatgggcgaggttgcctactacgggggttgttgtatggtgggcgggggtaatcgtgcgtacgtgatactcgtgagcggttacgggaccgccagctacggcaacgctttacgcgtggattttgggcgcggcaactgcacggcgccaaaacgcacctaccctcggcgcttagaactgcacgatggccgcacagaccctagccgttgcgatccctaccaagtgtatttctacggtctacagtgtcctgagcaactggttatcaccgcccacggcggcgtgggtatgcgccgctgccctaccggctctcgtcccaccccgtcccggccccaccggcatgacttggagaacgagctacatggtctgtgtgtggatcttctggtgtgcgtccttttattagctctgctgctgttggagctcgttcccatggaagccgtgcgtcacccgctgcttttctggcgacgcgtggcgttatcgccgtccacttccaaggtggatcgcgccgtcaagctgtgtcttcggcgcatgttgggtctgccgccgccaccgtcagtcgcaccacctggggaaaagaaggagctaccggctcaggcggccttgtcgccgccactgaccacctggtcactaccgccgtttccgtccacgcggatacctgacagtccgccgccaccgtaccagcttcgtcacgccacgtcactagtgacggtacccacgctgctgttatatacgtcatccgacatcggtgacacagcttcagaaacaacgtgtgtggcgcacgctacttatggggaacccccggagcccgctcgatcgacggctacggttcaggaatgtaccgttcttaccgccccgaattgcggcatcgtcaacaacgacggcgcggtctctgaaggccaagaccatggagatgcggttcaccatagcctggatgtggtttcccagtgtgctgctgatactggggttgttgacacctccgagtaacgggtgcaccgtcgatgttggacgaaacgtatccattcgagaacagtgccgccttcgaaacggtgcgacgttctccaagggagacatcgaaggtaacttcagtgggcccgtcgtcgtggagttggactacgaagacatcgatattactggcgaacggcagcgacttcggttccatctcagcggactcgggtgtcctacaaaggaaaatataagaaaagacaatgaaagcgacgtcaacggtggaattcgctgggctctatatatacaaaccggcgacgccaagtacggtattcgtaaccagcatttgagtatacggttaatgtatcctggggaaaaaaatacacaacagctgttgggttctgatttcagttgcgaacgtcaccggagaccgtccacgccgttgggaaagaacgccgaagtgcctcccgcgacccgcacgtcttctacatacggcgtcctcagcgcttttgtagtgtggatcggatccggcctcaatatcatctggtggaccggcatcgtgcttctggcggcggacgctctcggacttggcgagcgttggctgaggttggcactgtcccaccgggataaacatcacgcatcgagaaccgcggcgctccagtgtcaacgcgacatgttacttcggcaacgtcgacgggctcggcggctgcacgccgtttctgaaggcaaactgcaggaagagaagaaacgacagtctgctctggtctggaacgttgaggcgcgaccctttccgttcacacatcagctgattgtgctgccccctcctgtagcgtcagctcctcctgcggttccctcgcagccccccgagtattcgtctgtgtttccgcctgtataaaaataaagagacgggaggctgatcgcggccttcagcgtctcatttgtctttactctcgagtgcggtcggtgtctcatcggtgagacgaggccgccgcccgacaagttcgatctcatgtcgctcttggagcgcgaagagagttggcgtcgcgtagtcgactactcgcacaacctgtggtgtacgtgcggtaactggcaaagccacgttgagattcaggacgaggagcccaactgcgagcagccggagcccgcacactggctagaatacgtggcggtccagtggcaggcccgggttcgcgattctcacgatcgctggtgtctctgcaacgcctggcgtgatcacgccttgcgcggccgttggggtacggcgtattcctcgggttcctcggcctcttcctccggtttcgtcgcggagagcaagttcacctggtggaaacgactgcgccacagtacccggcgctggttgtttcgccgccggcgagctcgatacactccgtctaactgtggggaaagtagcactagcagcggccagagtagcggtgacgagagtaactgcagtctacgcacccacggcgtgtacacacggggtgaacaacactaatcgataagtcgcgtgtaggcgactggctacatcaaccggatatctgcggggatttaaaaagacgacccgttgtcatccggcttagagcaaaccgtccttttatcatcttccgtcgccatggctatgtacacatccgaatccgaacgcgactggcgtcgtgtaatccacgactcgcacggcctgtggtgcgattgcggcgactggcgagagcacctctattgtgtgtacgacagccattttcagcgacgacccacgacccgagccgaacggagggccgccaattggcggcgacagatgcggcggttacaccgtctgtggtgtttttgtcaggactggaagtgtcacgcgttatacgccgagtgggacggcaaagaatccgacgacgagtcgtcggcgtcttcctcgggcgaagcgccagagcaacaggtccccgcttggaagaccgtgcgagccttctcgcgggcctaccaccaccgcattaaccggggtctgcggggcacgcccccaccgcgcaacttgccgggatacgagcacgcttccgagggctggcggttttgcaatcgacgggaacggcgagaggacgatcttcgcacgcgggctgagccggaccgcgtggtgttccagttagggggagtacctcctcgccgtcaccgggaaacttacgtgtaagaacacggcgtgacaataaacaacatagcgtaaatccccgtgtgatgtgtgtgattgacgttcgggaaacatgtccccatcatcagcgtcacaactgacgtgggttggtcactgacgtgcaggatgttacgcgagtcagagaatcgcataagaacggggtggtgagcgggttcccacaggagtctctggcgcaaaagcaccatgagcctcaggttccccgagagggcgggttacgagaaactgggataccgcccgcatgccaaacgcgtgtgggtgcatgacccgttgggattgacgcggtttatcatgaggcaactcatgatgtacccgctggtgttgccgttcacttttccgttttacgtgccgcggtcctagcacgtcagtggtgacgctgataattgcaacatggcccatgacgaacccgcttgggacgaacgtcaataccacgtcaaaccaccgtgacttggctgaacgttgaaacataaagccaaagcgccgtcggcacttggcttcagagcagcgcctcggggcgatgcgacggcgatgaacttagagcaactcatcaacgtccttggtctgctcgtctggattgccgctcgtgctgtcagccgcgttggtccgcatggctccggactcgtttatcgtgagcttcatgatttctacgggtatctgcagctggaccttctgggaccagtggtggcggggaatcgctcagtccggacctggagagagcaggcggaccgagccagagggaccttcgttcggcgttcaggccttaatactagccacatcttacctgtcggcggcctgtctgggggctccggtaccttacccgccggcctgtatcgtcccgaagaagaggtgttcctcctcttgaaccgctgccatgggccactgtcaacgccgaaaagcgcttgtctggctgaggttggtgtcgctaatgccagttttttatctcgcttcaatgtcggtgattttgacggagcgtcatgggaaaacggtaccgctcccgatggagagcccggggtatgctgaaattcttcttaaaattacgtaaacaacgtcgtccagtcgttgtgccgcgattcgtacggttcatcgtctacgtcgttttgttcaccgtcgctgtgcaacgcgtgaaacaagagcgtgatgcgcaccttcggcggtatgaagaacgattgcagaaaaaccgtgcacggcgtcggcagagttttccgtgacttggggcggtgggtccgagctgcggtatgggtcacggcggcgtgcgtcttattgacaaagatgccgatgtgtgactaaaaaacgtcccagccccagagcgatgtgtttcaataaaaattatgtagtatcatattatgcgtgtcctggtttttcattttttggatgtatttgtcgcataaaaggcggtgggatgtggggatgaaatatatccagatacgcagttttgttatcctaacaaaacccgtgtcatgctaaaaacggtaatgcaggatgaaagtcccgtgtgtggggggggggggcatatagtagtcgcttttaccgctgggcatacgctatgcttgtatttgtgactatactatgtgcagtcgtgtgtcgatgttcctattgggaagggtgtgaatgtaggaggtataaagaatggtgggacgcaggaagacatcgctagacacagctgtattgtgctagccccgcttagcgtcatgggtaaaacggtgataaagcgtcaaaacaccatgggggggggggggcaggaagcttggtggcggtgttcattaaatgcattccgtgtatttattggtacatttgcaaatcgccgagtataccggtataatgtggcaataatcgtattatgtgtgtactatgcagcgaagaggacaatatcagtgtaacgtgaagcaagtgtgggaacaatgccagtgaagaatatataaaagccagaaacatacataaatgaattgctagatacagggttcaatgtgtacagaaaaaagacgcaacaacgacggggggggggcgtacgattaatcctacatattacagtacaggctaccgcgtggtgttgtgtatgttacgatgcggtgtgcctgtcggtgtaattggatgtatgttacttatccgtggcgttgtgatagtgttgtgaaaaataattgtcgtgagcataatgacagctgcaatataaaatcactttattaagcattgtaatgataatgcgtggctacattagaaaacgtgacgcgtcgcatgtcgcggcacaatctggcagcggggtcggggtagggtacggtgggaggcatgtacacagatggaacaaaagcagaagtaacgtgagacggagcatatagtccagtatccagcggttcctgagtagcaccacccatcaactgaatgccctcatgagtaaaagtctgcgggcggcagcccttggggaccgttggcatgggacgatcaatctccaaaccacagcgtaacaccgttttcttccaacgtcgttgatagacgtcgtttttacggttactccccagaacccagaaagtctcgtccaagtcgtaccaggaatcttctccagggacacgcgacggtttccaatcctcgtcgtctcgtctcaaagcacgtcccaaactggcttgaggagtcaacggtggttctgtgggtcgggtgtagcgcgagtgctttcccttcatgaccgattcgtcttccttgcctttaggctttttggtctttttgtgtatcatctggccaccggcttccataaccaccgtggccaagtccagtcccagagcttgagcgtcggcgcggcgtctggcgtcttgcagatagtcttccacatttgcacagatgaccggatgtttggtggctagggtgagcacctcagcctcgccgcggcccggacgtagcaaaaaagctaactgcccgtgcggctcgcgcgcccacagcgcggcgcgcgggtgcaggtgcagcgcgtcccagcgcggccgctcccactgctcgcggtccagctcgggcagcagccgccgcgcggcctcggcggcgggcgccgactcgcgccccagcgccagcgcgcccagcacgcccgcgcgcagaaagtgcgacagctccgccgccagcgggtacacgtgtccgtccagcgggcagtacccgaacacggcgcccagctcgtccagcagcaccaccagcatggcgcgcggtacggtccccgacgccgccggacccaccatcgccgccggacccaccatcaccgtcggcgccgccgctgctgccgctgccgccgcgtccgccccgaccaccgcgtgcgcgtccgcgcttggcacgcaaatcgcgctcccgccggcggcgccgtacggctgcggaggtaaagtcacagcagaccccacggctcccgctatcgcgcacggcgcgtccccgccggcggcctccgtctccgtgccgctcgcccccggcggcgacgtcgtccccgccgccgtccctgtcgccggccccgccgcgcagcccagccaccgcgacggcagcaccgcgcccagcgccagccagccgcagcacagacgctggttcaggtgccgacgcacggccgtcagcagcgacgcggggtgcggcgccgacgcgaacggctcgtactgcgccagctcctgccacgcgcccagcagcaccatcggctgcagtcgcctgcccggcgtctgcagtgccaccgtcgtgccggcccaccggcggcgcagctcccgtccgagcgccgtcgcctcctcggcgcgcagcaacgtctggcgaagcgccggctgaggcagcagcgtcgcgcgcggggtgcccacgcccagccggttgcagcggtacagccgcaccacctcgcccgcgccgtgccgaaaccactcgtccgcgtcgcgcgccgccaggatcagcgtgttgttcgccaggtcgtacacgaacacgcggaacccggcgcccagcgccaggtacagtccgtcctgcgcgcacagaccctcgggatggccggccttgtcgcccaccgtcgggtcggccgcggggtccacctcgtgcaccacggtcgccaccagcacgatccacgcgtcccgcggcgacagctgacgcaggtccgtcgcgcccacgccgttcatctggctgcgcggcgtcacccgcgcgtagaatccgtacggccgtccgagcggcagcagcgtgcccgcgtcgcgctgcgaccacttgcgcatggcgcggcccgtgctgttggccaaaaacgccgcgcgccacacggcgcccatggcctggtattccagctccgtcagcgcctggcgctccaccggaatctgagacagcaacaagcgctccgggccgtgccaaaagttggtgttgttgccgctacccggaggggcgcccggcggcccgcggggttctacccggtggacggcgtgggccggtgtcgccgtacccgcagcactcgtactagtccccgctgttgacgtcgtttccaaagaagaagaacgagaggaaccaacccccgaaggccctccggctccgcggccgcgaccgaggggcggggggcgcggcgacatgccgttgcgctgggccatggccgccggacacctccgacgtccactatataccaagcaaacccgcgtcagcgaccacgccgtttacacacgcggacgccgcagtcgcccgtgtgccccggccgacacgcatctggcttttataggcagcgacgtgcacggcgcttgctggcgccgcctcgccgcgcagtcgggaagcccgtggaaatgcacccggcagccgacggcgcagtggactggcaaaggcagcccgagcgagaacccatccccgaggggcgggggggtgttttttgcgggggggtgaaaattggagttgcgtgtgtggacggcgaatagttgcgtgtggtgcggaggacggcgacggcgaataaaagcgacgtgcgcggcgcacgtcgcaaagaagacgcgtgtctgtgtctgtctgattccccggggaaaagagggagttcccaggggacggcagcgcgggtccctggggacacacgaaaaacaacggccagagacaagacgcggaaaagaggaagtccctaggggaccgcgagggcaacgacagacgaagtacggcacaacccgcgtcgaggacacacgcagaggcggtcgcccaggggaggggggggggtcgcggaccccgtggcacactgcttccatccagccgcgcacaccgcacccctgacacaccccgccagcacacccccgacacacccgccacacgcccgcgacacaccctgacacacccggcacacgccctgacacacccggcacacccgacacccaccccacgcacgcacccacccagccgcgccccagacacaccccgaccgccgccagtgcgacttcttggcgccgtaagcgcgccgccgcttctgcggcgtgttccccacggcgcttcctgcgcgctgccggtgcgtcaaggagttctgcggtgtttgttcacgggccggcgctggggacggggtgttgcgggcgctcggagggctttcgcggcgggtgtttgcacggagtttctactaagcttttgcgcggcgcttcgcttttcggggcggggacggcggtgttttcgggcgtactggggttgacggcgctggtaacgggagttacgctggggacggggacgggggttgcgccgggaacggggggtgtgcgtgggtgtgcggggccgggcacgggggccttttgcggcggggacggtggtggggacggcgcgttgcgggaccggggacggaggtggcgccggagacacggggtgacgtcggagacaggggccttttgcggcagggacggggcgtttgcggcggggacgggggcctttcgcggcggacacggggacgggggtggcgccggggacgggggcctttcgcggcggggaacacagacggcacgcacacgcagctcgcttcagcggtcgccctatcagaaccgccgctactctttattaacgtcttaatccccccgcttctacacgcaacgctgcatacagctatgctcacactctatctcttcacagcgacatgttgcttcgtctatgcgctgccgcgacaagcacaagtggacaccgccatctgccaccacacatggcccatgtgctccgacgtcccgcatcctacgtcgtctgctcacaacacggcgcttccttccccgcacgccatctccatcgaacaccgtctgctgcattcgccgtcgcctccacgagagaacatacgccacagcatgcgctgtcgccgccgcgacatggcctcctccgcttccacacctgtttcgcacacccaacctctggctgccaaccacagacgttcaaggatcacgtacgcaacgaccgatcccaccaattctccaacggcctcgcccgccaagtcagacaagctggaagccgacgcagacacagcactccatcgacgcccggcctcgctgttgcgccacctcttccagccctgccacgcccaacgcggcacttccaacagagccacatcccagagggcttccttgaacgccgtgcaccacaaactctgcggcgcgatgatatcttcgtcgtgttccaccacttgcacaccgctgattatggacttgccgtcgctgtccgtggaactatctgcaggacacaagaaaaaagaaacaccaaccgagggtgggtggggcggtgaagaaggggaggacgacgttctcgccacaatccgcaacacgttgtccgccccaacctcacctgctgcggctaccacgcatcgactgtcgttccctggagaatcgaccttctgcctcaccgctgtttccgagtgctcacaacgtcgaacatcaacggctgcattaacgccgccgccgccagcggtagctgctgcgttctctttttcgtccacggtctccgagaccggcacttttccgcagagcacaacaggccgcacacgtgtcgacgacaccgccgtcgttaccgccggagacccgcgctctcctgtgacacacgtaactctcctccagatattccgtctgcgtagctcgctgctgacgagcaggtccggcggcgctctccgcggaggtgagcacgaggccatccccaaagtcgcgtcgctgttctggacgctgctcaaagcaacacagatagttgacatgactcacaaaacaccgagtgccgactctcaccgcaacccacaaaaatacaccgaccgcccacaacgcctgctgttgacagcacttgccatctggcaacgaacctacaatgacacgcgtgccgcccacgcgccgcaagtgcgcttgctcggcgacatcctcacttaccgcagaccgcaaactgccaccgcgtctaccaaagcacacacgcagcagcagccagaggaaccaaaaggccaacagatctggacgcagacagccggccaggccgcgccacacggcgacgagccgcatagcgacggcgagctacgccgcgagtcgcattctgcaccgccgacgtctcgtacactacccgatacgattttggcagtgaaacgccgttccgttgcccaacggtcacacgtccgactggacgcgaaacccggactgaatgagcgggacggctttcgccgacggttgttgctccccttatccggctatttccgcgcaaacgagctccggaataaacaatttatgggctatggaacagagaacggccttaagaacacttgtctcacccgccctctgggtgccgcggggggtgtgcgggagccgattggggagcgacaagacagagacgtggcggactctgcgacacgacgcgttttccacacgttgtacgccgcactgcagaccgtacgggtgtggtataccgcgttaggcaccgcgtggcgtacctcggggtctcgtacgcgtgtctctctattcggtggtccacggcgtcgcgatcggcaggcgggccggctgcggcgctcggagctgtagccgtctcggacttgtctagccgctgccgctcccgttgcgtgcctgctgctgcgtaaagtacatcagggccaccagacagactccgatgaagatgacgatggcaacgctgatccaccatctcctgatggcgttgtcgggccaccagggccgctccttggtcttgaccagataagtagtggtggtgacacacttgggcgccgtcatgccgcgactcctccaggttgctccggcgtttgcttcggcgggtccctggtcgagggagacggtccctgcggtgaaggaggaagagcagaaggaataggagtttccctggagcagcgccgtaggcaagtgccgcggcacgtgtccgggtggctttataacggccgtcgatgatggtttttaaaccgggacgacggtggttcacgtgaagtaccaggcggcgatgctgaccatgacgccgagcagcagagtgaagacgatgacgttgaacaggatttccagatagtgtcccatgttccgcgtggttcctgcgcggttcctgcgtggtttctttttttcctgtgttaacaccggcgttttcgggacggtcggttaacgtgggtttcaggggaaggctgtaagcacggggaaggagcgctgataggcgagacaacgcacgaaggtccaagcggcggcggcgccgacttccaccatcaagccaacgaccagcatccgcagcagcagcgcccaggcgatctcgcgctcgacgacggctacggcgacgaggcagaacatctcaacccagacgacaagcgccaggaggtagagcacggccggaaagaccgcgggcgttagcatttggtcgcggagaaggaaacaaaaacggttgaaaacggggactgtagagttgctttgttcaggagacgacgacgggagcagacgggatggcgctggatacgctagcggggctggctatctgcgtgggtctggtcatgggtgtcaccgtgatcgcgtcgtgcgcgctgctggtgttttattattgcgatgagaaggaggatggccgtccgtcgaagctgttgcaacgtagcattcgacgttggcgacacggccttagcaccgaatccttaaccgctatcctgccggacggttcgtccacggagcaggagatctaccacacgcgactttaagtcacggaggaagttacgtgggtaggagggcaccgtgccccgaggcggcgacgggctagcgtataacaagccgcgcgacaacgggcgagcggcggtgagacacacgcgcgcacgtcggcggcgatagccatgagttccgatagcaattttgatccctggattcccgtgtgcgtcgtggtggtcatgacctccgtagtcctgttcgcaggtctgcacgtgtacctgtggtacgttcggcggcagctggtggcgttctgcctggagaaggtgtgcgtccgctgctgcggtaaagatgagacgacgccgctggtggaggatgccgaaccgccggccgagctggaaatggtggaagtgtcggacgagtgttactaggacatcgccgctgccgatgggcgccggcggacgtgactcggcagccactgtagggataaatagtgcgatggcgtttgtgagagaacgcagtagcgatgggttgcgacgtgcacgatccttcgtgccaatgccaatggggtgtccccgcgatcatcgtgatttggataacatgcgcggccttgggaatttggtgtttggcgggttcgtcagcgaatattttttctggacctggcatcgcggctgtggtcgtctgttccgttttcatgattttcctctgcgcgtaccttattcgctaccgggaatttttcaaagattccataatcgacattttaacttgccgatgggtgcgctactgcagctgcagctgtaagtgcagctgtaaatgcatctcgggcccctgtagccgctgctgttcagcgtgttacaaggagacgatgatttatgacatggtccaatacggtcatcgacggcgtcccggacacggcgacgatcctgacagggtgatctgcgagatagtcgagagtcccccggtttcggcgccgacggtgttcgcccccccgccgtcggaggagtcccaccagcccgtcatcccaccgcagccgccaacaccgacatcggaacccaaaccgaagaaaggtagggcgaaagacaaaccgaagggtaaactgaagaacaaaccttcgtgcgagccgacggtgagttcacaaccaccgtcgcagccgacggcgatacccggcggtccgcccgacgcgcctccccccgccatgccgcagatgccacccggcgtggccgaggcggtacaagctgccgtgcagacggccgtggccgcggctctacaacaacagcagcagcagcatcagaccggaacgtaacccgcccccggtgtgataaggaattttccgacttggcccacatctccttcctcagtgtttggacaataaacacattccttgccaaaaaatgacgtttccagaaatccaaggcataaatgtccgtacaccggcccttcccgacacggagcttgagattccaagcaggagagaagatcatggtgtggctgtggctcggcgtcgggctcctcggcggtaccggactggcttccctggtcctggccatttccttatttacccagcgccgaggccgcaagcgatccgacgagacttcgtcgcgaggccggctcccgggtgctgcttctgataagcgtggtgcctgcgcgtgctgctatcgaattccgaaagaagacgtcgtcgagccgctggatctggaactggggctcatgcgggtggccacccacccgccgacgccgcaggtgccgcggtgtacgtcgctctacataggagaggatggtctgccgatagataaacccgagtttcctccggcgcgattcgagatccccgacgtatccacgccgggaacgccgaccagcatcggccgatctccgtcgcattgctcctcgtcgagctctttgtcgtcctcggccagcgtcgacacggtactgcatcagccgccgccatcctggaagccacctccgccgcccgggcgcaagaagcggccgcctacgccgccggtccgggcccccaccacgcggctgtcgtcgcacaggcccccgacgccgatacccgcgccgcgtaagaacctgagcacgccgcccaccaagaaaacaccgccgcccacgaaacccaagccggtcggctggacaccgccggtgacgcccaggcccttcccgaaaacgccgacgccacaaaagccaccgcggaatccgagactgccgcgcaccgtcgggctggagaatctctcgaaggtgggactctcgtgtccctgtccccgaccccgcacgccgacggagccgaccacgctgcctatcgtgtcggtttccgagttagccccgcctcctcgatggtcggacatcgaggaactcttggaaaaggcggtgcagagcgtcatgaaggacgccgagtcaatgcagatgacctgagaccgaaacagcgagcgcgtccgttgtacagttgtatagcagcacacgccttccctctttttcaccgcagctaagagagagaaagagagtatgtcagtcaagggcgtggagatgccagaaatgacgtgggacttggacgttggaaataaatggcggcgtcgaaaggccctgagtcgcattcaccggttctgggaatgtcgactacgggtgtggtggctgagtgacgccggcgtaagagaaaccgacccaccgcgtccccgacgccgcccgacttggatgaccgcggtgtttcacgttatctgtgccgttttgcttacgcttatgattatggccatcggcgcgctcatcgcgtacttaagatattaccaccaggacagttggcgagacatgctccacgatctattttgcggctgtcattatcctgagaagtgccgtcggcaccacgagcggcagagaagcagacggcgagccatggatgtgcccgacccggaactcggcgacccggcccgccggccgttgaacggggccatgtactacggcagcggctgtcgcttcgacacggtggaaatggtggacgagacgagacccgcgccgccggcgctgtcatcgcccgaaaccggcgacgatagcaacgacgacgcggttgccggcggaggtgctggcggggtaacatcatccgcgactcgtacgacgtcgtcgaacgcgctgctgccagaatggatggatgcggtacatgtggcggtccaagccgccgttcaagcgaccgtgcaagtaagtggcccgcgggagaacgccgtatctcccgctacgtaagagggttgagggggccgttcccgcgcgagtgctgtacaaaagagagagactgggacgtagatccggacagaggacggtcaccatggacgatctgccgctgaacgtcgggttacccatcatcggcgtgatgctcgtgctgatcgtggccattctctgctatctagcttaccattggcacgacaccttcaaactggtgcgcatgtttttgagctaccgctggctgatccgctgttgcgagctgtacggggaatacgagcgccggttcgcggacctgtcgtcgctgggcctcggcgccgtacggcgggagtcggacagacgataccgtttctccgaacggcccgatgagatcttggtccgttgggaggaagtgtcttcccagtgcagctacgcgtcgtcgcggataacagaccgccgcgcgggttcatcgtcttcgtcgtcggtccacgtcgctaaccagagaaacagcgtgcctccgccggacatggcggtgacggcgccgctgaccgacgtcgatctgttgaaacccgtgacgggatccgcgacgcagttcaccaccgtagccatggtacattatcatcaagaatacacgtgaatgagaaaaagaaaaaagaggggagcggatcgcggtaatgtcgttttgacattctctgctcgatctactcagcgtctgcacgaaacggcgtccgcacggaggcgagcccaagcgtatctgcagcaagcggttctttctctcggtgatggtggcagcatcggtggcgggagcttgttcggacgatggacggtgaggagtccctggcgatcaggcggctcccgggtgtggagttcaacgggtggtaatggtggcggtgatcggtgttagaaaacggtggccctggcaaacatatatctactgtaaaccctctgctctgttaataaaaagcacacttttcacatgagtcagtaattttattgtgtagtggaaatttttacgtcattgggaaaccccagaatgaaagagtataatgtgcacatcaccgggggttccctgtcagtacgaatgtacacaacgcgggttacattacgataaactttccggtaaaacgatgccgatacagcgtgtataacgctgattgttacgacagacgggttcgtatatcaattatatagtaataaacatgctgtggatattaattttatttgcactcgccgcatcggcgagtgaaaccactacaggtaccagctctaattccagtcaatctactagtgctaccgccaacacgaccgtatcgacatgtattaatgcctctaacggcagtagctggacagtaccacagctcgcgctgcttgccgctagcggctggacattatctggactccttctcttatttacctgctgcttttgctgcttttggttagtacgtaaaatctgcagctgctgcggcaattcctccgagtcagagagcaaaacaacccacgcgtacaccaatgccgcattcacttcttccgacgcgacgttacccatgggcactacagggtcgtacactcccccacaggacggctcatttccacctccgcctcggtgacgcaggctaaaccgaaacccacgttgaatctgacgcggtttcggaaagcctgagacgtcactttcacaatgacgttcgtagacacgttgatcataaaacaccgtggaggctaaggcttcggtagggagagacctcaactgttcctgatgagcacccacgctctcatctcttcagacttgtcatgaccccagctcagactaacgccactaccaccgtgcacccgcacgacacaaaaaacggcagcggcggtagtgccctgccgaccctcgtcgttttcggcttcattattacgctacttttctttctctttatgctctacttttggaacaacgacgtgttccgtaagctgcttcgctgcgcttggatccagcgctgctgcgaccgcttcgacgcgtggcaagacgaggtcatctaccgtcgtccatcacgtcgttcccagagcgacgacgagagtcgtactaacagcgtgtcatcgtacgttcttttatcacccgcgtccgatggcggttttgacaacccggcactgacagaggccgtcgacagcgtggacgactgggcaaccacctcggttttttacgccacgtccgacgaaacggcggacaccgagcgccgagactcgcagcaactgctcatcgagcttccgccggagccgctcccacccgacgtggtagcggccatgcagaaagcggtgaaacgcgccgtacagaacgcgctgcgccacagccacgactcttggcagcttcatcagaccctgtgacgcagatgaacgttccttcttaaacatccgaggtagcaatgagacaggtcgcgtaccgccggcgacgcgagagttcctgcgcggtgctggtccaccacgtcggccgcgacggcgacggcgaggaggaggcagcaaaaaagacctgcaaaaaaaccggacgctcagtcgcgggcatcccgggcgagaagctgcgtcgcacggtggtcaccaccacgccggcccgacgtttgagcggccgacacacggagcaggagcaggcgcgcagcgtctctgcgaaaaagggaaagaaagaatcatcatgtgccgccgagagtcgctccgaactctgccgtggctgttctgggtgctgttgagctgcccgcgactcctcgaatattcttcctcttcgttccccttcgccaccgctgacattgccgaaaagatgtgggccgagaattatgagaccacgtcgccggcgccggtgttggtcgccgagggagagcaagttaccatcccctgcacggtcatgacacactcctggcccatggtctccattcgcgcacgtttctgtcgttcccacgacggcagcgacgagctcatcctggacgccgtcaaaggccatcggctgatgaacggactccagtaccgcctgccgtacgccacttggaatttctcgcaattgcatctcggccaaatattctcgctgactttcaacgtatcgacggacacggccggcatgtacgaatgcgtgctgcgcaactacagccacggcctcatcatgcaacgcttcgtaattctcacgcaactggagacgctcagccggcccgacgaaccttgctgcacgccggcgttaggtcgttactcgctgggagaccagatctggtcgccgacgccctggcgtctacggaatcacgactgcgggatgtaccgcggttttcaacgcaactacttctatatcggccgcgccgacgccgaggattgctggaaacccgcatgtccggacgaggaacccgaccgctgttggacagtgatacagcgttaccggctccccggcgactgctaccgttcgcagccacacccgccgaaatttttaccggtgacgccagcaccgccggccgacatagacaccgggatgtctccctgggccactcggggaatcgcggcatttttgggattttggagtattttcaccgtatgtttcctatgctacctgtgttacctgcagtgctgtggacgctggtgccccacgccgggaaggggacgacgaggtggtgagggctatcgacgcctaccgacttacgatagttaccccggtgttaaaaagatgaagaggtgagaacacgcataaaataaaaaaataacatgttaaaaaatgcagtgtgtgaaatgtgaatagtgtgattaaaatatgcggattgaatgggcgtgttggttattcggatactttgtgtcatccgttgggagcgaacggtcattatcctatcgttaccacctggaatctaattcatctgccaacgtggtttgtaacggaaacatttccgtgtttgtaaacggcaccctaggtgtgcgatataacattacggtaggaatcagttcgtctttattaataggacaccttactatacaaacattggagtcatggttcacatcctgggtccaaaataagagttacagcaaacaacccctaagtaccaccgaaacgctttacaatatagatagcgaaaacattcatcgcgtatctcaatattttcacacaagatggataaaatctctgcaagaaaatcacacttgcgacctcacaaacagtacacctacctatacatatcaagcaaacgtaaacaacacgaattacctaacactaacatcctcgggatggcaagaccgtctaaattataccgccataaatagtacacactttaacctcacagaatcgaacataaccagcattcacaaatatctcaacactacctgcatagaaagactccgtaactacaccttgaagtccgtatacaccacaactgtgcctcaaaacgtaacaacacctcagcacacaacaaccactctgtacacacctccaaatgcaataacaattcaagatacaactcaaagccatactgtacagacgccgtcttttaacgacacacataacgtgacggaacacacgttaaacataaactacgttttatcacaaaaaacgaataacacaacatcaccgtgggtatatgccatacctatgggcgctacagccacaataggcgccagtttatatatcggaaaacactttacgccggttaggttcgtatacgaagtatggcgcggtcagtaaatatgattccgatttaacacatatactccccacgatcctcgaacaccttacagcatatgagcaaaaaacaacaaagtataaccaccatcacaattgggcgaataacatgctgtcatccactagcgtctattaatctaatgtttaacgggagctgtactgtcgccgttaaaatgtccatgggaatcaacggatcaaccaacgtccatcagctatgtgattgtgctctacctgggtaatcgctgtcagccttggcgacaggtgtaatcacagctgtcacataactctcgaagcctccaatcacagcagcacacatagtcctaacgccattggcgtgtataaaagttcggaaaacttgacggttgtacggcacgacaaatcgatgtagtggtatgtgtttccagcagggaccgtgtgcggtctcttaggctcgctatactgtgactagaaactggttacctgtgaagatggctgactatcctgttgtgtcctggaaaagctttcagcgtcgtaggtggactttgcagtatgcgggttagtgaagttatgtcatttatttacgtttacgatctcgtattacaaaccgcggagaggatgataccgttcggccccatgagttatttttattcttccggtaggaggcatgaagcctctggtgatgcttattttgctgagtatgctattggcatgcatagggaaaactgaaatatgcaaacccgaagaagtgcaattaggaaatcagtgttgtcccccatgtaaacaaggatatcgtgttacaggacaatgtacgcaatatacgagtacaacatgtacactttgccctaacggtacgtatgtatcagggctttacaattgtaccaattgcactgagtgtaatgacactgaggttacaattcgtaactgcacttccactaataacaccgtatgcgcatctaagaattatacgtcgttgtccgttccaggcgtccaacatcataagcaacgacaaaatcataccgcacatgtaaccgtcaaacaagggaaaagtggtcgtcatactctagcctggttgtccctcttcatctttctcgtgggtatcatacttttaattctctatcttatagccgcctatcggagtgagagatgccaacagtgttgctcaatcggcaaaattttctaccgcaccctgtaagcttcctgttgttgtttttacatcacggtgcgatgaagtcacacagataattacagatgagctgttcatattttttattattttttccaattcctgcactaaaaaaagaagcactttacggaaccgtgtctgaatatctgtggggaatttaggtactttttgccgacgtcaggaaaaataagctgtcgcctacataagagcccggtgctatcgtgctgtcactctttcttgttgccttcgatgtacggcgtcctggctcattactactccttcatcagtagccccagcgttatggttaattttaaacatcataacgccgtgcagctgttgtgtgcacggacccgagacggcactgccggatgggaacgtttaacccatcatgcgtcgtatcacgcgaactatggggcatacgccgtgttgatggctacatcgcaaagaaagtccctagtgttacatcgatacagtgccgtgacagccgtggccctgcagctcatgcctgttgagatgctccgtaagctagatcagtcggactgggtacggggtgcctggatcgtgtcagagacttttccaaccagcgaccccaaaggattttggagcgacgatgactcctcgatgggtggaagtgatgattgatgatgagaacctgacaagaaagacgagagagaaattcagagctgtcattgtagaattagtctagattcctgataataaacggtatcgattttgaaacctaattgacgtgtgatcgatttttaaacctgtgtgttgtgtgattgattggtatgtggggggatccgatttcaaaggggggtacttatcgggaattgatgtgtcatggacgcagttttgagtgattttccgggaataccggatattacgaattgatgtaagttacgtcagtaattaagtcaggatgcggtttattttcggtttgctgattggtcttgtaatcgtgtatacgtattattatgaagtacaaagtacggaactacgttgcccatgcactaatggtttacacgatcctttatatggcatattttatgctggtcgtgaccctccacgtcctcccggttgtgaaaaagatcaatattatttaaaacctcccaaaggtaaagctgtatgcttaggtccacatcatcatttatcaatatggctcaatggtcaaaatagtagtttatggcacaaagtgctggtgacgggaaaaaacggtaatggaccacacgtaactaagaaaggtgactttcctagaggtcgaaaaaatataatgatttagcttaatatggatatatacgatagctgataaattttccacgaaaaaggataacgcaatatgtttttgatatggtgctaacatggttacatcattcgattataaactcgcatatcaaacttttatcggtaccacacctgtcattgaccgcatatatgttatttaccgtgtgtttcccggtccatcttttagaattggaagattacgacaggcgttgtcgttgtaacaaccaaattctgttgaataccctgccggtcggaactcaactgcttaagccaatcgcagcgagcgaaagctgcaatcgtcaggaagtgctggctattttaaaggacaaaggaaccaagtgtctcaatcctaacgcgcaagccgtgcgtcgtcacatcaaccggctattttttcggttaatcttagacgaggaacaacgcatttacgacgtagtgtctaccaatattgagttcggtgcctggccagtccctacggcctacaaagcctttctctggaaatacgccaagaaacttaattaccactactttagactgcgttggtgatcatgtccctattttaccgtgcggtagccctgggcacgctgagcgctctggtgtggtatagcactagtatcctggcagagattaacgaagaatcctgctcctcatcttctgtggaccacgaagactgcgaggaaccggacgagatcgttcgcgaagagcaagactatcgggctctgctggccttttccctagtgatttgcggtacgctcctcgtcacttgtgtgatctgagacgtcatgctggtagcgtttatgagtcgggcggtggccggcacgccgcatttcctaacccgcgcagcatgttgcgcttgctgttcacgctcgtcctactggccctccacgggccgtctgtcaacgctagccgcgactatgtgcatgttcggctactgagctaccgaggcgaccccctggtcttcaagcacactttttcgggtgtgcgtcgacccttcaccgagctaggctgggctgtgtgtcgcgactgggacagtatgcattgcacgcctttctggtctaccgatctggagcagatgaccgactcggtgcgacgttacagcacggtgagccccggcaaggaagtgacgcttcagcttcacgggaaccaaaccgtacagccgtcgtttctaagctttacgtgccgcctgcagctagaacccgtggtggaaaatgttggcctctacgtggcctacgtggtcaacgacggtgaacgcccacagcagttttttacaccgcaagtagacgtggtacgctttgctctatatctagaaacgctctcccggatcgtggaaccgttagaatcaggtcgcctggcagtggaatttgatacgcctgacctagctctggcgcccgatttagtaagcagcctcttcgtggccggacacggcgagaccgacttttacatgaactggacgctgcgtcgcagtcagacccactacctggaggagatggccttacaggtggagattctaaagccccgcggcgtacgtcaccgcgctattatccaccatcctaagctacagccgggcgttggcctgtggatagatttctgcgtgtaccgctacaacgcgcgcctgacccgcggctacgtacgatacaccctgtcaccgaaagcgcgcttgcccgcaaaagcagagggttggctggtgtcactagacagattcatcgtgcagtacctcaacacattgctgattacaatgatggcggcgatatgggctcgcgttttgataacctacctggtgtcgcggcgtcggtagaggcttgcggaaaccacgtcctcgtcacacgtcgttcgcggacatagcaagaaattcacgtcgccacgtctcgagaatgccggccccgcggggtccccttcgcgcaacattcctggccctggtcgcgttcggattgctgtttcagatagacctcagcgacgctacaaatgtgaccaacagcacaaacgtccctactagcaccagcagcagaaatagcgtcgacaacgccacgagtagcggacccacgaccgggatcaacatgaccaccacccacgagtcttccgttcacaacgtgcgcaatgacaaaatcatgaaagtgctggctatcctcttctacatcgtgacaggcacctccattttcagcttcatagcggtactcatcgcggtagtttactcctcgtgttgcaagcacccgggccgctttcgtttcgccgacgaagaagccgtcaatctgttggacgacacggacgacagtggcggcagcagcccgtttggcagcggttcccgacgaggttctcagatccccgccggattttgttcctcgagcccttatcagcggttggaaactcgggactgggacgaggaggaggaggcgtccgcggcccgcgagcgcatgaaacatgatcctgagaacgtcatctatttcagaaaggatggcaacttggacacgtcgttcgtgaatcccaattatgggagaggctcgcctttgaccatcgaatctcacctctcggacaatgaggaggaccccatcaggtactacgtctcggtgtacgatgaactgaccgcctcggaaatggaagaaccttccaacagcaccagctggcagattcccaaactaatgaaagttgctacgcaacccgtctcgctcagagatcccgagtacgactaggctttttttttttgtctttcggttccaactctttccccgccccattacctcgcctatactatgtgtatgatgtctcataataaagctctctttctcagtctgcaacatgcggctgtgtcgggtgtggctgtctgtttgtctgtgcgccgtggtgctgggtcagtgccagcgggagaccgcagaaaaaaacgattattaccgagtaccgcattactgggacgcgtgctctcgcgcgctgcctgaccaaacccgttacaagtatgtggaacagctcgtggacctcacgttgaactaccactacgatgcgagccacggcttggacaactttgacgtgctcaagaggtgagggtacgcgctaaaggtgtatgacaacgggaaggtaagggcgaacgggtaacgggtaggtaaccgcatggggtgtgaaatgacgttcggaacctgtgcttgcagaatcaacgtgaccgaggtgtcgttgctcatcagcgactttagacgtcagaaccgtcgcggcggcaccaacaaaaggaccacgttcaacgccgccggttcgctggcgcctcacgcccggagcctcgagttcagcgtgcggctctttgccaactagcctgcgtcacgggaaataatatgctacggcttctgcttcgtcaccactttcactgcctgcttctgtgcgcggtttgggcaacgccctgtctggcgtctccgtggttcacgctaacggcgaaccagaatccgtccccgccatggtctaaactgacgtatcccaaaccgcatgacgcggcgacgttttactgtccttttctctatccctcgcccccacggtccccctcgcaattcccggggttccagcgggtatcaacgggtcccgagtgtcgcaacgagaccctgtatctgctgtacaaccgggaaggccagaccttggtggagagaagctccacctgggtgaaaaaggtgatctggtatctgagcggtcgcaatcagaccatcctccaacggatgccccgaacggcttcgaaaccgagcgacggaaacgtgcagatcagcgtggaagacgccaagatttttggagcgcacatggtgcccaagcagaccaagctgctacgtttcgtcgtcaacgatggcacacgttatcagatgtgtgtgatgaaactggagagctgggcccacgtcttccgggactacagcgtgtcttttcaggtgcgattgacgttcaccgaggccaataaccagacttacaccttctgcacccatcccaatctcatcgtttgagcccgtcgcgcgcgcagggaattttgaaaaccgcgcgtcatgagtcccaaaaacctgacgccgttcttgacggcgttgtggctgctattgggtcacagccgcgtgccgcgggtacgcgcagaagaatgttgcgaattcataaacgtcaaccacccgccggaacgctgttacgatttcaaaatgtgcaatcgcttcaccgtcgcgtacgtattttcatgattgtctgcgttctgtggtgcgtctggatctgtctctcgacgtttctgatagccatgttccatcgacgatcctcgggaatgccagagtagattttcatgaatccacaggctgcggtgtccggacggcgaagtctgctacagtcccgagaaaacggctgagattcgcgggatcgtcaccaccatgacccattcattgacacgccaggtcgtacacaacaaactgacgagctgcaactacaatccgtaagtctcttcctctagggccttacagcctatgggagagtaagacagagagggacaaaacatcattaaaaaaaaaaagtctaatttcacgttttgtaccccccttcccctccgtgttgtaggttatacctcgaagctgacgggcgaatacgctgcggcaaagtgaacgacaaggcgcagtacctgctgggcgccgctggcagcgttccctatcgatggatcaacctggaatacgacaagataacccggatcgtgggcctggatcagtacctggagagcgttaagaaacacaaacggctggatgtgtgccgcgctaaaatgggctatatgctgcagtgaataataaaatgtgtgtttgtccgaaatacgcgttttgagatttctgtcgccgactaaattcatgtcgcgcgatagtggtgtttatcgccgatagatatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggcgacttgggcgattctgtgtgtcgcaaatatcgcagtttcgatataggtgacagacgatatgaggccatatcgccgatagaggcgacatcaagttggcacatggccaattcatatcgatatatacattgaatcaatattggccattagccatattagtcattggttatatagcataaatcaatattggctaatggccattgcatatgttgtatccatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccggccattgacgtcaataatgacgtgagttcccatagcaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttacgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaataactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctttattggctatatgccaatactctgtccttcagagactgacacggactctgtatttttacaggatggggtcccatttattatttacaaattcacatatacaacaacaccgtccccattacccgcagtttttattaaacatagcgtgggatctccacgcgaatctcgggtacgtgttccggacatgggttcttctccggtagcggcggagcttctacatccgagccctgctcccatgcctccagcggctcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatggatcttttctgcagtcaccgtccttgacacgatggagtcctctgccaagagaaagatggaccctgacaaccctgacgagggcccttcctccaaggtgccacggtacgtgtcgggacttgtgttcccctttttttaataaaaagttatatctttaatgttatatacatatttcctgtatgtgacccatgtgcttatgactctatttctaatgtgtttaggcccgagacacccgtgtccaaggccacgacgttcctgcagactatgttaaggaaggaggttaacagtcagctgaacctgggagacccgctgttcccagaattggccgaagaatctctcaaaacctttgaacaagtgaccgaggattgcaacgagaaccccgaaaaagatgtcctggcagaactcggtaagtctgttgacatgtatgtgatatatactaacctgcatgggacgtggatttacttgtgtatgtcagatagagtgaagattaactcttgcatgtgagcggggcatcgagatagcgataaatgagtcaggaggacggatacttatatgtgttgttatcctcctctacagtcaaacagattaaggttcgagtggacatggtgcggcatagaatcaaggagcacatgctgaaaaaatatacccagacggaagagaaattcactggcgcctttaatatgatggggggatgtttgcagaatgccttagatatcttagataaggttcatgagcctttcgaggagatgaagtgtattgggctaactatgcagagcatgtatgagaactacattgtacccgaggataagcgggagatgtggatggcttgtattaaggagctgcatgatgtgaccaagggcgccgctaacaagttagggggtgcactgaaggctaaggcccgtgctaagaaggatgaacttaagagaaagatgatttatatgtgctacaggaatatagagttctttaccaagaactcagccttccctaagaccaccaatggctgcagtcaggccatggcggcattgcagaacttgcctcagtgctcccctgatgagattatggcttatgcccagaaaatgtttaagattttggatgaggagagagacaaggtgctcacgcacattgatcacatatttatggatatcctcactacatgtgtggaaaccatgtgtaatgagtacaaggtcaccagtgacgcttgtatgatgaccatgtacgggtccatctctctcttaagtgaattttgtcgggtgctgtgctgctatatcttagaggagactagtgtgatgatggccaagcggcctctgataaccaagcctgaggttatcaatatcatgaagcgccgcattgaggagatctgcatgaaggtctttgcccagtacattctgggggccgatcctctgagagtctgctctcctagtgtggatgacctacgggccatcgctgaggagtcagatgaggaagatgctattgtagcctacactttggccaccgctggtgctagctcctctgattctctggtgtcacccccagagtcccctgtacccgcgactatccctctgtcctcagtgattgtggctgagaacagtgatcaggaagaaagtgagcagagtgatgaggaacaggaggagggtgctcaggaggagcgggaggacactgtgtctgtcaagtctgagccagtgtctgagatagaggaagttgcctcagaggaagaggaggatggtgctgaggaacccaccacctctggaggcaagagcacccaccctatggtgactagaagcaaggctgaccagtaaactattgtatatatatcagttactgttatggatcccacgtcactattgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcagcccgcgtaagaaaccgcgcaaaaccacgcgtcctttcaaggtgattattaaaccgcccgtgcctcccgcgcctatcatgctgcccctcatcaaacaggaagacatcaagcccgagcccgactttaccatccagtaccgcaacaagattatcgataccgccggctgtatcgtgatctctgatagcgaggaagaacagggtgaagaagtcgaaacccgcggtgctaccgcgtcttccccttccaccggcagcggcacgccgcgagtgacctctcccacgcacccgctctcccagatgaaccaccctcctcttcccgatcccttgggccggcccgatgaagatagttcctcttcgtcttcctcctcctgcagttcggcttcggactcggagagtgagtccgaggagatgaaatgcagcagtggcggaggagcatccgtgacctcgagccaccatgggcgcggcggttttggtggcgcggcctcctcttctctgctgagctgcggccatcagagcagcggcggggcgagcaccggaccccgcaagaagaagagcaaacgcatctccgagttggacaacgagaaggtgcgcaatatcatgaaagataagaacacccccttctgcacacccaacgtgcagactcggcggggtcgcgtcaagattgacgaggtgagccgcatgttccgcaacaccaatcgctctcttgagtacaagaacctgcccttcacgattcccagtatgcaccaggtgttagatgaggccatcaaagcttgcaaaaccatgcaggtgaacaacaagggcatccagatcatctacacccgcaatcatgaggtgaagagtgaggtggatgcggtgcggtgtcgcctgggcaccatgtgcaacctggccctctccactcccttcctcatggagcacaccatgcctgtgacacacccacccgaagtggcgcagcgcacggccgatgcttgtaacgaaggcgtcaaggccgcgtggagcctcaaagaattgcacacccaccaattatgcccccgttcctccgattaccgcaacatgatcatccacgctgccacccccgtggacctgttgggcgctctcaacctgtgcctgcccctgatgcaaaagttccccaaacaggtcatggtgcgcatcttctccaccaaccagggtgggttcatgctgcctatctacgagacggccgcgaaggcctacgccgtggggcagtttgagcagcccaccgagacccctcccgaagacctggacaccctgagcctggccatcgaggcagccatccaggacctgaggaacaagtctcagtaagtgaaaaactggaaagagagacatggactcttgtacatagtgattccccgtgacagtattaacgtgtggtgagaaggctgtttaataaaagtagcttttttttatatatctccgtctctggtctcgtgatgtgggggtgcgggtggtcccggatacttgtccttctccccctcatgtgtatggctctgatggcgaggggcacacacggggcttacatctgctcccccaacccagggagacttagaatctcttgtgccctctcggtgttggaccaaagactgtggtgggagatccagtattcatcgggtcgtcttacccgagtcctggtctttcatgataacggtgagaagggtgatgacttacatctcacggatacccgtcactgcacttcctgtacacatccctatgtgatttctttgattaccccgctgaccatcaatgccacgctacggctgctgatacgagatgggatgtacgggcggggggagaaagagttgtgcatcgcccatctacccaccctgcgagacatccgcacctgccgcgtcgacgccgacctaggactcctatacgccgtctgtctgatcctgtcgttcagcatcgtcgcggcggccctgtggaaggtagattacgacagatccgttgcggttgggcccaaaagctataaatcatagccactgacgcaggcacgtcattgacagccggcgacgtcgagagggtaactatgtaccgtgcgggggtgacgctattagtggtggcggtggtaagttcggggagatgggacgtggtgacggtggcggccgcgattgggatcgggtggtatgagcctgaagtgagcatggcttacatgtatcaacacaatgacactaacttgactattttttgtaacactacagcttgcaattcgccctttttggcctcagggatgatgataagtgccccgttgaaaacacgctttctcaccagcaaggtcaactacagcaatgacatggataacgacagaaaaaattatacccaccaactgaaatacatgctagcgggggcacctggaacttatgtaaatagcagcgtcacctgctggggctctaacgggacttttggtgccaagactttcttagtcaaatccatgatcaacaatacggatagtaacaccaatacgtcaatcattcactttgttcagcaagatgaactggtggataatcccgcgtactttaggcgtagcaatcaccgagcctttatgattgtcatactgacgcaagtggtttttgtggtcttcattattaacgcttcttttatctggagctggacgtttaagcgtcacaagcggtgacgcggccccctgccacatatagctcgtccacacgccgtctcgtcacacagcaacatgtgtcccgtgctggcgatcgtactcgtggttgcgctcttgggcgacacgcacccgggagtggaaagtagcaccacaagcgccgtcacgtcccctagtaataccaccgccacatccactacgtcaataagtacctctaacaacgtcacttctgctgtcaccaccacggtacaaacctctacctcgtccgcctccacctccgtgatagccacgacgcagaaagaggggcgcctgtatactgtgaattgcgaagccagctacagctacgaccaagtgtctctaaacgccacctgcaaagttatcctgttgaataacaccaaaaatccagacattttatcagttacttgttatgcacggacagactgcaagggtcccttcactcaggtggggtatcttagcgctttcccccccgataatgaaggtaagtagcacctacctttctgttcaaccccttttcttccctcgtcaacctgataccaaaataaacattaattttatccacaggaaaactacatctctcctacaacgctactgctcaagagctgcttatctcgggactcaggccgcaggagaccactgagtacacgtgctctttcttcagctggggccgccatcacaacgccacttgggaccttttcacctatcccatctacgccgtgtacgggactcgcttgaacgccaccacgatgcgggttcgcgtgctgcttcaagaacacgaacactgcttgctcaacggtagcagcctctatcaccccaacagcaccgtgcatctgcatcagggcaaccagctcattccgccgtggaatattagtaacgtgacgtataacggacaacggttacgcgagtttgtcttctacctcaacggcacgtatactgtcgtgcgtctccacgttcagattgcgggccgaagctttaccaccacctacgtgtttatcaagagcgacccgctgttcgaggaccggctgctggcctacggcgtgctggctttcctggtgttcatggtgattattcttttgtacgtgacctacatgctggcgcgccggcgggactggtcctataagagactggaggagcccgttgaggaaaagaaacacccggtgccctacttcaagcagtggtagggcccgagacgagaggagtggctgctgtgttgtctttatttcgctgacttctacggagttttccctcagcctctgtgttcccaacacgtccccccgctgagcgttggcggcgatggtcatgttctcccaggaccacgtccagatcgtctacggctccacacgcatctgcaagtccctggccccggccaacaagagaaagacccatcgcaccatcgtggtagcgccgcggcggggttttttgcgtattcccccggacgggcaggacgtcaaccacgtcaagatcgtaccgaccaccacctcctccctcgcgccgccccgtgacgacgagcggcggccgaccccgccgttgcggccgccgctcacagtctatccctatggcacgtcgctgatccgcaggtcagctagggacgcaaaactccgctccaagctaatcgtcttccatataactcggcccgcactcggtcagcacccgcagaatcccgggatctcgggccctgcggccatggatcatagtgagttcctcaccagctttcgtcgcgaggtcgatcggcaaaccgtactgaccgccgagaacgcgcccgccactgtggaagtctgtctgggcgacgctctgcccggcggcgtcatgggtggcggaggactgccggcgggtgtgggctcggccagcgccgccgtggccgccgctgccgccgctgtggccggagtgcccgtcgccgcaaaccccgtcatgcccgccaccgccacggtcaccacgccgcccatgatcgaccttaccagccaccaccggccgctgacgctgtttacaccggcctccgcggccgctgcgcccgccgtggccaccaacggcggtaacgccacctacattttgccagccgactgtcggtacgcgccactctttgccagcaagtataagtacgtcttcgaagaggtgtcacgtctcatgcggctgcacgactccacggccgtgcagctgcagatcagcgcctcgtgcggcaacgctttccaggccctcaagagtgccctgctcaagttgcacaacgtcaccgtgttagcgggccagcagctcatcacgcagacgatgccgcacacgccacaggccgtagccacgttcaaattctttcaccaggatcccaaccgcgttctggactgcatccgtccggtggtgccgcgctctacttcgtaccacgagacgggtgtgtaccagatgtgggtctcgggcgccaccaagaaagacctgtttgacgccgtgaccctgtgcgcttccatcgtagaaaagcagccagacgtatttaatatcaacgtcagcttgttgacgtacccttcgatcgcggcgccccacttgccgctgtacaacgaattcaccagctttcgcctgcccacctcatgaagcggcggcggcgatggcggggctggttgcttttcctggccctgtgcttttgcttactgtgtgaagcggtggaaaccaacgcgaccaccgttaccagtaccaccgctgccgccgccacgacaaacactaccgtcgccaccaccggtaccactactacctcccctaacgtcacttcaaccacgagtaacaccgtcatcactcccaccacggtttcctcggtcagcaatctgacatccagcgccacgtcgattcccatctcaacgtcaacggtttctggaacaagaaacacaaggaataataataccacaaccatcggtacgaacgttacttccccctccccttctgtatccatacttaccaccgtgacaccggccgcgacttctaccacctccaacaacggggatgtaacatccgactacactccaacttttgacctggaaaacattaccaccacccgcgctcccacgcgtcctcccgcccaggacctttgtagccataacctgtcaatcatcctgtacgaagaggaatctcagagcagcgtagacattgcggtggatgaagaagagccagaactggaggacgacgacgagtacgacgaactgtggttccccctctacttcgaggctgagtgcaacctaaattacacgctacaatacgtcaatcacagttgtgattacagcgtgcgccagtcgtctgtctcattccccccgtggcgcgacatcgactcagttaccttcgtacccaggaacctctccaactgtagcgcccacggtctggccgtcatcgtcgcgggtaaccaaacctggtacgtgaatccgtttagcctggctcacctgctggatgcaatatataacgttttagggatcgaagacctgagcgccaactttcggcgccaactggctccttaccgtcacactctcatcgtgccgcagacttgatgtgccgccgcccggattgcggcttctctttctcacctggaccggtggtactgctgtggtgttgccttctgctgcccattgtttcctcagtcgccgtcagcgtcgctcctaccgccgccgagaaagtccccgcggagtgtcccgaactaacgcgccgatgcctgttgggtgaggtgtttcagggtgacaagtatgaaagttggctgcgtccgttggtgaatgttaccgggcgcaatggcccgctatcgcaacttatccgttaccgtcccgttacgccggaggccgccaactccgtgctgttggacgatgctttcctggacactctggccctgctgtacaacaatccggatcaattgcgggccctgctgacactgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattttgcctgcgtcaccagctggacccgccgctgctacgccacctagataaatactacgccggactgccgcccgagctgaagcagacgcgcgtcaacctgccggctcactcgcgctatggccctcaagcagtggatgctcgctaacattgctgataataaaggctctctgttaacccccgacgagcaggctcgcgtgttttgtctgagcgccgactggatccgcttcctcagcttgcccgaccacgacacggtgctgctgcgcgacacggtggcggcggtggagggcgcgcggcaactcgagatggtgtacccggcacccgagcacgtacaccgctggagctatctgtgtccgcccgagcaggtgcgcgtggtgatcgtgggccaggacccgtactgcgacggcagcgccagcggcctggccttcggcacgctggcaggccgaccaccgccgccctccctcaacaacgtgtttcgcgaactggcgcgtacggtggacgggtttcagcgtccggcctcgggttgcctggacgcctgggcgcgacgcggcgtgctgctgctcaacaccgtgttcaccgtggtgcacggacagcctggatctcaccgtcacttaggctggcagacgctgagtaaccatgtgatccggaggctgtcagagcgccgggagcatctggtgttcatgctgtggggcgccgacgcgcacacctgcgagtacctgatcgaccgacggcggcacttggtactcaagtcctgccacccgtcgccgcgcaacaccacccgcgccttcgtgggcaacgaccactttatactggccaacgcgtatctggacacgcattaccgagagaccatggactggcgactctgtgggtgattgatgataatagacacaccggggagacaaggtggtgaactgtgatgtctatctctttattgtaaaaaaaaatcagtgaccacaatatatatagacacacaccgaaaggggtggaaacccaaatgtccaagcgcgtcctgtttcataatttttccggtctcggctctgttttttaatcgtcgaaaaacgccgcgatcgaggcggcggcgatcgcagcctcctcgctgggatcgataatttcgagtccgtcctcgaggaacgagggccctcgccggcggccgctgccggcgacttgcgacaaccggagcagaggatcgttgtcctcgtcctcatggcggttgtttctccgtcgcgatctccgagaggaggaggacgacgacgatgcggcctgccgccggctgtttctaccaccgccaccaccgccgcctcctcgggtattgttccgggcccgaccccgacgtccgcccggcggtggtggtggcggcggcagtggagtcgaagaagacgaggaagagttactggcagccgcggcggtggcgacaacggggtttaccacgtagggcttgatttcacacacgggccggggaggagcagctggtgtttcgactgcggcggcaacgggcgcgacaccggcgacggaacctgagggtacaacaccggtggtgacgagtggcggacatgcggctgctggggggccaacgccggctgtggagacagctgcggcggtcctcgcgacgctgctgtggttgacgacgacagtcccgcccgacgtctctggcaagagtctgctggaaaccagggggagatcgcacaatcttttctccttacaatcattgagcattttggtcaatgactgtataatgtcatcaaaacgcggactgcgaggaggctgaggcgccgcggattcctgcgaattcggaggaacacggcagttagagactggagtggtggaatcattctcctcctccgactgcggtggtgcctccgccgcctcagccggagccctcctcatcctcctcatcatcattaaccccgcagccgccgccgtcgccgccgcctcggactcctgcaccgtctcgcccgcgctgtgggcgctgctgggtcgagggagcgaaagaagtgacgacggcgacgtcgacgacggcgacgaaaccaccgctccgcgctcaatgggtagaagtaacgcaccgtcggtgccggcggccacgtccgtcacggcgttatggtggtgatgatggtggtggtggttattggaggaagaagagaccgcggaggatgaggacgagtaattgagaaaggccaccgcttcagacgtgtccagcggcagcgacatgcggccgctgccgccgccaccaccaccgccagcaccaccggactgctgctccgtctcgttcttgccgccgccgccatggccttcgtgctgtgcggtggtcttttgtctcttcgcctcccggaggggaggagagcctacagacgggacgacacatagcgcacgaaaaagcacatggttatcatccacacaaccaccagcgcaccaacaccgctcgcctgctcgctcgtgcgctacggggggctcacgagtccactcggaaagcaccgtgacgcgaggagggccgggactcaccgtcgttctcggaggagggaggcggccgccgctccttctgccggttcatcaaccggggatcccgcagcagtccgttggcggagtccgaggagtgctgaccgccgctcccgccgccgccaccgccaccaccagtgccgccgcctccaccaccaccggcagacgaggacgattttttgcgccgttcttcgtgacgctgttcctgccttcgccgttgctgttcctccgcagaagggccgtcgcgagtcccgccgctgccacccagcgaggacacgcagacggcggaggcggtagacgcggcgccgcaaccaccgcctccgctggaggattcgccgtggtttttcaggtaatgccgcacgtaagtcacttgcaaattaccgttctcggaaatcatagtgagcagcgcgctctcattgggtccgctggagcccaccaccgaggagacggatttgttaaagacgataccgccgcgtacaaagaggtgctcctgaagttccccgtcgcccgtaatgtcaatggacatgaagccctgctgcgtcttggcgccggccgaagcctcgccgtgctgcataatggtagcgcagagccagcccttgttgaggtgcaacaccttgccatcgccgtccacgcagttgaccagacgcgcggtatcaaagacgaactggcgcacgtcgaaagtctgattgacgctctgatgcaggatgcggttaggattcgcaaaagtccaatattttcgcacgacggtagtagggagatccatgacgcggcggcgcaaagcgcgagcgcaacgctcgtcggaggccgtggagcgagtgccgccgcagccggcagagcgccgaaccccgtcgcagactctatttatacatcatctttccagcccgcctagcaacacccacaaacaacgtcacgacgcaacgtggttaaacagtacgtttattaaagtaactgggtgaacgacaccggagcggactgcaaatcgcaacgctactttctcgagtgcagatactcttcgagacggctaaacaacgtgtccaactcgctgagacctttccgcgtgccgttatccgatttcctttccgcctcctgagacagccgactaatcacggacttatctccgcaacctaacagaggctgggagcccgacaaaagtaaaacagcgtgctatgaacacgttgttacctctgcgcggacagcgccgccacagagacacttacgcattgccgcatgtctttgtagatggattctagcgtcgagcgcatactatgcaattccgtcttaagtccgggatagacgtggtcgcctgcggggaacacgatctccagataccgcctcaacaaccagtccataacgctgcatccccaacagcctttgaccaccgtaccgtcgagccacacggagtagtcgtcctcacgttgctacaagaggaaaactacgtcacccgacacgcggaaaagaaagaccgtcgcaataaaccgtacctacgtgacctaccaacgtaggttttactcgatgaaaggtgacgcggagatcttgcaatctggtcgcgtaatcctctggacgacactgcggctttgtattctttatcgtcgtcgtcgtcgccggcttcgcctcctcggaagcgcctagaaaaaagacgatcaggaccagagaggaagagaccatcaccgacagcatcgccgcagcatgccgccccagtccgccacccaactgcgcgtcccaggtaggtggtcctttatgttatgatgtttttgtcaatttttttttttcaatttctttcttccgcggttagaatagtttctgtaggaaccaattatcaatctgacgggttatcgtcaccacttgatggcaaaacgaaatttttttttttcattgccttgaagtctctcccgccaccaccaccaccgccgttatctccggctggagatcaagacgaaattcctcctctcttaaaaaaaaggtggtgggctcaattgatcatggcaagaagaaaaactatactgaataaactgtgtgcaaaactactagtaacaacaaaaatagcgactagatacaccacggacaatctcagcagatactctctcaaaagaaaaaaagacgccgtaacgtcggagaatctggtatctactgcctgacgaatttttttttcgtccatgtatgtgattacgagtagtagtggtatgtagaacaagaagaaaaatcgtagtccccaaaaggataataaaaataacactcatagagaatcacagattttctctagacaactctctatccaaataacgaatgtgaagcgtacaaagtaagatattcaaagaatagcaccttcatagattcatttcagctttctactccttgtaatttaaagttgcactaaacaaagctcttaaagaaggttcgagccgctctcgatcactcatcgatcacgcgagtcttattattccaccacaacgtaacattcttcactttgtagagacactttatcgtagagtaaccctcgatttcctagctgttgttttttgattattttgttcgctctaagagagatactcgaaatcctacttacaccaaggaccctacatcatcgcaggaagaataaacataccgtagaaatctcgacacgcaaacgcgaatgtacacgaaccaaaagccacagacccactatttctgtgccgtatttttttttgacaatctgtctgaatctgcggaaatagttacggagaagcaattctgttaaaaaattcagtacgttagcagcaaaagataatcatttcgtgtgatagcaagtaaatcacctcacttaggatcgatttcgtgcgaaaaaattattttttctcctaatcaacagataatatggttaccatttagagtagtgtcactttactttcacggaagatgcaacccccgagaaaaagaagaatcgatcatagataaaagaaatcaagccagacttgttaagaaaaaaaaaagatcaaaaaattactacctaaaaagaacgcctagccattgggagacgcgcacgtctgtgtggtctccgcgatcatgagaacgaaaaaaaaagacacgacaatacacaggctgacctttgaaaaccaagcctattgataataatctaccccatagaacaggatataatcaagcatccaaacaacaaacagcgccgccgtgcctcctccagaggacggtgacgacgtatgtctgtcgtctcccttctcgctctggcttctggggctctcctcctctccccatcatcttctccttcgtcccagacggacggctatcggttcgcgcgctcgtcttttcttcgatgtgcgcaggtttcgtcatcggagaagaagaccgcgaccgtatcataatgatgatgataataataatacattcaccgaccatctttatcctcttttgttgttccaaagagaaaagaaaaaaaaaacaagcagccactctaaccatcacactcacgagttaatatggggttaggggggaggaagagaaataccgccatgaaggcaagagcagcagcagcaacgacgtcactacgatgattgatgatgatacacgactaccactggaggagaggaaaacggagaaaactcatcgtgatgatggaaacaagaatgatgataataatgatgacgataaagccaccacacgatatatacagagaacaacaaaaccaccaccacgacgatgaaacaaaacgctcaaccaaacattgtgtaaccgctacgcgtccgtggccgcggccggcggcctcttgtcttgtttttgttgtccccttcgcgggggacatcatcgccgccgacccgcgtgtgccctgcctcacggctggtccgtgatgaactcttgctcgtaaccgccaagcgataaacaagccaccgtgatagaagacaccttataagaccatatcctagttacatagtagtgcatatatatagtaatagtagaataagtgaactttagacacgatagatgaagccatagtctgaatagtcatgatgttaggaacactatacgactagtacatacatacatacacccccttaggaggaacgatgaatcaaagaataatacatcatgtagcataagtacattaagcctttaaacgaacaaattgctaaccaaaatcgatcaccaccatagacgtactatcatcattacaacgaaaaactagacggatggatagctgtaagtctcacctagctaactaacgatcacattttttctccacgatatagtcaccacaaccatgaatgatagccgcctatttgaagtttgatatctcgatgaatctctatagtcatagcccgttctttttttccaagtatcctttagtccataagcattattataaccgtattacccagaaatctttgttatgagtctcttcgctgtcaactgattagtagcaagttgctgtgattttttttccaatcccataggcatccttagttaaaacattaagaagtaagtaggttctggatagctaatcatcttttttttttacttcggtagattaaaacaaatgaaacacgtagctgttgttttttggtgaatatagtttggtaagtccttagcgggtaagttctaagaaacattagttactttttattgttctgtctcctctccccctaccttacgttgggaggtagcttcgtcatgtaggataataattaggtaagcaaacaacatagatagtgattttagtatagataactcgtgtaagtgttttagtgacttgtaactcgactcggtagacttctcagagtttcgcctcacacaggcgggtacactcgttaagaaacgcaaaatacctaaaagggtacgttacatagcagataagttgatagatgaccgatattatacttcattaactcacgaagatgactgtaagtaaggatattgttgttcatgatagtagccaggttataaggatcatatatatctcgtcagggaaatacaagttagaccataatgttgactactttagagataataagacaccataggattctgaatttaccatgatataagttaagaagattgatatctgtcctttttttgaaacgaagataggcctttttattttttcgaattcatgttcgaaaacacaagcttccataacaagaacccgtaccgaagaaaagttccatcgactaaaaagaaaaaagaaaacgaagcaagacctcgacgacaacaacacatcaaagaaagacgaccagctgattatgttcttaggaattccacacacccgcgagccgatccgcaaacgtcgtgcgaggcgcgctttctctggctcgacacaatgatcacaccgcacgctatagacacgtcgtcgtggacgacgatgacctcaggccacgaatgacaaccaacatgggcaaagtccaattagccaaaaagacgacgattctaagaattgatgaatcctcgatatacgcctatcgataggtttcaattgtgtcatatacatcaaatgaaaaacaggacgcacgataaaagcttccttacagcataactgtaacatacgatcatcgaacatctcctcacatacctttctcctctcacataggaaaacaaaactctttttttttctttcctgtcaaggaaaaaatcaatgtaccaccacatcactttctgctcggtcccggcgacggatgggcgcgcacgcggacaaagacccaccggccacttccacttattttttattgttaatcgtcttctcccccgcacgcggagcaccaccaagcctagctgctcattcgctcaaccagtcacaccgcgcacgcgagaaggggccggggtccgcgggcaccgccgccggaggcgcggttccctctctctaattccctggaaaacaagtaatgacaaacaaaaagacgacaaaaggtctctattctgctacatgagagaaattatagctgttggcaatttttcaaaatacatgttataaggcatcctctctgccacacgcgcagtcacggataggatcagtgcgtattcattataaaaaaaacacaaacaacccatatatgtgaagcagaatgatgaccgaccgcacggagcgacgccgtcgactgacccacgcgggatgtacgccgtccgcgaacaaccaaaggacgacccgtctccccccgcatccgggtttttctcttggtcgaacccggcttgcgacgacgggttgttgctttaccggacgacggtcagccgcggggttgatacccagcgacggcgtcgctcccacccgggtttcttctcttgtaggtaccactcgtagactgtcagccttacgaggagacaccgcggaccggggaaacggataagtttacgaacagaaatctcaagagaaagatgctgacccgataagtaccgtcacggagacacggtggtttttattgaatttccagtgtatcgagccaccgtgatgcaggtacggtggttttatgtgaagtgccgctatctataggcgatgtgttccctgacggtgtgtgtttttttggggatagacaacgtggttcttgtacgtggtttttaccctgctcaataaagtcacgttttccttacacggtgttgtgtcaaaaaataagcgtggtgcgtttgtctttgagcgcgcgacagatatagggggtgatagcggtgttcttctcatagggaagtcgcaacgggttgacgttcatcatgaggtgctcggggtccgtgactcgcgacatggccacgtagatgtggctcatcttgaggttcttgggatggtccccaaagtccacggccaccttctcgagcgacaggccctgactcttggcgatggtcatggccgtgcgcgaagtgaggccgtagtccacggtggtgcacacgtgcagactcttgccctgcgccgactcgacgaagcgcgagacgttaacgtcgagcacaaagaggaacccgagcgcatcgcgtagcaccagccgcgaaagaccgcgctgcaccacctcggggtggatgcggtggcggtcactgggcagactgagcacgttgtcgctggtgtagccctcgagcgtgtacgtctgcgccggcgacacatgcgaaagcatgcccacgaaggagccggtctgcgagctgatctgacagttggccttgaacaccacgttacggcgattgtaggtaacgagcggcaacgtggcgaagcgaccgcccgtgagacgctgcatgagctggtagcgcttgagaaaaatgtcgcggaaggtagtgtacatgtgcaccgtctcctcgaaagaaagcagcgccaggctaggtggcttgacgtatttgagaaaaaagggatccgcgtacagactggtgtgatccatgagttcggcgtccgtgatggcgtccgagtcgtcatggtggttggacaggcaggggatgtcgtgggtctcctcttggccatgttccatccgttgagataccggcacgctctggccgccctgagaagaatccgcgtcgacgtgattatttatcggattctctcccccgctccaagcgggagcggcggccgtggcggcggcagcggcgcagagcgaactcacgtcgggcagctcaacgcgcgccagctcacgcaacatctcctcggtcgtgtagggcgacacgtaaaagtagtacatggccgagaagagcaggcccgaaactaacgagtaggcgtaggccgcctgctcgcagggcgtgcgttcgataaacgtgtccttttgcaagatgtccacgaaacgttcgaccgtgccctggtatccgataacacaggcccgcaccttagagttgactcccaccgaactgcccttgatgtaggtaatgcgcaaggtgagcagcgtctcacggctatcgggcgcggtggtggtatcatcgtcctggaaaaacgccgtctcgtcgttgccgccggtgctcccgattacagatcctccccctccgtgagcctggacggaggggttgttggtggcaacgacgtcggccgcggggcgcagcgcctccttggtgatctcgctggagaggttgtggtcgacaaactgcgagtagttaatgatgcgcgccaagttctggcggaaccagagctcgacgggctgcggcgagtcgcccagcgggtcggccagctcgcagagctcctggtacgcgcggttgttgaccacgcagtagacgggcaaatcaaagagacggtggcgctcgctcaggcggatctgctcgtgcagccgcttgaagtaagcctgcacctcgacgtgcgagagaaaaagccgcgtcatctcggcggcgtacgagggattgcggatggagctgggcggccgcacgaagcggtccacgtaggccacgtgctcttccttgagcgggataccgaactccatgtacttgagcaggtcgccaaagtccaggtcggtgcaacgcttgttgtgaataaacatgacccagttgtcggcgatgtcgcagtagttgatgagcacttcgttctgaatcagcgccgagagcacgtcaacgcccttgcgcacgctcttgttttgcgtgtagtggtcgtagcggctctccagcgcctcggtctgcgtgggcgaaccgacgcagatgatgcagggcacgcggcgttcgcggtaaagtcgcgtgtcgcccagggcgttgtaaaagtagtaaaaaaacaccaccacctgcagcatgtagcgcagcataaggccgcactcgtcgatgacgatgatattgctctcgcacagctccgagaggtcctcgcaggcggcggccgcggccgcggcggaggccgaagcggccttgcgctcccacatatttaagcatttgtccacgatgtcggcgatgaccggccagtaggcgagcagatcgttgatctgcaggcgctggatggtggtctcctcgtgcggctcgcacacgcggtagcgttccagcgtctcgtggctaacggcgctgtcagccagcggcacgtgcttgctgacgaagccgaagacgcggtagatggtcttgacctgcgccgagcgagtgcggttgaggatcgcgctgaggttctgcgcggcgatcaccgtggtaccggtgatcacgcaatctagattggccgccagcacctggatgctggaagtcttgccggcgcccgccgtgccggtgacgagcagcgcgcggaagggaaagaagggccaacggtcgacgcagggcacgcgcgtgccgccggcctcggacgaagcggcagcggcggcagaagaggaggcggaggagtgaacggtcgccgttgccgcggtggtagttgcggcagaggggttgttatctgtcgttcgttcaacgcgactgatggagcgaaaccactggaacgaaaaatcctcgggcgcaaagcgctcgcgcgagagggacttgaccttgtcgacgatccgttcgatcttggcggccgacgagaggttgaggatcaaggcgtcgtcgtacttgggcgtgggccgcggcgtggatgacgaggccgtcatcgacattttccccacgggccagacgatgagcttcctgcggttgctgcacggctttctggggacgtgtcgcggccagagcatgcaccaggtgctgcgcgacccgtgcgtgctgcgcaagcagctgctctacggagtgtgcaagacgctctttgacaccatcacggtgcggcgcgtggccgaggagtggaagttgcacgcggcgctgtttccctaccgcgcgctggacgaagaggacctggagcagtatctgttggtgtggagcgcctcgttgcgccagagcgtgcaaacgggcgtgctgggcgcgctccgcgacattttatatcagtacgccgataacgacgactatggtctctacgtggattggtgcgtaacggtgggactggtaccgctgctggacgtgaagaccaagccgagcgaggcggccgagcgggcgcaatttgtacgcgcggccgtgcagcgggccaccgagacacacccgctggcgcaggacctgctgcaggctaacctggcgctgctgctgcaggtggccgagcgcctgggcgccgtgcgcgtagccaacgcgcccgaggtacgcgtcttcaagaaggtgcgctcggagcggctggaggcgcagctgcgcggcaagcacatccgcttgtacgtggcggccgaaccgctggcttatgagcgcgacaagctgctgttcaccacgccggtggcacacctgcacgaggagattctgcgctacgacgggctctgccgccaccaaaagatctgccagttgctcaatacctttcctgtgaaagtggtgaccgccagccgccacgagctcaactgcaagaagctggtggagatgatggagcagcacgaccggggcagcgacgccaaaaagtccattatgaagtttttgcttaacgtctcggacagcaaatcgcgcatcggcatcgaggacagcgtcgagtcctttctgcaggacctgaccccctcgctggtggaccaaaaccgtctactacccgcgcgtggtccgggtggacccggcgtggtgggacccggcggcgccgtggtgggaggacccgcgggccatgtcgggctgctgccgccgccacccggcccggcggcgcccgagcgggacatccgcgacctgtttaagaagcaggtcatcaagtgcctggaggagcagatccagtcgcaggtggacgagatccaggacctgcgcacgctcaaccagacctgggagaatcgcgtgcgcgagctgcgcgacctgctcacgcgctacgcctcgcggcgcgaggactccatgagcctgggcgcgcgcgacgccgaactgtaccacctgcccgtgttggaggccgtgcgcaaggcgcgcgacgcggcgcccttccgtccgctggcggtggaggacaaccgcctggtggccaacagcttcttctcgcagttcgtgcccggcaccgagtcactggaacgcttcctcacgcagctgtgggaaaacgagtatttccgcacctttcgcctgcggcgtctggtcacgcatcagggggccgaagaggccatcgtatactccaattacacggtagagcgcgtgaccctgccctatctgtgtcacatcctggcgctgggcacgctggaccccgtacccgaggcctacctgcagctctccttcggcgagatcgtagccgccgcctacgacgacagcaagttttgccgatacgtggagctgatttgcagccgcgagaaggcgcgccggcgccaaatgagccgcgaagcggcgggcggagtgccagaaaggggaactgcctcgagcggcggcccaggaacgcttgaaaggtccgcgccgcgccgcttgatcacggcagacgaggagcggcgcggcccagagcgtgtcggccgatttcgaaatggaggccctgatgatccgcggcgtgctggaggtccatacggatttcactagacagaatgtgatgatcatggagccgcaagtgctcgactttacggtgcgcggcgacaagctgtggctgcatacggagcacgggctgctggtttccatggccgagtaccgcagcgagttgctgtgcacctcggcctttctgggctactccgccgtgtttttgctcgagaccgaagacgccgtcacgcaggtgaggctctcggatctgcggctcaaacaccgctgcggcatcgtcaaggccgacaacctgctgcacttcgcgctctgtaccgttatttcatgcgtggaaaattgcaacttaacgcgcaagtgcctgcacgacctgctccagtacctagacgcggtgaacgtgcgcgaaagcttcggccggctgctgcaccacagcgcccggcggctgatctgcagcgcgctctacctactctttgaggaaaaagaaccgcacattgtgcagtacgtgcccgctaccttcgtgcttttccagcagacgcggcatacctgcctgcagctggtagcacgcttctttttccgccttaccggtcaagacgaggcacactcgtttagcctcaagctgaccgagcgtaagaccgtggacggttggcccgtgggcctgggcctgctagacgtgctcaacgccaactaccccaatttgccctcaccccccaagctgccaccgcgctgggaacggggagaggaagagtgagaagcgaactagacacgcatatcatagaaaaaaaaaaaacacgcaacacgtagtgagctttgacgtcccttttactagtatccacgtcacacgctgagaactttgacgcactttttttttactagtatccacgtcacttacccgcgtagttcccctacgtgactcgttaagcgttgagccggaaaaacctcaggccctcggaagccacccgcttagcagcgtgttgcgcgtcaaccgccagcgaacgcacccactcgtcgcgctcctcgagccaagtcgccgacgaagaagaacaagacggaggagacaccgtcgccgtgcccgaagaggacgaagtgacggacggcaaggcggaggagagaacggaagaagaacaagcggtggtagaagcggtggaggacgacaataactctcgcgcccagacctccacgcaagccgtgagcatggcaaaagccttgtccacatagacgccgtagccgatatcggccgctaacgccgtatcgcgtgactgtacgatgatctggccctgctcggcccacacgccgtggaagggcgcgcagtcaatcaccccggcgtgcggccttacttcgttttcaccgggctggaagcgcagtaaccaaaagtccacgtcgttgcggcgagccacgaagcgaaagaggatctcgcggtacacggcttccagctcggacacgctcacgcgctcccgtaacagcgccggcagccggcccaggacatgacccacggccgagagccagtcgccaccggccgcgcagcaacagccacccaacgccgcgggcggcgtggagggagaaacccgatcactaccgccgttatgaccactcccggcagcggcatctagaccgccgccactcgcgtggtccgcgtcgcccacaccactaccaccgccgccgccgctagaatggcggtgagtgacgacgcagcccgcgcaacaagcgccgccacaatgtcccgccgcgaaaccacccaccaccccgtggagcggactaccaccggcgccgccgttgccgtagaagaagttgaagggacccaccaaccgctcgtcgccccagaccaacagcaccccgggcgcgctctcttgaacacgacaggtgggacccggatcgtcgccgccaaaaagtttgcgccaataacagtcgaccacagtccgcacgcacacttcggccgagacgggtccgtgacccgaatagccgtcgtatacataaaactcgcggtggccgcgcgacagaacccacaaaaggccggccgaagcgcaggctgacgtaacgtgctcggagatgtagcccagcagactctggatctgccagaaagcgcgtcgcgagcgaaaacgcagattctcaataaacttttcacaaaccgcataagtgtggagtcgatgactataacgcacgtagggattgaagtcgcgcgcgcgtacacacttggccagcacgcgctcgaccaaatccacgatgagcactcgatgtagcgtggcgtcgcgaacgtgcacggtgaaagtggcgtcgtcgctcggcgggtgcgcaccgccggtgctgctgctgacttccacgacgttgttttcaccgtcgccgtcgtcacgtggcagcggcggcaacagccagcgacgatcgccgccggccggtcgctcgcgaaaagccgtggcattgagacgcacggcgccgccgccggcctcggtaccgaagacctgccactcatcctcaggcacgccgagcgagagcgcgcagggttccacctccagcttgccggccgagcccacgatgtcgggcaggccgcaccacgagagcacctcagccgccgcgtccaacgccgtctcgcgcattaacgtgtgcagaccgtggaccgcgtagacgggcacgggcgggaaaccgggaaaaaagaaagaacgggcggcgcccgtctcaaagaggtccggccccaggtagtcgcgtagcggcggctgcccagcgaaaccacggaaaagcacgtcgtaaaggtgagtccaggccgactgcagcaataaacaacactgctcgtcggtcactgccacggccacgaaaccgacaggcgtgaccagacgcagacaggtgcgcaaaaaacacacctcgcgcacctcaaagaggcgtgccaggacggcctcgtcgtcgcgctccagcacatacttgtgagtgccgacgcgaaacgacatggccaaatcgtaggcgtagtaaccgcgacgcaattttttgtgcgcgtgggtgccatactcttcggagacgcgttccgcggcatgcgtgaccacacgcggctcgtgcacttcgggatacgagccgatgaccactagcttggctacgtggaaaagactaagcgcgttcgacagcgctgcggtttccacgcccagtgccggtgcggcctccaaaatctccacgccactagcgtccgtctgaatctgcaccggcgtgaaggtgcgcgccaacacgcggattaacgcgctgccttctagcaacacgcgcgccaacacggcgctacgctgctctaggccgcgccgacgctcatcggcgtccgtagtcacggccgaggccagcgcagcgtagctggcgcgatgcacagcacgcacctcagccggcggcagacggtcaccgcgcaccacgaacgtgtgaagccgcggctcggcacggccgccacccagatccaaaaacagacattgtacgataggcaccgaggcctctagaaggccgtaccagctgagatgacagctggtcccgaacagggtgtacgggtggtggcggtggtgcagcggcggctgagcggtcatcctcggacagaagagagtcgcgaaggcccgcggggtcttttttcaccgaccgcccggacgtgctcaaaccgcgtcgtgagccgcggcggctcccatcgtagtatttaacgacccgcgagcctgtcgtcatcggcgcgcccccatcgcctcccgagcgagcgggccgccgctatcgccatggccccctcgcacgtggataaggtgaatacacggacatggagcgcttctatcgttttcatggtgctgacttttgtcaacgtcagcgtgcatctagtgctgagcaattttccgcacctgggctacccctgcgtctactatcacgtcgtggactttgaaaggctcaacatgtcggcctacaacgtaatgcacctgcacacgcctatgcttttcttagactcggtgcagttggtgtgctacgccgtgttcatgcagctcgtctttttagccgtgaccatctactacctggtatgctggatcaagatcagcatgcgcaaggacaaaggcatgagcctaaaccagtcgacacgcgacatttcgtacatgggcgacagcctcacagccttcctcttcattctcagcatggacacgttccaactattcacactgaccatgtcatttcggctgcccagcatgatcgccttcatggccgccgtgcactttttctgcctgaccattttcaacgtgagcatggtcacgcagtaccgcagctacaaacgctcactctttttcttctcgcgtctgcaccccaagctcaaaggtacggtgcagttccgcacgctcatcgtcaacctggtagaggtagcgcttggtttcaacaccaccgtggtagccatggccctgtgctacggcttcggaaacaactttttcgtgcgtacaggccacatggtgttagccgtcttcgtggtctacgctatcatctccatcatctactttttactgatcgaggccgtcttttttcaatacgtcaaggtgcaattcggctaccacctgggcgccttctttggactctgcggcctcatctaccccatcgtgcagtacgataccttcctcagcaacgaataccgcaccggcatcagctggtcgttcggcatgctctttttcatatgggccatgtttacgacgtgtcgcgccgtccgctactttcgcggacgcggtagcggcagtgtcaagtaccaggcgctggccacagcctccggcgaagaagtcgctgcgctcagtcaccacgacagcttggaaagccgtcgcctccgcgaagaagaggacgacgacgatgatgaagacttcgaggacgcttaaccccgccgccacccgcaccagacttggagacatggacataaaaaagagacacgcagaccgtgggtcgggagcacatactttttttttattaaaggtttatctgttcttccaccagctactttacgtgtttcaaacagcacattagacacacgggggcgcaaacacacacaaaaaaaaaataatatacacacggagaaacacccacgggtgtcccattcccgactcgcgaatcgtacgcgagacctgaaagtttatgagttaaaagggcaaggaggcggcgggcttttttgtcccgggggtgggtggacgttgtgaaatcttcttttggcgcggagtcctgggtgtgtcgggccgcggcagtcgcttagccaccacctggacgggggggaccgggggcggggacaggtaaattgaggtgtcctcttcgtctaggtcgtccgtctcctgcataatggagctttgctgatggtggtgatgttttgagggtttctttttcttttttgactgcttgctcggtttcggagccttgtcctcgcgaaacgtcgagcgcaccgcgtttttcttggagccgtcgtgggtggcctcgcggtggctgccgctactactgtcgtttcccccgcagccactaccgcagagccgcagcttctgttgccgctcctcgttatcgtcatcctccccgtcgtcatcgtcctccccttcgtccgaggaggaagtcggagggatgttgtcgtaggagcgtagagacacctggcgacccagagcatctttcaggggctcaccgggcgtggtaccgaactcacaacatattcgtttgcagagttcggcacccatatcggtaggttcgtcttgcgggacaggtcgcgactccaacggtctagcacggtagagacggcatggcgcgtaaactgagggtcaaagaccacgggcgtgacgatgagcaggagcgggatgtggtcgcagtggaaaacgcgaccgccggccagcaactcgcagcccagttcgctttcctcgcgctcgcggaagatggccgagaccaggtagacggtaggcaggtcgcggaaatcgatccgctccgggtccggatgcttctttatatagtattggctgagcacgtactgctgaatgagcatctgaaagtaatactggtgacgcggattgacaaaagccggcagtgaaaagcgcgctacctcgtacacgttgagccggcccagcagctcgggcgtgttttcgtcctcgaaaggtatcggcggcggcgaatcgcccgggctgccccgcaggtggtgatcagcgccgccgccagcggcgtcgcccgcggctaggccgagactcgcgttaatagtgatcgtggcgtccccgtcgctgttgtcgtcactcaggtgcttggcgtcaaacacgatcacttccgaacactcggccttattgagatacagcagatcggccaggtactcgcgcagcggttcgggcggcttgagcgggcgcgcgcgcttgagcgtggccctgaagagcgccgcgtcgtgcgaaagcagaaactcgcgtgccgacggggtctcgcgttcaccgcgaaactccacgcccggcaccgggtgtgactgcaacagcgaggccacggccgccgcgtcgtgcctccgcagcacgttctgcacaaaggggtcctcctttttgcgcaaatatttgtagcggcacttgatctcgtagacgcgcgcgcacggttccaccagcaaggtgcgaccgctgccctgcttgagcacgccgaagcacaggtccatggaagcgcccagcagccccgacgtggggtcgatgagcagaccgaggccgtcgcgcaccggctcgcgtccgtgcatcacgtaacattccaccagcgttttgactaagccctcgtgtttgataccgaactggatgcccggcgagacgccggcgcgcgagcccgtgtagtgcgagccgccgccacccgaaccgtccgccgccgcggcgccgggcagacagccgctgacgaaggcctcgtagaacttggtggccgagaccgtgtccatacgcaacagatgccacaccgagttgcgcgactgtccgcgcgattccttttccagcaactggaagagctcgacctgccgatagttgggcgccaaatccagcaaccggctgagccacacgtagtcgtccgagccgccgtgccggtcgtcgcaccgctcggccacgcgctccagggcctcggcgatctcggcgcgtgaggcttcggcggcgtgccgctgacccaaaatgtcgcgcagaccctcgtcgcgagccagcgcggccacgcgcgtcataaagtcctcggctactggcgtaccgtgggcccgcagcatcttggcgaagatgcggtaggcgtaagacagacgcagcaccgtaaagggcagattacggaagccctcctggtgcagcaaaaaggtgttcatgagaaagagactgaggggctcatcgtcccaaaccgccagcagccgggtgagctcctcatcgtcgtcgtagtccaaactcgagacgccccacatgatgatggcggcgcctcggtattttccccgccggtgggtttgtaccttctctgttgcctttcccctcagcaaccgtcacgttccgcgtcccggttactcggggaacagttggcggcagtcaccgtcaaggtcctcctcgcagattatgctggtggtgcgccgaaaggcgttatataaatacagcccgtcgctcgtggccaacagacgctccacgttctttctgacgtattcgtgcagcatggtctgcgagcattcgtggtagaagcggcgaaaggcgcgtacgcgacacgaggacatcttggcctccacaaagcgcagcgtgtgcgacaccagcgcggcgccatgctcgcccaggagacaggcgccgtagctcatttgcgccgccagaatgagcagacaggcgtcggagcagtgcgtgagcttgccgttctccaacgcgcggcaggccgcgccggcgtgcttaaagagcaacgcctccgtgcccatgcgcacctcgtccagaccgcgccggtccaacagccgcatgaggcaaaagcccagcacgttacccagcgccgacagctccgacatgcaataacgccgtaggccggctacggggaaacgcgcgtgcgggtcgcagatgagcagcttctgcagcggcatgggtcggaaagcagggtggtaacattcgcgcagacggtgcgagcagttggggatgcggcgcgccgtgcccgtctcctgaaagacggccacacagcgctcgttgtaatccggatagggctcgctgaggctgtaatcgcacagcgcggcgcgcacgatctcgctggggttgtgcgggttcacgtcgatgagcacgttcatgggtgtaatgtcaaagtggcatacacgacactggtgattgagaaatttgatagcgtcggccaacgtgcaaaaggcacgtcggtagctgtcgatgcacgccagcttccactggtcgtgatgaaacatgtctgtgtggaaacgtcgatgtaccgtgacgttgtgcagcagacagcagcccgtggccgtgagcagaccgcggtgcacgcccgtgcccaccagcgacggcggctgctgttgctcgccagcggcgcgcgtgcggatcaggcccgacatccagaccgtgagcaccgtctcgctgtgcttacgcgccaccttgaccacgcgatagcgatcgagcggccagacctcgccgaaggagccctggcccaggcggtagctctcgtcgctcatgtccacggcataacagatcttgtggcaaaaatcgtcctctttgggcacgtagaccagcaggtaggagatagagagctcgcagagctcgggatgcgtaaggcgcaagaacatacgtgggtcgcacgtaaggccgcggatggacgtggtgatgatctggtcgttggaacaggtgcaatgcacgtcgtcgtgtgacgtggagtcggcctccaccgccgtggcggattcctccccggaactaccgctgagcggctgcggaacgcggcccgggcccgatgccacggcgctgtcctgactttccgcgcgcagctccacgtcgttttcttcgagcaccgcgtgcacgccgcccacacgacgtcggcacagcggggtgcgggccagcgacaccaacggcggacgcaacgggcgtttgcgtccaccgcggacgccgctcacgctgtccgaggggtcgctgccgccggtgaagagagcgcggcgtacgctggtcacgtcgccgtcgcgatcgtactcgaacgaccacatggccgaggtttcgcggcagcgcaagccgtggtaaccgtcgccgctggcggcgctgccgcgagacgacgtggacggcaccacggcccgacgttggttctccttgtccgaaaccgcgtcctctttttctccgtcacgcatcacgtcacttcgaacgcatgcggaaaaagtcgcgtgtccaagcacggtggttgtgctgacggaactcagggtggtcaaagtggtgacgccgtcgccggcctcgtcggccatcagatccacgacctcgtcttcatcgacgtgagcctgggcaacctgagcggcggcggcctgcgcggcctgcaccgcggcttgagcggcggcctgcgcagcttcgcgcatccactggcgccggcgcgccctgctgggacgacgcaatggcggcggatcccagccctgagtcgtcgttccgagcgaggccgagcgagcccgagaccgaagtgcggaggacatagtggcgacagtcttccctgttcctagggctgcactagctaccacaccgacactgtcgttatgttgtgtttttttttaataaaatctgaacagaggcgtgacggggattgctatacctgttagacggcgtcgtcgacctccaggtccaaatcgcacgtcgccgaaaccgagtccaccaaggtggctctcacgtcgtctaccgtgtccttcagctcggttaaagagtccagcgcgtcgtccacgttaccggattgcagctgtcgggcgcgttgcaactcttgctgcacggccgcccgttgctccaacaggtgtgcggccacgcactgcgtcgttcgctgactgtatcgggtctgttcccgagcggccacacgcatcaccgtcaaagcctgctgcgtggtgagccggtgctgcggtccgtaggtacgccgcagaaactgatgctgctgtcgctcaaggtcgacgcgcatcacgtcctttaagagctgtttgttgaccgacgtcatagattcaacgtgatgagacccgcgtcgttcagcgagagagcgtccagcaacttgccgacgtggtagacggggaaaagggagacggtgctctggccgggcaagatgtgactcaaagtgacgtcggtgacagccgcggcgcagtcttggataacgatggggctataactcacggtccgcgcctcgtcacgcgcgagatctaaacagagacggttctgactgtagagcgcgcacaacaaacaggtgcgcgacgaggccggccaggcgggcacctcgcgccccgagaagcggccgcgcaccgcctgcaacacctctctgagacggtccagcgagacgggctttaaaggcaaatgcacctcgtcgccggcgtcatcgacccggcctgctgacgcgctcgtctcgaccgcacaagcgccggccccgccgccgccaccactaccaccaccaccaccaccaccaccaccaccaccaccactaccacccgccgtcgtcgcctgcggcgtcggcgcagggaattcgtagccgcgataccaaacaaagacgtacagctcagccagattcatgtaggtcatatagtcccgcacgggttcgtaaaagagtttgggcaacaacgcggggaaaggacaaccgttcttttcgcggccgaaacaggtgtcacgcgcgcaaaagctgcgcggtccacagtacagcagccacagcagggcctccacgtcgcacacgttgtgatgatctaacaagcccggcgtgtacacctgtcgcagcacggcttccacgtgttgcaccttgttgctggagagtgacagctccacgtgagccttgcgatacaacaggtaactgccgtagattaattcgccgtcgtaagtaacacggtcagcattacgtaacacataatcacgcacacaaagcgacggcaaaggctcagccgcggccgcgaaacgctccagcacgtcgtgtcgacgtagaaaagacggcgtggcggcgtcgtttttcggagcgcgtcgtctacgacggcgtttggcccgagacccaccgccgttcttttcccccgcggatttattcccgacgtttttctttttgtcctccggcccgctatcgccaccgctgctactgctatccaacaccggcacctcggccgactcgcgcggaattacgttagtgaccaacaagaaattctcgtcgggcgtttcaattaggcgaaagcgatcgtaaggtgacacggcctcgcaggccaccagcgccatatttacggcctcctcgaagcgccaagcctcggagaccgagaaatcggcggccggagactgcgccgacagctcgaccatccgttccaccgagcacagggacgttgaaaccccagcggaccccggagacctgacggcagttgagggggaggagacggggaaactgagaggagaggcggatgaagattcgtctgagcctgacgccgaggaggacgacaccactagggacgacgaagacgaacgagtgacggcgcccgtcccacaagccacgtccgcgacaacgtggttttcgggtggatcctccgtcgtcctcgcggacgccatctttttcctctcctctcgccgctgccgcctaacctccgctcgcaccaccgccgccgccatcatgttgcgcggagattcggccgccaagatccaggagcgctacgcggagctgcagaagcgcaagagccaccccacctcctgcatttccacggccttcaccaatgtggcggcgctgtgccgcaagcgctaccagatgatgcaccccgaactcgggctggcccactcgtgcaacgaggccttcctgccgctcatggccttctgcggccgccaccgcgactacaactcgcccgaggaaagccagcgcgagctgctgtttcacgagcgcctcaagagtgcgctcgatgaactgacgtttcgtccgtgctccgaggagcagcgcgcctcctaccagaagctggacgcgttgaccgagctctaccgcgatccgcagtttcagcagatcaacaacttcatgaccgactttaaaaagtggctcgacggcggcttcagtaccgccgtcgagggcgacgcaaaagccatccgactcgaaccgtttcaaaagaatttattgatacacgtcatcttttttatagccgtgaccaagatccccgtgctggccaatcgcgtgctgcagtacctcatccacgccttccagatcgacttcctctcgcagacctccatcgacatctttaagcagaaagccaccgtgttcctggtgccgcgacgtcacggcaagacttggttcatcatccccattatttcgtttctgcttaagcacatgatcggcatcagcatcggctacgtggcgcaccaaaagcacgtgtcgcagtttgtgctcaaagaggtcgagttccgctgccgccacaccttcgcgcgcgactacgtggtcgagaacaaggacaacgtgatcagcatcgaccaccgcggcgccaagagcacggcgctttttgccagttgctacaacaccaacgtgagtagctccatgatgataacatacgccttgccacaaaccgtggcgagtccatgtcctctttttttttgttatttcttgtttcttctccccgtgaactgtcagaccccgttagtgcactaggttcttaagcaccggacaggaacacactatcatacgtgacacaggttcctctaccttaaccaggtcccacacatcggtcttgacgggcagccatcggccctcagaatccttgacaccgatgtgataatccaggccgtctcccagtgtgacctgcgccgcggtcttagaacctacggcacataggtacttggcgtcatcgctctcacagaaaaaagtcgcgggttcctcgttgtggatgagcgactgcgtcatgggcccacagggcacgtaacaaagacagcggcccatatcgggggtgcaacccacgtaattgccagtgggatctacgtgtccctcgtgatccgtgcaaaagctgcaacccgcctgcccgcaggccgtggccgccgccatgaggcgcgtcatggaagggatatcgcaccgattgccgcatgaggtaaacaggtcgtagcacagaatgtaaaagaaaagcgtgtagccttcgggacgcggcagcaaccaggcgccggcgccgcctagcgtcactgccttctgacaggtcaggtccatggcaccgtgacccttgaccaggatgcgcttggcttcatcctggggcaccaacatgcagacctcgtaaatcacgtcgggcgtaataccatcgcacgtcatactgctggtcacctggctaaagcttggcaagaaatcaatgctggctggacccaaaggacctccgaagctcagttggtacaaggtaggtaaatgacagatgcgtcgacgacgccgatgtacctggcccacgccatagtggccttgataacggccgttgcagcaaagacagaggatccattcgccgtcgcggtagagcaacagcaattggcacaagatacacgagccgtcgtcctccggactaaagatcgtcgaacggcaagcgacggcccgatactcgcggtgtttccggctcttgccgaccagcttccacatgcattcctcttgcaagaactgcttcaaagttctggaatcggtctcgcaaagcccgctgcgccaagccatgaagagtgacgcgcgaagagacggcaaagccgcccggcagcacccagtaaaagtccaagtctggcgtgacgtagagcacgcacacctcgggctgcgagagccaacgtcgcaggcgtccgcggcgatcacggacgatccaaagcccggtgcgaggacaacgcgccgcgcgcacttccacgcccaaatccacttgcgcgcgaacgcagcgcaccacgtcagcgtaccaagtccgttcggcgggcggaccgctctcgttccgcggtccgaaaagcagctcctgcggtttgggcgccgagcgctcgcgctggcgacgagctcgctgagcggcagcggcggcaccccggctcagacgaggcgttagcgccttaataatacagctacgcacgtccgcccgatccatccagagcgccaaggcatgacggcaaagttcccaaacaacgcgccaggacatgttccgtggcacgtggcaggcgaaacgctgtggcaacgcgccgctgtcccgtcgtagtacagcgtagatctcgtcgcgcacggcgcgaatcagcacgtactcgacggcgatgcgcgcccgataagcgtccaacgcccggtatagttcgacttcgtggtcatcgtagctcagctcgcgactgcgccaaaaggaattgacgtaccacagcacacggaggcgcacgcgatgctgcacatcccagacctcgcggagacgcgagacaccggcacccttccactcgtccgtacgcgcgacctcgtcgcggtcgtacggatcggtggcgtacatgaggtctggatttacgtccaggcgcagctgcaccaactcatgaccgcgtatcttggaaggcggctccaatggacccgcgtgatagatgaattcctcgtcgccgcgcaacaaacgcgctacccgctgctccaggttactgaatctgccgccgccgttcgcggaggaggttcctgctccgttcggaatctcaaaaaatggagtactgacggccgtctccagagaagccacagccgcttcgggcaaacggcgatccgacccattgtctaagttattacgcagtccgccccgccgacggtgattcgtggtcgtagccaactggtgctgccggtcgcgcttattcgcttccatttcttctcgtaacaggtcacgcgctaaaaactcccagtcacgatagctgccgtcgggccagaccagtctcaggtgtagcgtctgcgcgcctgagagccgattatcggggcagcgcagacccaacgtagtgaagacggcatagaacatgcgcacgcgctgctctttctctaacgtcacagtgagaccgctttgacgtaggtaatcgagcaactccagtgggcgcggtagtacacgaaaacaggcccgctgccaagtccgccgctcgcggtcaaaagcgcgatcgccgcccacggcgtcctcggcgtcgtcggaggccggtgcgtcgtcctcatctccgcccggaacgcggcccgcggatcggccagcgctgtctacattacgatagtagacgtagcgcagcgtctcggcctcctcgttactcagcacctcctggtcgagcaccaggtgtagaggcaattgctcatcgtcagcgaaccgcgcctcaaacgccagatccgaatacaggtgcgtttccatattcggaacgcatctgtttcagaagcgcgtcctcacgcttcttacgactaaccttgatgacacacgcgtcgtacttggtctgctttgagtagataccgatgataagctgaataaaaagttggctgatgacgggcaccgaaatacgattgacgttatgcatagaacggaaaaccttattaaaggtgaagtaaatactgtcctccacctgctttttgaggcggtcgcgctcgaccacctcttggatcacgtcggcgtaacggccggcgtgcgtcatgaggtagctgtacacgccgctgagcacggcgctgatgatgttgacgtcgtccagtgcggcctcctcgatgggttccaacaggtggctacgcgccaccggatagagagcttcgtataccaggcccgtcttgacgcagacggagccctcgagcgtggagacgagcgcgcagccgctgcccagatcacacaggtgcgtgcgaaagcagcgcgtgcacgcgtagagcgagtgtaactggatctcctcggtaaacgcgttctggacgtgcctcatgtcacaggcgcccgaggcgtcgcacatgacgtctgagcgtcgctgacagttttgggggcggagggaacaggagaagggcagggacgacaggtgttgcttgtctccacgacgttcacgtccgggtggctgcaggcgtccaggatgtcgttgacacactccaccgtcaggtgctcgaacacggacgcgaccagttccaagcggcgcgggcctgactcctcggcctggaaaaggaaggaaaagtgttgaaagaggcggtcgacaaagataaaaacatcctccgtagtggcgtgcgcgacccccagtcggttgagttccgccagcaacgagttcatggcggctgtggcgggtcgcgacgacgacactttcgtttttatgggcgcgcgtcacgcggcgccggtgtcggcggattggttccggttttcaggtcgcagcccggttggcacacggcgatcccgcctcacctggcggctcacctggctcacctgtccggccccacccctactctgtaggcttccagccgagcgtgcgtaatcataagagtcccttttctgtctcctctctacacagagcatccgaggacaaaacttccacttgctgctggtggacgaggcgcacttcatcaagaaagaggccttcaacaccattctggggttcctggcccagaataccaccaagatcatcttcatatcgtccaccaacactaccagtgacgccacgtgtttcttgacgcgcctcaacaatgcgccctttgacatgctcaatgtggtctcttacgtgtgcgaagagcacctgcacagcttcacggagaagggcgacgccacggcgtgtccttgctaccgactgcacaagcccaccttcatcagcctcaactcgcaggtgcgcaagacggccaacatgtttatgccgggcgctttcatggacgagatcatcggcggtaccaataaaatctcgcagaacaccgtgctcatcacggatcagagccgcgaagagttcgacattttgcgttacagcacgctcaacaccaacgcctacgattatttcggcaagacgctttacgtgtatctggacccggccttcaccaccaaccgcaaggcctcgggcacgggcgtggcggccgtaggcgcctaccgacaccagtttctcatttacggcctagagcatttctttttgcgcgacctctccgagagttctgaggtagccatcgccgagtgcgcggcgcatatgatcatctcggtgctgagcctgcacccttacctggacgaactgcgtatcgccgtggagggcaacaccaaccaggcggcggccgtgcgcatcgcctgcctcatccgacagagcgtgcagagcagcacgctcatccgcgtgctcttctaccacacgcccgaccagaaccacatcgaacagcccttctacctcatgggccgcgacaaggcgctggccgtagaacagttcatctcgcgtttcaactcgggctacatcaaagcctcgcaagagctcgtctcctacaccatcaagctgagccacgaccccatcgagtatcttctggagcagattcagaacctgcaccgcgtcacgctggccgaaggcacgacggcacgctactcggccaagcgccagaatcgtatctcggacgatcttatcatcgccgtcatcatggccacctacctgtgtgacgatatacacgccatccgtttcagggtcagctaggcacgcagcagagccaccaggtgccgacgactgacgccggcatcggcagaaacgagacgatcgtaacccaggcgcgtaaaactccccaaaggcgaaaacgtttcagcgtagtcggctaacaaagcccgggccgccgccagcgttcgcgcctgcacgccgccgtgactgcgataataacggcgcagcaccacgttgacaaggtcgttctcctcgacgcgcggcggaggaggatccaaggcctccagcgcctcctggtgcaaatgcagcgaattgagcaacaaacacagacaggcggccagcttcatcgtcttgcgatgtagcagaaaaccgccgcttgcgcccgagacggcggcatcctcgggctttccggccaacatgcccagcatctcctcgcccatctcgtcctcgtccagctcgtaaagacagacttgacaaagaaaatagttctccagacgcggcacgtcgagcaagagcagcttcttagcacccgccagccccacgcagtgctccagcagacgggcggatgaacgcggaatattactcattcgcaaacggtgataagcgctggccaccacaccgtcaaacatgtccgaatcaccgcgcgtggcactctgcaacaacggcgctagacgctcctccatctcgggcggacaaagaaccagctcctcgtgcgagcgccgttccagcaaaaaaaaatattggcggaacgtgttcaccagggcgcgcgccgccgagattcgtcgctgcaccgtagtgatcacaacgtccggcgcccaaagcacgctggtacccggccaaataacgtgtctggggccggtgctgccgccgtcgttgacgcgaatcatataaatgcccggcacgtcgtacagctcgtccctgctgtcgtcgtctccccggcgctcctcaccactcgcatcaccgtcgcgccaccgtagcctactactccccaactgaccgcattccaccaccaacttggcgcaatgggtaatgcccgtaagcgcgtacaccagatcgctatgcttctgccaatagatggagaagacggacgacctgcggttaaaacgaccgctgcaataaaaacacagctcggaagcaaaaaccacgtcgtcttcggcgtcgggcggcggcggtaacacacggcgaatcagttgcgacagcggtccgttgcgaaacgcgtgctcgcgcaccgtaccgtcgtccattaacaacgccgcgtcgtgccaacccggcgtcggacgctcctccggacgaaacgccgcggcggcagcggccgcggcttccatcatcgtgatgcaaaccgcgctcgcggcgacgtgggttcagaactgccgtcaacgctgacggaggttgggacagaagggacggaggaagatgaggacacacacaatgggggaggggatgaacacaggcccgatgtggctgcggccgccgagcacaatcgaaacaacgtctggtggatcacttcgcgcgtgtgcggcgtaccgctgatactctgcaacacgcccagcacctcgactaacactttgaggcgcgtgcgagggatcttgtgggcttccacgtgccgacacaccgtcagcacgttggcgttccggcccaggtgatccaatttgacttttttgttccgggccaggatcttgggcacgttgttggctagacgactgccgatgagcgcacaagtgtgcttgatcttggtgtgcgccgtgaggttcttgctgtagtcaaagagaccccgctgtgccgcctcaaatactaggcggtccaactgcagccgcttctctcgaccgtgcagcttgagcaggcaagcacgcagaaacagcactaactgcttggccaggaaggggatctggtacgaattgcgcagctctagttgcgtgaaaacgcggtgcagaccgtaatcgatgcacacgtcgcgcatgttcttgatgcacgagagttctttgagcagaatggcttccaggtcagcgcccgagacgcgcggcacaatggccgtagccgctttgaaccagcccacgttgacgttgttagtatgcgagatcatgcacggaaagttggtggtccagtacaccttgctgcgctccgagcggatcaccgcctggtcctccagcccatgcacgtccagcgaggagttgctgttgcacaccacggccggcagaaaaaagtgatcgatattaacgtgcagccggtacacgcccagcgagtacagaaactcggggtaggaaccgcgaatattgacgttgagcgagttgatgtagacggcgtcgttggaaacaaaggtgctgacggtgcaagcgggctccttaaaggtgtgcttgtacatcacaaaactgtgggtcatgttcttgggaagccgcggcgcgcgcacgccgagacccgacgcggcgatggacgagagcgcggccttcatattgataacgcggttggtgttgaaagcgttgacggcgatgcggtccagactcacgcccgtcacctcggcaaactccatcccgccgatgagcttacgacggcacggcgcgtaacgctgcacggctagatgtttacgacgtcggtgttcctgataggcccggcgcagctgctgccccgtaaagtcaaatggcggcgtggcgtcagtctcccccgattccagcgtctcttcctcctcctcttctcccgtctccgaccgccgttgacggtgtttacgccatctctccccgtaccgagcgtacatgagacgcgagatgatgcacacgtaacgtcgaacgcgatcggcggccgggtcgcgcggcagtgacagcttgtgacccgcgctcgtcgtcgggagcgcggtggaagacagcgcgtgtccgttcgccgaaaccaccgtcgattctgacggtgatagccgcgacgtcctcggagcgcaagaaacaccgtaaccgcggtttacgggtcggttccccgtcccatgggaccccagatcccgagctagttcataataaacgtagaaaaggtttctccacaccgtgtccgtgtcggcaaacgtgacgctaaggcgtcgataacacagtaggttgtggtgtccctgatttccaccgtttccccctcccccacttctgtcagcgtggccagtccggcacttgccgtagctcacctgtaacttgaagtacagtacctgtcgcttgaagcgactgagaacgaaggtgctcaggtggcacaccgtctgctcgggcaagcgaagcgccatcatgacgcgggcgcggtcgcgatgcagctgagccagcacgcgaccgaaaaactccgacgtcacttcgtggtgatattcaacgcccagccaaagcttttgcagctccagcagaaaaaagtcgcgtgtagcgtccaacgcgcacggcgcttgcggacgcacgttgagtccaaagagcagcttgtagtgaacctggatgcgcggcgccgcggcctcgcccaggtagccggagacggcggttacgtagtcgtctacctcgctgacactgagtacgcgtccgatttccaccatcaggtaaggatagtcgtccaggtgcaggctgaggtcgcgcggcaggcaggccatagcgtagcgttcctcggttcccgaggcgccaccgccgccaggacagtcgcaaaagaggctcggcaattctcgattccattccgtcagcgagagcaatccgcgtagcacatgcgtggccacgtggttttcgagaacgtggtaggacagcgcgcgcccggcggtcacggatccgcaacaacaacgtcggtgcacgtagagcagcggcccgcgacaaaactgcgtcgtaggtaccagatgttcaccgtggccctccacttcaccgtcgcaaaaacagggtacggccacgggtcccagtaacagacgacccagtaccagcttgacacgctcgggctcggtcctcacgtgtatcggacaggcacggtagagagccgcaaaaacagcgcgcacccgttcgacgttaacgggtcgcggacgacagaagcgggcgtcctcgcccgtcgatagctcttgggtgaggttgcaggcgcgaacgtgcacggggacgtgtaaaacccggcgcggcatagcggagccgccgacgactattagagcgtcacagccgaggcggcgcggcgcagcgccggccattctccgggtcgcgctgctttccccgagctccgacgcctcgcgctcacgccgccgccgcgatggagaactggtcggcgctcgagctcctgcctaaagtaggcattcccactgactttctgacgcacgtcaagaccagcgccggcgaggagatgttcgaggccttacgcatctactacggcgatgaccccgagcgttacaatattcacttcgaagccatcttcggcaccttctgcaatcgcctggaatgggtttattttttgaccagcggcttggccgcggcggcgcacgccatcaagttccacgacctcaataaactgactacgggaaaaatgctgttccacgtgcaggtgccgcgtgtggccagcggcgccggtttgcctaccagtcgtcagaccaccattatggtcaccaaatacagtgaaaaatcccccatcaccatcccctttgagctcagcgcagcctgcctcacgtatctgcgcgagacgttcgaaggcaccatcctggacaagatcctcaacgtggaagctatgcacacggtgctgcgcgcgctcaaaaacacggccgacgccatggaacgcggcttgattcacagctttttacagacactgctacgcaaggcgccgccgtactttgtggtgcagacgctggtagagaacgccacgctggcgcgacaggcgctgaaccgcatccagcgaagcaacatcttgcagagcttcaaggccaaaatgctggccacgctctttttgctgaatcgcacgcgcgatcgcgactatgtgctcaagttcctcacgcgtctggccgaagcggccaccgatagcatcctagacaaccccaccacgtacaccacgagctcgggggccaagatcagcggcgtgatggtaagcacggccaacgttatgcagatcatcatgtcgctgctctcaagccacatcaccaaagaaacggtctcggcgccggccacctacggcaattttgtactcagtcccgaaaatgccgtcactgccatatcctatcactcgatcctggccgatttcaactcgtacaaggctcatctgacttcgggccaaccgcatttgcccaacgactcgctttcgcaggccggggcgcacagcttaacgccgctgagcatggacgtgatccgactgggcgaaaaaacggtgattatggaaaacttgcggcgcgtctacaaaaacaccgataccaaagatccgctagaacgtaacgtggacctgacgtttttcttccccgtagggctgtatctgcccgaggatcgcggttacaccacggtggaaagcaaagttaagcttaacgacaccgttcgcaacgcgttgcccaccacggcctacctgctaaaccgggaccgtgccgtacaaaaaatagactttgtggacgcgctcaagacgctgtgccacccggtgctgcacgagcccgcgccctgtctacagaccttcacggaacgcggaccgccctcggaacccgccatgcaacgactgctcgagtgtcgttttcagcaggaacccatgggcggtgcggcgcgccgcataccgcatttttaccgcgtacgacgcgaggtcccgcgcacggtgaacgaaataaagcaggactttgtggtcaccgacttctacaaggtgggcaacatcacgctctacaccgagctgcaccccttcttcgactttacgcactgccaggaaaacagcgaaacggtggcgctgtgtacaccgcgtatcgtcatcggtaatttgccagatggactggcaccgggccccttccacgaactgcgcacctgggagatcatggaacacatgcgactgcggccaccacccgactacgaagagacgttgcgacttttcaaaaccaccgtgacaagccccaattaccccgagctttgctacctggtcgacgtgctggtacacggcaacgtcgacgcttttttgctaatccgcactttcgtagcacgttgtatcgtcaacatgtttcacacacgtcagctgctggtttttgcgcacagctacgcgctggtgacgttgatcgccgaacacctggctgatggcgccctaccaccgcagttgctctttcactaccgcaatctggtcgccgtgctgcgtctggtaacgcgcatctcagcgctgccgggacttaacaacggtcaactggctgaggaaccgctatcggcttacgtgaacgcgctgcacgaccaccggctgtggccccccttcgttacgcacctgccgcgtaacatggaaggcgtacaggtagtggccgaccggcaaccgttgaacccggccaacatcgaggcgcgacaccacggcgtttcggacgtaccgcgtttgggcgccatggatgccgacgagccgctgtttgtggacgattaccgtgccaccgacgacgaatggacgttacaaaaggtcttttatctctgcctcatgcccgccatgaccaacaaccgggcctgcggcctgggactcaacctcaagacgctgctagtagacctcttttaccgaccggcgtttctcctgatgccggccgccaccgcggtctccacgtcaggtacgacgtcgaaagagagcacaagcggtgtcacccccgaagactcgatagcggcgcaacgtcaagccgtaggcgagatgctgaccgagctggtggaggacgtcgccaccgacgcacatacgccgctgctgcaggcctgtcgtgaactgtttttggccgtgcaattcgtgggcgagcacgtcaaggtgctcgaagtgcgcgcgcctctggaccacgcgcagcgtcagggcctgccggactttatctcacgtcagcacgtgctttacaacggctgctgcgtcgtgacggcgcctaagacgttgatcgagtacagcctacccgtacctttccaccgtttctactcaaaccccaccatctgcgcggcgttgagcgacgacattaaacgctacgtgaccgagttcccccactatcaccgtcacgacggtggtttcccgctacccacagccttcgcgcacgagtaccacaactggctgcgctcgcccttttcgcgttactcggccacctgtcccaacgtgttgcactcagtcatgacgctggccgccatgttatacaaaatctcaccagtttcactggtgctgcagaccaaggcgcacatccacccgggattcgcactcacggccgtacgcaccgacaccttcgaggtggacatgctgctctacagcggcaaatcatgcacgtcagttatcatcaacaaccctatcgtgaccaaggaggaacgcgacatcagcaccacgtaccacgtcacgcagaacattaacaccgtagacatgggtctgggttacacgtcaaatacctgcgtagcctacgtaaaccgcgtgcgaaccgacatgggcgtccgcgtgcaggacctctttcgcgtcttccctatgaacgtgtaccggcacgacgaggtggaccgctggatccggcacgcggccggcgtagaacggccgcaactgttagacacggagaccatctccatgctgacgttcggcagcatgtccgagcgcaatgccgccgccacggtgcacggacaaaaggccgcgtgcgaactaatccttacgccggtgacgattgacgttaattactttaagatccccaacaacccgcgcgggcgtgcctcctgcatgctggccgtcgatccgtacgacacggaggccgccaccaaggccatctacgaccatcgcgaagcggacgcacagactttcgcggccacacacaacccctgggcctcgcaagccggctgtctgagcgacgtactctacaacacccgacatcgcgaacgtctaggctacaactccaaattctacagcccttgcgcgcagtactttaacacagaagagattatcgcggccaacaaaacgctcttcaaaaccatcgacgagtacctgctacgcgccaaggactgcatccgcggcgacacggacacgcagtacgtctgcgtcgaaggcacggaacaactcatcgaaaacccgtgccgtctgacgcaggaagcgctaccgatcctcagcaccaccacgctggcgctgatggagaccaaactcaagggtggcgccggggcttttgctacgtccgaaacgcactttggtaactacgtcgtaggcgaaatcatcccgctgcagcaatccatgttatttaactcgtgaggccgtccggtgaggaggacggcgacgaccgcaggttagcggcgagtcacctagacgcaaacgcgggcccggacgcgccacgctcgctctgacgccgcgcccggtgcagacgttgttcgtctctgcttctcctccgtcgcggccaggatttcaccgccgctatggcggccatggaggccaacatcttctgcactttcgaccacaagctcagcatcgccgacgtaggcaaactgaccaagctagtagcggccgttgtgcccattccgcagcgtctacatctcatcaagcactaccagctgggcctacaccagttcgtagatcacacccgcggctacgtacgactgcgcggcctgctgcgcaatatgacgctgacgttgatgcggcgcgtagaaggcaaccagatcctcctacacgtaccgacgcacggactgctctacaccgtcctcaacacgggacccgtgacttgggagaagggcgacgcgctatgcgtgctgccgccgctcttccacggaccgctggcgcgcgagaacctgctgacgctgggccagtgggagctggtgctgccctggatcgtacccatgccactggcgctggaaatcaaccagcgactactcatcatgggcctcttctcgctcgaccgttcgtacgaggaggtaaaggctgccgtgcagcagctgcagaccattacttttcgcgacgccaccttcaccatccccgatccggtcatcgaccagcacctgctgatcgacatgaagaccgcctgcctctccatgtccatggtggccaacctagcctcagagctgaccatgacctacgtgcgcaagttggcgctagaggacagctccatgctgctcgtcaagtgccaggagctgctgatgcggctggaccgcgagcgcagcgtcggcgagccgcgcacgcccgcgcggccgcagcacgtgtcgcccgacgacgagatcgcgcggctgtcggcgcttttcgtcatgctgcgacagctggatgacctcatccgcgaacagatcgtcttcacggtgtgtgacgtttcacccgataacaaatccgcgacctgcatatttaaaggctgagccggccctctcgcgcccgcagacaccaagcatgccacgcgtcgaccccaaccttcggaatcgggcccgccggccacgagccagacgaggcggcggcggtggcgttggcggcaatagcagccgacacagcggcaaatgccgccgccaacgccgagctctgtcggcgccgccgctcactttcctcgccaccactaccaccacgaccatgatgggcgtcgccagtaccgacgacgacagtctcctcctgaaaacgccggacgagctggacaagcacagcggctcgccgcagaccatcctcacactgacggataaacacgacatccgtcagcctcgggtgcaccgcggcacctaccatctgatccagttgcacctcgacctccgacccgaagaattgcgggatcccttccagattctgctctctacgccgctgcaattgggggaagcgaacgacgagtctcaaaccgcccccgcgacgttgcaagaagaagaaacggcggcttcccacgagcccgagaaaaaaaaggaaaaacaagagaagaaagaagaggacgaggatgaccgcaacgacgatcgtgaacgcggcattctatgcgtggtctctaacgaggattctgacgtgcgcccggccttctctctctttcccgcacgcccaggctgccatatcctgcgctcggtaattgaccaacaactgacgcgcatggccatcgtgcgcctatcactcaatctcttcgcgctccgtatcatcacgccgctgttgaaacggctaccgctacgacgtaaagccgcgcatcacacggcgttacacgactgtctggcgctgcatctgccagaactcacgttcgagccgacgctggatataaacaacgtaacggagaacgcggcttccgtcgctgataccgcggaatcaacggacgcggatctgacgcccacgctgacggtgcgcgtacgacacgcgctgtgctggcatcgagtggaaggcggcatctcggggccgcgtggactcaccagccgtatctcggcgcgcctctcggaaaccacggccaagacattgggaccctccgtctttggacgattggagctagacccgaacgaatcaccgccggacctgacgctgtcgtcactcacgctataccaagacggcatattacgtttcaacgtgacctgcgaccgcaccgaggcgccagccgacccagtggcgtttcgcctgcggctgcgacgcgaaacggtgcgacgacccttcttttcggacgcgccactgccttactttgtaccgccacgctccggcgcggcggacgagggactggaggtgcgcgtcccttacgaattgacgctaaagaactcgcacacgttacgtatctaccgccgcttttacgggccttatctgggtgtttttgtaccacacaaccgtcagggactcaaaatgcccgttacggtctggctaccgcgctcctggttggaattaaccgtactggtgagcgacgagaacggcgccacgttcccacgggacgcgctcctggggcgcctctattttatctcgtcaaagcatacgctgaatcggggttgcctgtcagcaatgacgcaccaagtcaaatccacgctacactcgcggtccacatcccattcgccgtcgcaacagcagctctcggtgctgggcgcttccatcgcgctggaggacctgctgcccatgcgactggcgtccccggagacggaaccgcaagactgtaagcttacggaaaatacgacagagaaaacgagtcctgtcactttagccatggtctgcggcgatctctaaacagaggaccctggtgatgggaaacggacactaggcgtccgcgcgatacgggattaaaacaaaaaaaatcggtggtggtgtgtgatggggtgtggtgacggtggggcttcgcctctttttttttgtaataaaaaaagacactcaataatccgcggttgtctctgtgtagaacgtttttatttcgggttccgcgtttggtcgcctgcctatgtaaggcggcggccgcagagggcgcgccgctcagtcgcctacacccgtacgcgcaggcagcatggagtcgcgcggtcgccgttgtcccgacatgatatccgtactgggtcccatttcggggcacgtgctgaaagccgtgtttagtcgcggcgatacgccggtgctgccgcacgagacgcgactcctgcagacgggtatccacgtacgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaggagcccatgtcgatctatgtgtacgcgctgccgctcaagatgctgaacatccccagcatcaacgtgcaccactacccgtcggcggccgagcgcaaacaccgacacctgcccgtagctgacgctgtgattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctgacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcagatcttcctggaggtacaagcgatacgcgagaccgtggaactgcgtcagtacgatcccgtggctgcgctcttctttttcgatatcgacttgctgctgcagcgtgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgcaagacgccccgcgtcaccggcggcggcgccatggcgggcgcctccacttccgcgggccgcaaacgcaaatcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagaagccctgcccgggccatgcatcgcctcgacgcccaaaaagcatcgaggttgagccacccgccgcgcacgcgcttaagacgactctataaaaacccacgtccactcagacacgcgacttttgggcgccacacctgtcgccgctgctatatttgcgacagttgccggaacccttcccgacctcccacgaagacccgttcacctttgcgcatcccctgaccctccccccatcccgccttcgcaatgtctcaggcatcgtcctcgcccggtgagggaccctcgtcggaagcggccgcgatcagcgaggccgaagccgccagcggaagctttggtcgcctgcactgccaggtgcttcggctcatcaccaacgtggaaggcggctcgctggaagccggtcgtctgcgactcctggacctgcgtaccaacatagaggtgagccggccctcggttctctgctgttttcaggagaacaaatctccgcacgacaccgtagacctgaccgacttaaacatcaagggccgctgcgtggtgggcgaacaggaccgactgctggtggacctcaacaactttggcccacgacgcctgacgccaggctcagaaaacaacacggtctcggtgctggcctttgcgctgccgctggaccgcgtgcccgtcagcggactgcacctctttcagagccagcggcgcggcggcgaagaaaatcggccgcgaatggaagcgcgcgccatcatccgccgcacggctcaccactgggccgtgcgactgaccgtaacgccgaactggcgccgcagaaccgacagcagtttggaggcagggcagatctttgtcagccagttcgcctttcgcgccggcgccatcccgctgacgctggtagacgccctggagcagctggcctgttcggaccctaacacgtacatccacaaaacggagacagacgaacgaggccaatggatcatgctgtttctgcatcacgactcaccgcacccgccgaccagcgtgtttctgcacttttcggtttacacgcatcgcgccgaggtggtggcgcgacacaatccgtacccgcacctacgacgcttgccggacaacggcttccagctgttgattcccaaaagttttacgctgacgcgcatacatcccgagtacatcgtgcagatccagaatgctttcgagaccaatcagactcacgacaccatctttttcccggaaaacatcccgggcgtctccatagaagccggcccgctacccgatcgtgtgcgaatcaccctccgcgtcacgctgaccggcgatcaggccgttcatttggaacaccgacagccgctaggccgcatccactttttccgccgtgggttttggactctcacacccggtaaaccggacaaaatcaagcgtccccaggtgcagctgcgcgccggtctctttccacggagcaacgtcatgcgcggcgccgtctccgagtttctcccgcagtcccccggattaccacccaccgaggaagaggaggaagaagaggaagaggacgacgaagatgacctctcatccacaccgacgccgacccccctgtccgaagccatgtttgccggcttcgaggaggccagcggcgacgaggactcggacacccaagccggactgtcccgggcactgatcctgaccggacaaagacgtcgaagcggtaacaacggggctctcacgctcgtcatcccctcgtggcacgtctttgcgagccttgacgacttggtaccattaacggtgagcgtgcagcacgccgcattacgacctacctcttatctgcgcagcgacatggacggcgacgtgcgtaccgcggcagacatcagcagcacgttgcggtccgtgcccgcgccacgaccctcacccatcagcaccgcttccacttccagcaccccacgcagtcgaccccgcatctagagagagacttctttgtttttcccccgcgtgtttttcccattccctgtatttatttctaaataataaaaacacagagacgttgataataaccgcggtgtgctttattagggtatcacggtgtagaaaaaaaaaagagagggaagccctaaatatagcgtctctcttactcgagcttattgagcgcagccacaaaaatccgccgattcagatctaccatgtctttgggcgggctctgggaagctgcggcggcttgggcagcagcggcggctaacacgacactagccgggcaggaagaagaaccttccgtcgagggcccggccgttgccgtctcagaacccgacgtggtagcgaggcggcaactggcgttcaccacgccagcctgagcgcgctcagctaccttggcacctccggatagaagtgccgtgggtgtttctcctccgccactcgtcagctcgccggtgggagtacacacggtagtagtagttggggaggaagaggccgcagcggggagagccgccgaaagtaacgtagaactctgccgcgcggcaaacagatcgcgtttcagctcgtgaatggcatcccgcagttcatcgtaacgttgttgctgctgctgattggaacccgcgtgcccgccacttccaccgtcgctattgacgtgactttttagacgctttcgcgcccggccgtgctcggcctcgccggggaaactcaagtcttcgtccgaggacgacgacgacgccgccgcagcttccttacggcgtttgttgtgtccaccgctgcccccgtgacggtgctgcttctgcgactgaccacggtgaccaccgtcgtaacgctcccatccggacggtggttcatccataccgcccggagaatcgcgccgacggtaataggctggtgatggtggcggcggcacgggacaagccgaatgcaaaggcggcgcgggctcgtaacgccgaccccacccgggataatggggatccacgtattccgcaaagtgacgtgccgccaactggtcgtaacccacgacgggggcgccgtagggcgcgggataagacggcaaaggcaacggtgctggcgaagcagaaggaggagccgctacggcaccgggatacatgacgggcgctgccgagcgactggccccaagtagcgagaaaaaagcgtctttgggtaaataaactccgtcgtgaggccacgctagagacggcacagccggcgacgcacctgccacggtagcacctggaggagccgtagcggcgggaaccgcagcactcagagggtgcgacatggacgccgcctctgccggctccgagggagaaagcgacggcggtgattccgcgggaagaacggacggcgacgctggaagcgcaggcggctggacaggagatggcggttcgactggaggcgacggggacgaagagggaacccgcgccccagccgccggcgtggcggcctgactgcggctgtcgcccgaacgctcggcggacgccgctttaatatcgcacgccgcctcaggcgaaacgctcgccttgacgtacgactcgcgctccgtcacgccgactagttgcttgtcgtagcgcagcttgggcagtcgctcacggatgtagagcgcgtccacgctgttgcccaacaggccgtagctgtctgagcgaaagggatcgcccgacgcgtcgacagcagtgctgccgcagcgctgccactgtgcacgtagcccgtcacggtcggccgccgtgaggtctggaaaccgctgcgtgacccactcgggatcgcgcccgtacacggccaacgtaccgcgacgccgacccacgctgcacaaagccacgtgtttgaacggcgtggtttccgagcccgaaagcgacgtcgcggcctccacgtcgtcgcagcgccggctggagagcgagaggccggcgtagctgccgctgagaaactccaccaccttgtctggctgcagcggactgacgggcccgcgcgaaaccagctcggacttttccgaagcgcggcgtacaatctccagaaacctgggcgaagtgacgcagcccaggcaaaaaagaccgtcgcggacgctctgcatcgccgcaacgtgtcctacaacggccgtgtcgtcgtggttgatgttgagcgggagcgcgaccgacaacgaaggctgtctctggccctgcgcgtgcaaccagtgctccactacgtcccgcggcaacagcaattcggcctcgtccggagactggtcatagcgggcgagaaagccgcccacgtagaccggcgctacagcctgcggctgctgctcgtccatcgtcattgtcctcaccgtcgctacccgctcaccgagcgaacgatgatggcccgcgacgaagagaaccccgccgtcccgcgggtccgcacgggcaaattctcctttacttgcgccaatcatctaatattacagattagcgagaagatgtcgcgcggacagccgctgagctcgctgcgtttggaagaactcaaaatcgtacgcctcatctgcgtcctcctctttcaccgcggtctcgaaacgctgctactgcgcgaaaccatgaacaacctgggtgtctcggaccacgccgtgcttagtcgcaagacgccgcaaccctactggcctcatctgtaccgcgaactgcgccaggccttcccggggctggactttgaagcggccgtgttcgatgaaacgcgcgccgcccgtctcagccagcgcctgtgtcacccgcgcttgagcggcggactgctgacgcgctttgtgcagcgccacaccggcctgccggtcgttttccccgaagacctggcgcgcaacggcaacatcctcttctccctaggcacgctctacggacaccgcttgtttcgtctggcggccttcttcacgcgccactggggtgccgaagcgtacgaacccttgattcgcataatctgtcaaaaaatgtggtacttttatctcatcggcaccggcaagatgcgcattacccccgacgccttcgagatccagcggagtcgacacgagacgggcatttttacttttattatggaagattacagaacgttcgccggcacgctgtcccggcacccgcaccgtccgcacccacaacagcagcagcaccaccaccccggtcccccccatcctcctctttctcaccctgcctcgtcctgtctcagcccagaggccgtactggccgcccgcgcccttcatatgccgacgctggctaacgacgtgtgaacctaacgtgatttatctgccacttttctccccgctgccgtacagcgccgccgctcataatgccgtcaccgtcgcgtcggacgcgacggtgttttcgccgtcgatgcagaggacggaggaactttcggccgaaacatcgatcgtagtcccaggacacatttcggaagccatgccttccgcgtgcttcaccaacgtggctttctccgacgtggttgtcgttaccacaacggccgccgacgtcgcgtcggcgtaacaacggctggaggactttttcaccgcctcggcgacgtctcgaacggacgtagaaaagtaacacacggccagctccacgctatacatagcccgtttcaacgcctgcaccaaccgacgtacgaaatgaccgtggcagctttgctgacatctctcgaccagataatcaaaggagtcatccagatccttggtgggctcgcgggagaagaacgcaatgataaagagcggcagaatgccaagacgcatggtgagaagggtacgcgtagccaattccacgtaatccataatgccgaaaccggtgccggccgcgctagcgggctgcagtacaccgcgtaggactctgaagcagtagtagggcacaaacagcatgagacacgtcacgtagaaggtgcagacacgacccacgtaggaccagacgtggtcgcgccgatcgctgtaggccaactctaccacgttagccagtacggcgatcatgggcgcccccagcaaaaaccacatcttgatggtgaggtccaccgcggcatactgtatagggatctgacagcctagccaacggtagtccagtgaacccgtagcggcggtgggcacagcggctacgatggaaagaacccaggcaaaggcgaccgcgtagagcgccacgccggcgttttcgcgcgtttcatgatgccagagatcacggccgtaagatatggccgacagacgatccagtatcagaaagaggaaaaacaacgccgtcgaatataggcccacgtcgtcgacaaagagcactaagcgacagaggctgagatttagagcgccacgcagcatgatacccttggacaacatggtggccacgatagaaaaaaactgactaagtaccagattccaagtaaaaatcatcacggacacgggcggccgcgtaacacgcaacacccagaggcaaccgatgatagtcagcaggttgaccaggctaacggagccgaacatgccgatgagtagatccgaggcggcgcgatcggccgacatagagtagccttcgaacgggcccatgtgtttgaaactcacgatagcgaacatgatggactcggtgactgaagtagtctcctccacagaaggggacatacccaccaccgccgcccgctctcgccgaacgaatataccctctccggggacgttcgccctttatgcagcgagcgacacgtggtggaaattacaacaccgccacgctcggaagaaaccccaacactaaaaagtacaacagttcgtaaatatcgttgacgttaaagagggacgagcccagagtggacacacggtgacgcggcagggtcactgacaacagccgccctagcccgtgttcgtagtgaaagagcagggtatcgtgtacctctaagcgacgtaaatcgccgtactgtttggagctctgcgcgaacatgtagtcggccacggggttgctcttgctgagctgcatgagcacggcgccgccgccgtcgccacctccggcgctgtcctcgcgacgtgagggatcccagccgctgcgcacgctctcggtcacggccaacagagccaggccgggaaagagctgcgacagcgtgaccgcggggtcgcgcgcgtaccacggcccgatgtagtactgcaccagaaactcaaagttacgtacccgcccgtgtcgccccccgtagccctcctcttcgccgcccgcgcgccccccgggcaacccgccgccggctacggcatccgaacccagcaggtcggccaacgtaaatttgcccgtgcgcggagcgaagacgctatccgcgttggtcaccttccacaacagcagcaggccagccaggcaggtcaggcccgaacgcagatattgctgttcgtgcacaaagacggggacgtcgcgacccagcttgccgactagcagacgtcggctccagagagaaagcacgtcgtcgcgcacctggcccgacagacgctcttgcaccagctcctccgttatcgtcccgtagcccggcaaatgctgaagaacgccgcgtttgtggaaaagccgcaccagcacgtgacgatcaaaagtgcccgggtgatagtggcgaccaccgcttaggggcatgtagtagcgtagatcgggcgagtcgcgatacgcgtaatagttgttacccgcggcgacggggccttcccaagcggcaatctcacgactcacgtcgtcggccagacgcggtaacagctgaggcagctcactcaacaccgccgtcacggagtccggcggatcgcggccctcccaaagcgcgtgtccgtaggcgactagcagacaggcggcggcttccaaatcggagagtacacagtcgtacgtcggatacaccgtcacgttttccaaagcgttgaccacgccgagcagcagctcctgcgaaatggaaaagttgtccatctgcgccagatggtacactcgtttccaccgtggttgcgtgtacaacccccgcttgagccgatagtaccagataccaaaggagaaagtccaagtggaggcgttctcgaacatggtgttgaccacctcgccgcgaaaatcggtgtgaaagcggataaagggatcgttctgcgtgattccaaagtagttaggtacgttcccgggcaacggctgctcggcgcactgcgccagccaggtagaagaagcaccggcggccgctgacgcggcgaccgcgtcagacggggcggcggcgggtcccgtgatggcatcgtgccgactataaagaccgtgtgggacggcggaagctcctgccacgccggtccctggggacgacgaacgcggacgacacggtggttgtagcagcgtccgcggcgacggtccttcgtcgagctcgcactgctggttcaacagcgcctccgcctcggacacgcgcccttcgagatcctcgcagtaagtctgcaccctgtgacccagatccctcagctcctgacgcagataccgtttgcgcacccggtccatgagcacgtcctcgcgccagcccccgccgcgcattgccaccgccgcgtcctccagcaaccgccgaagcacgcgctcggggcagcgcagcacgttttcctcgtgcggctcgaagaagacggcgacgggtagccgccaaaaggtgtgcaacagactcatcctgacgcctccctagatagtccaggacagaatcggtacacaggttaaaacggcctgagcggaaagcccgataaaaggatgggcgatcggccttttgctgaaaaaaaaccagactgggcaccacgctccaaacttgaccgccaccgcgtggcagacgcagaaaatcaaagtccaccagtgcgcccttgagctggcgcaggccctcggcgtactgcagactgtgggtggcgtgccaccgcacggactgatcgtcggcgtctgagtacgtggttttgaactcaatcacgtagcaatacacgatgccgcgcgacccagagtccggcggtaaaaacaccaacacgcagtcgggaatccgccgacttaatcgtacttcgataaaaagacggcgacggtacttttgcaactcgggtgggaaaagacctcccaacaggcggttaagcgccacaaacgagggaaagacccgcagcaggcgacggtagatatccaggtgcttgcgcttaccgatccgcttacgcacgtgaggcaatctccgcagagcgttccccgtcaaatcagcgtcgtccccacgcccggacggcatggcttattcgcgtgtcccctcttctcccttcgcagcggccaatgacatcgtattaaatagacgaagacgcgacttttgtaacccgtagcgccgcacccgggtgctccttcctgggatcctttttctccttctctcgggtgtaacgccaaccaccacctggatcacgccgctgaacccagcggcgcggccgcgctatgcggcccggcctccccttctacctcaccgtcttcgccgtctacctccttagtcacctaccttcgcaacgatatggcgcagacgccgcatccgaagcgctggaccctcacgcgtttcacctactactcaacacctatgggagacccatccgtttcctgcgtgaaaacaccacccagtgcacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctagaaagataccaacagagacttaacacctacgcattggtatccaaagacctggctagctaccgatcttttccgcagcagctgaaggcacaagacagcctgggtcagcagcccaccaccgtgccaccgcccattgatctgtcaatacctcacgtctggatgccaccccaaaccactccacacgactggaagggatcgcacaccacctcgggactacatcggccacactttaaccagacctgtatcctctttgatggacacgatctgcttttcagcaccgttacgccctgtctgcaccagggcttttacctcatggacgaactacgttacgttaaaatcacactgaccgaggacttcttcgtagttacggtatccatagacgacgacacacccatgctgcttatcttcggtcatcttccacgcgtactcttcaaagcgccctatcaacgcgacaactttatactacgacaaactgaaaaacacgagctcctggtactagttaagaaaactcaactgaaccgtcactcctatctcaaagactcggactttctcgacgccgcactcgacttcaactacctggacctcagcgcactgctacgtaacagctttcaccgttacgctgtagacgtactcaaaagcggtcgatgtcaaatgctggaccgccgcacggtagaaatggcctttgcctacgcattagcactgttcgcggcagcccgacaagaagaggccggcaccgaaatctccatcccacgggccctagaccgccaggccgcactcttacaaatacaagaatttatgatcacctgcctctcacaaacaccaccacgcaccacattgctgctatatcccacggccgtggacctggccaaacgagccctctggacgccggaccagatcaccgacatcaccagcctcgtacgcctggtctacatactttctaaacagaatcagcaacatctcattccccagtgggcactacgacagatcgccgactttgccctacaattacacaaaacgcacctggcctcttttctttcagccttcgcgcgccaagaactctacctcatgggcagcctcgtccactccatgctggtacatacgacggagagacgcgaaatcttcatcgtagaaacgggcctctgttcattggccgagctatcacactttacgcagttgctagctcatccgcaccacgaatacctcagcgacctgtacacaccctgttccagtagcgggcgacgcgatcactcgctcgaacgccttacgcgtctcttccccgatgccaccgtccccgctaccgttcccgccgccctctccatcctatctaccatgcaaccaagcacgctggaaaccttccccgacctgttttgtctgccactaggcgaatccttctccgcgctcaccgtctccgaacacgtcagctacgtcgtaacaaaccaatacctgatcaaaggtatctcctaccctgtctccaccaccgtcgtaggccagagcctcatcatcacccagacggacagtcaaagtaaatgcgaactgacgcgcaacatgcacaccacacacagcatcacagcggcgctcaacatttcgctagaaaactgcgccttctgccaaagcgccttactagaatacgacgacacgcaaggcgtcattaatatcatgtacatgcacgactcggacgacgtcctttttgccctggatccctacaacgaagtggtggtctcatctccacgaactcactacctcatgctgttgaaaaacggtacggtcctggaagtaactgacgtcgtcgtggacgccaccgacagccgtctcctcatgatgtccgtctacgcgttgtcggccatcatcggcatctatctgctctaccgcatgctcaagacatgctgactctaggacctgacagtttacgagaaaaaggacagagaagttaaagacattcacacaaaaccttctaaaacggtacgggccccaacacttaggggcactcttgctcgttgtaataaagtacacgccacacggtgtgatggtactatgtgcgtgaggtctgtgcgtctttatttacgaggtactgttgtgggtctggttacatatcgggccctggatacaagctcggtacacagccaaggtgcgggagactaggtcgtcttggaagccgatgcaacaacggtagatgagcagcaaaacgaccagaatcagcagtgagtacacgcaggcaagccaaaccacaaggcagacggacggtgcggggtctcctcctctgtcatggggagaaaagaagacatgagaagcatttctaaattattctttattatatcactgactgtcctgttattttctataataaactgtaaggtcgttagaccaccgggacgttactggttaggtacagtactttctacgataggcaagcaaaaactagataaattcaagttagagattttaaaacaattagaaagggaaccttatacaaaatacttcaatatgactaggcaacacgttaaaaatcttactatgaatatgacccagtttccacaatactacattctagcgggtcccattcgaaacgatagtataacctatctgtggttcgatttttatagtacccagcttagaaaacccgccaaatacgtctactcacagtacaatcatacggctaaaacgataacattcagacccccatcttgtggtacagtgccttcaatgacttgtctttccgaaatgttaaacgtttccaaacgtaatgatactggcgaacaaggctgcggtaattttaccacgttcaaccccatgtttttcaatgtaccacgttggaataccaaattgtacgtgggtccgactaaagttaacgtagatagtcaaacgatttattttttgggtttaaccgccctacttctacgttacgcacaacgcaactgcacacacagtttctacctggttaacgccatgagccggaatctattccgcgtccccaagtatattaacggcaccaagttgaaaaacactatgcgaaaactaaaacgtaaacaagcgccagtcaaagaacaattagaaaaaaagactaaaaaatctcagagtactactacgccatatttttcctatacaacgtctaccgctctcaacgtcactactaacgcgacttatagggttaccaccagcgcaaagcggattcccacatctacgattgcttatcgtcctgatagcagctttatgaagtccattatggccacgcagttaagggatctagcgacatgggtgtatactactctgcggtatcggaatgaacccttttgtaaaccagaccgtaaccgtaccgccgtgtcagaatttatgaaaaacacgcacgtactgattcgtaacgaaacaccgtacactatttacggcactcttgacatgagctccttatattacaacgaaaccatgtccgtggaaaacgaaacggcttccgataataacgaaactacacctacgtcaccatcgacgaggtttcagaaaacgtttatagatcccctatgggactatctagactcgctgctgtttctagataaaatccgtaactttagcctccaattacccgcgtatggaaatcttaccccgccggaacaccgccgggctgtaaatctatccaccctcaatagcctttggtggtggttgcagtaaagttctgaaagcagcaatgtcgtagtacgatacaaaaggctcccatcagaatgagagcgttaagcatagtccaccaggctgcaaagctggacagtgaaagctcatacatatgcgatgtacaatgcgcattgtaaaaatcattgtgagcatgtggtctcatcacgttggggtcgtgagtggtggaaccgggtttggtactagtcgtcgatgaagtacttgtcgccgtagttgtactagttgtcgcaacagccgttgacttcacggttgttgaggtgcgagtagagctagaaggactcggtgtgctagcagtcgacgtattgttggaacttgccgctaccgataaaaccaaaagacctagtactagtgtgttccactccatcgcaccaccgccacgatgcttacgatgttgaccgaccgaatcgactctcaactggtactgtcgcggctgccgcgctcccgttttcagcgattctgggagacccctacgttaataatgaaggaagagtccgcaccgtcatcaggctccatcatcctagccgagaaatccgtcaacatgcgttactgcgtgcgtttcgctagcgatagcgattttcaaaccacatttacgctgccccaatcgatcgaggagaaatacgacaaagagcagcatccgggagaagatgaagcgtcgtcgccattaccgtcgccgctcaaagttccctacaagtggatgccttccagttttatcgtcaaacaatgccacacgcagctggccttttacaataaacacatcatttggctatcacgcgagcgcaaagtgcccacctcgctgggcgtcagcctctatatccccgaaggttttttcggcattaccttttacaaatgcctggacgcgcaattcgtttgcatgcccgagctgctggaatccgggctgcaagtcccgcagttggatgtcgtcaacctcaacgacacttttcagtccatctttccgggcaccatcgaaggcgatatcggcgttttcccctgttttgtgccagaaccctggcagctcatgaacttgccgccgcccaacgaacaccgtttcttttcattacgtacccgtcagacgctggtgatcggtccgggtcacacgcaaaccgtctattttgacgcggcctacgtgcacgcgcccggtatctgcgccctcatagtgggcgtgcgccagtttagtcagtcggatctcatcatccgacccactatctggctcccgggtaccgcggccggcgtgacggtggtcaacacttcgcacaccaccgtctgcatctccccacacaccaccgtagccaaagcggtttttaccacccaccgctttacctatctgccggtgggcagtcaccccctaggacagatgatcgtgccgcccacccccgacatcggtttcacccacacgcccgagcacgcgttgctgcaacggacaccctcgccggtagacgatgacgtcgacgagacagaagaagatgaaaagagctccgacgcagaaagccctgtcaacacgagtgacgttatttttgacgtaggtccgaaacctccccgtaatccctgacctaataaagtacgtctatgagaaaccccgtactcgtcgtgtccgtgatcacgtacgttttccaaaacgtgccaggctgttcacgcggaggacagcaaggccgccgccgtgggtttctttttcttcacgcccctgagttcacgcgcggaacccacaaagggtatctggggaggaggtatggtgaccatgttcggtgacatcaccgcctcccgaggcacgtcggggctgtgtcgcatgagatccaaaatctcgcgttcgtgattcgtaggcagcgtctcctgcggcgccgactccttgtagcgccgacggtgagacccgcgtccctggggctgctgctgcacgggctcgaccggcggctgctgttgcacgggctcgggtgacggcgacatcacggtcacttcatcctcctcgtcgccctcttccagcagccgctggtcgaacctcataacggtgggacaggagacggtgttaatgtgagccaaactcatcataggacgcgtgacccccgtttcctcggggatcagcgagtccgaaaccgagggacaggcaaaggccgacacggcggcgaccgtttccccgtcctcgcggacgccgctttccccctgaacgaccgccggtggcgtcggtggtgcaaccgtcgcagccacgccggcctcgagcatgtacgcgcttttctcgcagtccatgtccaccaggcccataacgcgctgcacctccaccagcgaggcctgatccgtggagaacttgtccagcaacatctccaggctgtcggcctcggacatggcaaactcgcccaccaccagtttgaggatgagaatgtccagggcctccaggatacgctgcgatttcttgcactccacctcggccgccggccgcgtgtgaggcaaacagccctccgagagatagcccttgagaaacgcgcacttgctctggcattgcctatagagcggcagcagcttcagcaggtggttcaccacgtccgtgtcgcgagaaaaggttcgcaggtcggccggggtgatctccagctgcttaaagttctcgtccagaaacgcctgcagctcgcgcagctccacgtcctcgctaggctgcagcagcacgtaatcggccacaggcgcggctttgcgacggcacatcagcagctcgcacaggcgctgggccagctgcatcgtgccggcgcgacgatgacgctcgttctgttcgcaacagagtatgattctgctcatatagtcgccaacgtactctcgcagacaccgacggaccactgcgtcttccccctgctggtcaaacaccaggtctcgcgacgtgtttatttctgcctacagacgcaaaagtgctcggactcgcggcgggtggcgcccgtcttcgccgtgaacaacgaaacgctgcagctctcgcgctacctggccgcgcgccagcccatccccctctcggcgctcatcgccagtctggacgaggccgagacgcaaccgctctaccggcatctcttccgcacgcccgtgctctcgcccgaacacggcggcgaggtgcgcgaattcaagcacctggtgtactttcaccacgcggccgtgctacgtcatctcaaccaggtcttcctctgccccacctcgccctcgtggttcatcagcgtcttcggacacaccgagggccaggtgctactgaccatggcctactacctattcgagggccagtacagcaccatctccaccgtggaggagtacgtgcgcagcttctgcacgcgcgacctgggcaccatcatccccacgcacgcctccatgggcgagttcgcgcgtctgctactgggctcgcccttccgtcagcgcgtgtccgctttcgtggcgtacgccgtggcgcgcaaccgccgcgactacaccgagctagagcaggtggacacgcagatcaacgcgttccgcgaacgtgcgcgtctgcccgacacggtctgcgtgcactacgtctacctggcctaccgcacggcgctggcacgcgcgcggttgctcgagtaccggcgcgtggtggcttacgacgctgacgcggcgcccgaagcgcagtgcacgcgcgaaccgggttttctgggccgccggctttccaccgagctgctggacgtcatgcaaaaatacttctcgctcgacaactttctacacgactacgtggagacgcacctactgcgtctcgacgaatccccccactcggcgaccagcccgcacggcctggggctggccggctacggcggccgcatcgacggcacgcacctggcgggcttcttcggcacctccacgcagctggcgcgccagctcgaacgcatcaacacgctttccgagtctgtcttctcgccgctggaacgctccctgtccggcttgttacgtctatgcgcttcgctgcgcacagctcagacctacaccaccggcacgctaacgcgttactcgcaacgtcgctacctgctacccgagcccgcgctggcaccgctgctggagcgaccgctgcccgtctaccgcgtacacctgcccaatgaccagcacgtcttctgcgccgtggcctccgaaacctggcatcgcagcctctttccgcgcgacctgctccgtcacgtacccgacagccgtttctcggacgaggccctgaccgagaccgtgtggctacacgacgacgacgtggccagcaccagccccgagacacagttctactacacgcgacacgaagtcttcaacgaacgtctgcccgtcttcaattttgtggccgactttgatttacggctgcgcgacggcgtctccggtctggcgcgacacaccgtctttgagttatgtcgcggactacgacgcgtctggatgaccgtatgggcgagcctctttggctacacgcaccccgaccggcacccggtctatttcttcaaaagcgcgtgcccacccaacagcgtgcccgtggacgcggccggcgcgcctttcgatgacgacgactatctcgattaccgggacgagcgcgacacagaggaagacgaagacgggaaagaggataaaaataacgtcccggataacggcgtttttcaaaaaacaacgtcctccgttgacacgtcacccccttactgccgctgcaagggcaaactggggctgcgcatcatcacgccgttccccgcctgcaccgtcgccgtacaccccagcgttttacgcgccgtggcgcaggtgctcaatcacgccgtctgtctcgacgccgaactgcacacgctgctggaccccatctcgcatcccgagagcagcctagacacaggcatctaccaccatggacgctctgtacgtctgccctacatgtataaaatggaccaagacgacggctatttcatgcatcgccgtctgttgccgctgttcatcgtgcccgacgcctaccgcgaacacccgctaggctttgtgcgcgcccaactggatctgcgtaacctgcttcaccaccacccgccgcacgacctgcccgcgttgcccctgtcaccgccgccacgcgtcattctcagcgtacgcgacaaaatctgcccctcgaccgaggccaactttatcgagacgcgctcgcttaacgtgacgcgttatcgacgccgcggtctcaccgaggtgctcgcctatcacctgtacggtggcgacggcgccactgccgctgcgatttccgacacggacttgcagcggctcgtcgtcacccgcgtgtggccgccgctgctcgagcacctcacgcaacactacgaaccgcacgtcagcgagcagtttaccgcgccccacgtcctcctctttcagccccacggcgcctgctgcgtggccgttaagcggcgcgacggcgcgcgcacgcgggattttcgctgtctcaactacacgcaccgcaacccgcaagagaccgtgcaggtgttcatcgacctgcgcaccgagcacagctacgcgctctgggccagcctctggagccgctgtttcaccaaaaagtgtcactccaacgccaaaaacgtccacatttccatcaaaatcagaccgcccgacgcgcccgtgccgccggcgaccgccgtctgagcctcactttccacggcgccggtgacccgccccccggcagcggtctcatctatatatacatcagcgtgcccgaacgtgaccttcctagcgacggcggccatggagctgcactcacgcggccgtcacgacgctccgtcgttatcttccctgagcgagcgcgaacgccgcgcccgtcgcgcacggcgcttctgtctggattacgaacccgtgccacggaagttccgacgcgagcgaagtccaacctcgccgtcgacacggaacggagcagccgccagcgaataccatctcgcggaagataccgtcggcgccgcctcgcatcatcaccgaccctgcgtccccgcacgacgaccccgctacagcaaagacgatgataccgaaggcgatccagaccactatcctcctccccttccaccctcctcccgccacgcactcgggggcaccggcggacacatcatcatgggcaccgcgggcttccgtggcggacatagagcgtcctcctctttcaagcgacgcgtggccgcgtccgcctcggtgccccttaacccccactacggtaagtctcacgacaacgatgacggcgaaccgcaccatcatggcggcgattcgacgcatcttcgtcgccgagttcccagttgtcctacgactttcggttcttctcacccctcttcagccaataatcatcacggatcgtccgccggaccgcaacaacaacagatgctggcgcttattgacgacgaactggacgccatggacgaggacgaactacagcaactcagccgtttgatcgaaaagaaaaaaagagcgcgtctgcagcgcggcgccgcctcgtcgggtacctcaccgagttctacctcgcccgtctacgaccttcagcgctacacggccgagagtctacgtctggcaccctaccccgccgatctcaaggtccccaccgccttcccgcaagatcatcagccgcgcggtcgcatcctgctgtcacacgacgagctcatgcacaccgactacctgttgcacatccgtcaacagttcgattggctggaggaaccgttgctgcgcaagctggtggtggaaaagatcttcgccgtgtacaacgctcccaacttgcacacgttgctagccatcatcgacgaaacgctcagctacatgaagtaccaccacctgcacgggctacccgtcaacccgcacgatccctatctggagacggtgggcggcatgcgtcagctgctcttcaacaaactcaacaacctggacctgggctgcatcctggaccaccaggacggctggggcgaccattgcagcacgctcaaacggttagtcaagaagcccggtcaaatgagcgcctggctacgcgacgacgtctgcgatctgcagaagcgtccgcccgagaccttctcgcaacccatgcaccgcgccatggcctacgtgtgctctttctcgcgcgtggccgtctcgctacgccgtcgcgcgttgcaagtcaccggtacgccccaattttttgaccagttcgatactaacaacgccatgggtacctaccgctgcggcgctgtctcggacctgatcctaggcgccctgcagtgccacgagtgtcagaacgagatgtgcgaactgcgcatccaacgcgcgttggcaccctatcgtttcatgatagcgtactgtcccttcgacgagcagtcgctattggatctcaccgtctttgccggtacgacaacgacaaccgccagcaaccatgccactgccggcggacaacagcggggaggagaccaaattcatcccaccgatgagcaatgcgcaaatatggaaagcaggacggacccagcaacgctgacagcctacgataaaaagaacagagaagggagtcatcgacatccctctccaatgatcgccgccgctccttccacccagccaccgtcgcaaccacagcagcactactctgagggcgagctggaagaggacgaagacagtgacgacgctagcagtcaagatctggtacgagccacggatcgacacggggacaccgtcgtctacaagacgaccgcggtccctcccagtcccccggcgcccctcgccggtgtccggagtcaccgtggtgagcttaacttgatgacgccgtcgccttctcacggcggcagtccaccccaggttccccacaagcagcccatcatcccggtgcagtccgccaacggtaatcacagtacgacggcaatccagcagcagcagccgccgccgccgccaccaccggtaccgcaagaagacgactcggtggtaatgcgctgccagacgcccgattacgaggacatgctgtgttacagcgatgatatggatgactaaaaagagagtgaggggtgttgtgcgtgattgctgtcccttatcccgttacaaagaaaaaagaaaaaatggtgttacacactccttggtactactatgactcgtggtgagatatccgatgatgataatgatgtacgcgtgcctgagcttggtgtttttttttctctctgtgagcttttttccccataagctgtgtactgttcgtgtccggaccccatacacggtttccgttaatgacggccccctccttttcccccaccgtaaaaaaaaaaaacaaagcacaatacacatgtggttttttggttcgaatcgagcttggcgtttatttcttctcgagccccacgtcctctccctcccattctttttatatatacacatgcccaagattggggggggggggaacgtgtgtcgtttccaggtcgtggtgacgatgatgatgtggtttttatcggggtggtagtacaagggtttgctactgtagtcgaaaaggtgggccgagaacatagaggaactaactcctaagcgatggctcaaaggcggatgagcaaatcattaaaatccttgactgtctatggttatgcaaaaggatatataaggtataaatagcgtatataaaaacatatatctatgtacaagacgcatgggataaataacacgtatttacacatttttctgcacatgtacaacatttgaggacgaggagacgacgaccggccggtcgccgccgccgcggttgctactactttcttaagtgatgcgaattggtggctatggtgaggagtttggaggaaataatatacatcatatattctgatgacagtgtagtaaacatttcactggcttcggcccggtgcgacggagggccccgacgtcccctctcccggaggggggaagaggcacgacgagcgagggccccgtcgtacgaggaacaagaatcttcttcattctttcacagtaaagcacatttctttatgtggggacgggaatcgatgtcatttgtgtatttgcattcggtagagagctacagtctccagtttcacgatcgttgtgcatcatacaacgacactttttatcctacaaatttcacacctatctatatacacacaatataaggttatagcatcatctagtttgttcatttcatacctgttgagaacgtttatgttctagcaattgatttcgcgtcatagggctgtgacggtgattcttcagagaatcagaaaaaaaaaagaggctcaacgagcaccagagactaagtcggaaaactcgcgcccgcttccccggacggtttcagcttagcctctggcctgcgatggtttttttattccaagttcgttccatgaatagagcgttatacgattgtgttttcgtgtcattcagacgtggttgatcatgttactacgtgtgtgttttttgctttggtcggtacacggtccctttcagcggacccagtgttccttggagagacgaaaagcgagcgtgtttcacgagatggctgatgccgagtgtcgtcgacataagtcattttctaaagaagcaacataaaaaaaagatgatgtggttcgtcgtactcacagtctcgtttagctactatagatattatagatccagagagcgtaccgcccgagagaacaccgtcttctccgggacgtcttgccgtcgtccgtcacccgggcgtcgagatgttcgtagagaacgatggaggacgaccaacaccgacaggtggtgctcatgagggtgtggtgtcgatggtgcgttttttttttttgcctcggcacgaccgtatttgcccgtcttaccgcacctccggaaagatggtgtttttacgcaggtgggtgaggcagttttttcagatgacaacgatggtaccgatagagcctgagatgatgatgatgatggctacgaaggacgggcggacgggcaaacgatggtaagaggtcgctaccgaggggtgccttttttttttctggtcagatggaacgtcgtcggtctcgagcgccccccgatgtagggccgctctcttacgtatcccgggtcgattcagaccgacaaaaagagcgtccagagacgcggtctctttcttctcgaacggaaagtccgaatcctacacatttctagtcgtgacggctagctttttggtggtcatggcggtggtggtcaacatatatctccagatataggagatgaggaaaaaaaaggaggacaagtctaacggaataatatccgatcatatatatggagggatatcaggtcatcattgtgtatcaaaagatgatttgtacaacagggaaggatacggttttaaaggttagtgcagagaaactatataaagagcgtataacatggagttcattctgtcattaaaaaggttctaagtagagcatattaaaaatagacgagagctagagttttattcttggttcatcatatattttgtaaaaaaaaatagaaaaatataggtgccggacgccggctacgtcccagtccggggcttagcgcacccaaacgcaggtttcccccgttttcaaacacctcaagatcttttgagaaacacatatttttgttatacacagtgaaaacgtggggggacagagttccaaacacgtgtctatcaagcaaaaattcagacgatataaatatggagagttttttcttcttatacaacagcgacagttcggtgtacatagcgtataatatatataggtcacatacagacttatgagctttttaccaaacagatgcaaatcgcctaccggaggcgggatcgggcgtgaggttctggctgcacccgcccgatccctcgtcggcttctccggcggctgtcctaaaatgactaggttcgtatatagagctataggtctttcatgatactgatgagaaatctatggtttgcgcgtcttatctgaatatatctagcacgatatagacgatacacgtcaagatcattgtatcacttcttttcgtctacgtggtaagagtcttggatactaaatatgtatataggcagcatttatagtttcaaaggatagaagatagtttttggacactgatagatatggcgttgttgagcggttgtgttggatgaacttgtcatcattctgtattttttcacataaggtgttcttttcttcgagcagtttataaaaggggtcaggcgcgatgactagagggcgcactttgggtgcggtcctccatcgcttgtcaacaaccggatgtgactcagcgagcacgagatggtttgacgtcagcgaccgttagccctcagggcgaaaacaggaagagtcgcctcgacagcgccctctaggtagcatcacggaacaggcggcgaccgcggactcgcctcagccagggggtaccgaggcggtgcccgcgactcgcccctcctccaagatggcgccgctcggccagactcgtcgagattttcagggctatcattttttcgctctgagcagaaaaaagctcttctaaaacgtctcaaaaaaagcacagaaaagttatcgtgctatttttttacccgcctggagcgaaaacgctcctaggctctcgacgccattttctctcgtccgccatgtcggagctcagaacggcatgacgagcgagagaaccgtcgaggtcaccaagatggcgccggttggggtgcggtcaaacggtgttttacagtttcggggccatttgaacagagaaaggtggggaattttaagggacacggttttgtcggatgggggagaaaatcacgccctgccgtcgtattgtctcgaatttttttcggccgtctgtacccgtatcggttcacgggttttccacggcaaatcggggaagggaaaaaaaaatggtggggcctgttcccttcccgggtctcggacgggtcgacacgccgggtgggacggtcgtggtctcctcggcccgtgccgggaccctccccgtggattcacggtgttccggacccctccaggaaagggtggaaaacgcgtggagcccacggggacgtgcgttcgtgccggggaaaaacccgactgggcctgaaccaacgttgggtgacctgccgggcccatcgtgtggggacggtgattgtggaggggcgtactgacgacaattgaagtgtcatggcggcccaccgtcgaccccgagcgcttccggccacacccaacctcgccgccgcatcggccagcacacacgccacagcctggtggggtccgaggcgccgaccccggctgggcggccgatggggggaggggagtggggaccacgcccagggccagcaagccgcgacggttcgggcggacttttttggggagcagcgggggaggggagcgtcacgggaccggccaacgcccaggataaggcggcccgagagccggcggctaggccgagggacccccggtcacgactggcggccggaccctcgagaggggggaggggagcccaaccggagccgccgagagggagccgccgcgagacccggaagccgtcgcggtcgaccccgctcccggagctcctgaccgggcccccagcccccaaccttccgggaccgactgccgttgagccggggcgtcgcccgtccccaccaccgtccacccggcccacctaccgtcgtcgtcggccgaccgccgcgacccccagccggaaaaaagcccggaggggcccaaaagccagcggggcgggccgggaaggggagctgggtggggaatccccggtcgcccaccgcggaacgagcctaggaaccggggtccgcgacccagccccccgtggggggaggggaagggcgcggaccccgggtcccgtccgttccgcggcgggtggaccgggaagccggcggaggtcgccgggagcagcgagggatcccgggccggagcccggggaggagcggggtgggggtgggaagcccccgctcgggtccccccgggctgcggacgggaaccggaaccccggtgcgggggtcccagcccggccgggccgtcggatggggggtcgagcggggggaggggagggacccccggccgaggtccggagcgggccgcgcccggtgcccggcccacggccccggatggtgctccagggcggtgggacgggcccgcggacggaccggcgccgggcctcggccggggagggtggggggtagggcgggaagcaggcgggagcgggcgcagcgtgcggaccgcagcacggccggaaccctgccgcggactgcgccggggggcggcgggcacgccgggttttataggttttcagatgccccgcctaggtgggcggagcggtaattttccaccgccgcggcccatgcccggcacggggctcgcgctccctaggtgcggccgcccagtggaaaaacaccggcgcatgcgcacggcgcacatccagtggaattttaccgacgcatgcgcactgaccgcctccagtggaaaaatactggcgcatgcgcacgacacacacccggtggaattttaccggcgcatgcgcagggcgaccctcccgcggtccctggctcgcgcatgcgcaccggggcccctggttcacccctccttatatataggttttccatgcggcatccccggcgcatgcgcactcgagtccccatcccataatccgcgtggcaacgccctgacaaccaaaaactcgccccgactgcgcatgcgcacggaaacgccgtcccattggaaatcatggttgcccaaatttggtaaaaatttgccccccccggttccggaggagaagggggggggtgaggggggggggttacggtggttcccgttccgccagtccgttttcgtagaacgtttcgttagaagagttatgctatatagggtatgcatcctaggggtggaagctaggctccgcccctgcggggcgtcgcctagcatccggtatacgtaaaacggactgatgacgtagctcgcttcgctcgctacgtcatcagagatgatttccgccggaggtggcgcacgcatacgtgacgtagctcgctacgctcgctacgtcatcgtatgtccggaattccacgggatgacgtatatccggagtgggtgtggtcacgcgagtgtgacgtaggcttgtcaggggtcacgtgagaagcggcggcgttaagtttactaggccaaaacagaggaagggggcggataccctaagtaagggggcgtgcacgtagccctgtagacactcccccctagggtccagtagcttatgacgcgtatccgggagtagcgtctacgtcagcaggtgtatatttccggtaaacggagaagcctgtacgtacaccgaggacggtggaaccctaacgggttccacctatctgaaatttccgtacaaggggtggagtctagggaggggtcattgtatattcgtttctgtgattggtagataaggtagcgtacctaggggtgtggatgtatacgtaagcggatatggctacacgtaatgggtgtggcttcactagggatcgctgtattctaccgcgcgcgtgcgtgcgcgcgcgtgacgtaacaaatcaccttgtgattatgacgttggcatctggcaccgcctcttgggcggttctacgggcctcgcttcctgcgcggatggtcacgtgaccaacaaaagtgctcaccgcctcgccggccacggggttgatgcctgttcttatgccgacaccagatggcgctcattgaccaggaaagctgtctacgcgggttttacagtgtgtttttgcgtcattgtgacgtagagccggcgatcgccacattcgatggtgtacgctcgccgccagatgtcgtcagattgtacccaaaaccccgttatgattacacgctggcttccgcattcttaggcacggcggtttcaggttacattacatcaagacgcgacaacgccccgaataaaaacaccgggcaccgttatgtatacacgacgtcgatactgatcgccgtagtgacgtcagtcgacacacaacaccgttccccatcacggtgtttcatggcaatgggcgaaagttactttttacaagacgaaaaatgtgttttttggtaaaaagagggggatgggaaaataaaaatacacaattttaaagttcggatcttttcctgttttattgactcgtaaactgtaaggtcttcgagtacgtgtcgggggtctgtgccgcgtacgtgttcgggaaaccacgttacgcggtttgtgtcgtgttgtaacgttgagataatacacacgtttggcgcccataggcgcgcaggtttttggggtgtgtaacttgtacggcgttttgtcggcggagcgcagcgaaagtcggtggtgatagcggcgattgaggttgcgagaccagatccaccgcgcttgtaccaccgtggtgcggtgtttctgcttgtaaaccgtcaggtggttctttgtgatttaaaaacaccgtgttcgcgaaacgtgacttttcacggtttgttagctgatgtgattttggaggccacaaacaccgtacggtgtttccggggatcgggctcgggatttgcctgtgtggcccggtgacggtaggacagaaaacaccgttttctagggacgttgttttcacgtgccctgtgtggggtttttatgtgctgcttgtgcgactgagtgggaaaacgggttgtgatcggacggtgtgctgaggataaacgacgtgcgcgactaccgacgttagtttgcggtgacgcgaagccgtcccgaacatcacgctattttcgcgggcgggtgcgtcggctagcggtctggctgcgagaggctgcccgaccgtaacggttagcttttcttacgaattgctgggatcgttgcggttgtcgccttcggtggtccgcaaccgcagccagaccgtagtggtggccacggtggtgtatcagacgtcgtgcgtcaaacatgacgtgctgaacttttccttggtataaaattcactcagtggcggcgtagccattgtcttccgttcatccaccatgagccacgaggaactaaccgcgctagcgccggtggggcccgcggcttttctctacttcagcaggttgaacgcagaaacgcaggagattctggccactctctcgctatgcgaccgttcctcgagcgtggtgatcgctcctctgttggcggggctcacggtggaggcggatttcggcgtttctgtgcgcacgcctgtgctttgttacgacggcggggtgcttacgaaagtcacgtccttctgtccttttgcgctctactttcatcatacgcaaggcatcgtggcttttaccgaggatcacggagacgtgcatcggctgtgcgaggacgcccgccagaagtacgcgttggaggcctacacgcccgaggcggatcgcgtgcctaccgatctggcggcgttgtgcgcggcggtgggctgtcaggcgtccgagacgactgtgcacgtggtggtgggcaacggcttgaaggagtttctctttgccggtcagctgattccatgcgtggaggaggcgaccacggtgcgactgcacggcggcgaggcggtgcgcgtgccgttgtacccgcctacgctctttaattcgctgcagcttgacgccgaagccgacgaggtctcgctggatgcgcgcagcgcttttgtggaggcgcgagggttctacgtgccggccgtaagcgagacgcttttctactacgtgtacacgtcatggtgtcaatcgctgcgcttctcggagccgcgtgtgctgatcgaggcggcgttgcggcagtttgtgcacgacagtcagcagtcggtgaagctggcgccacataagcgctacttagggtacatgagccagcgactcagcagtctggaaaaggatcatctgatgctgagtgacgcggtggtttgcgagttggccttcagttttgcctcggtatttttcgattcggcctaccaacctgccgagtctatgctcttttccgagtggcctttagtgaccaacgcaaccgatcaccgcgatctgatccgcgcgctgaccgagctcaagttgcatctctcgacgcacgtggccgccttggtcttcagcgctaattcggtgctctaccagcacaggctggtgtatctccagtcgtcggcgcggcatcccagcgccggcggtacggccagtcaggagacgttgctcaaggctattcagttcaccaacgggttgtcggcggcctgcgaagacgtctacaacgacgcgcgtaaggtgctcaagtttcaaggcgcgccgcttaaggacgaacgctatgggccgcagcatttggcgttggtgtgtggcacgtgtccgcagctagtttcgggcttcgtctggtatctaaatcgtgtctcggtgtataacacgggcttgtcgggttcgtcaacgctcacgaatcacctggtgggctgcgccgcggggctgtgcgaggcctgtgggggtacttgttgccacacgtgttatcagacggccttcgtgcgggtgcgcacccgcttgcccgtggtgcccaagcagcccaagaaggagccctgcgtgatcaccgtgcagtcgcgttttctcaacgacgtggatattttgggcagcttcggtcggcgttacaacgtcgacgccaaggacgggggtttggacggcaaaggtgacgacggggttccgggcggcggtgctggcgggggtggtggacgggacgtgagcgggggctcgagcgacggtctgggcggcggtcgtggtggtgggggtggcggggattccgggggaatgatggggcgcggcggtcgcatgctgggcgctagcgtggaccgtacctatcggctcaatcgcattttggattactgccgcaagatgcggctcatcgaccccgtgacgggcgaggatacctttagcgcgcacggcaaaagcgactttgtggccgtcttttcggcgctcaacaagtttgtggacgacgaggccctgggtttcgtttcggaggtgcgcctcaagagcagccgcgacgaggtggcgggcgccacgcaggccttcaacctggatctgaatccctacgccgtggccttccagccgctgctggcctacgcctatttcagatccgtcttttacgtgatccagaacgtggcgcttattaccgctacctcatacattgtggacaatccgttgaccaccaacttggtatccaaatggatgacgcagcattttcaatccattcacggcgcgttctccaccacgtcgtcgcgcaagggctttctcttcaccaagcagatcaagtcgtccaagaattcggatcacgaccgcctgctggactttaggctgtacgcgcagggcacgtacgccgtggtgcccatggagatcaagctctcgcggctgtcggtacccacgttgatcatggtgcgggtgaaaaaccgacccatctaccgcgcgggcaagggcaacgcgggtagcgtgttttttcgccgcgatcacgttccgcgtcgtaatccggctaagggctgcttgggatttctgctgtatcgacatcacgagcgactctttcctgaatgtggtctcccctgcttacagttttggcagaaggtctgttccaacgcgttgcccaagaatgtgcccataggtgacatgggcgagttcaatgctttcgtcaaatttctggtggctgtgacggctgactatcaggagcacgatctgctggatgtggcgccagactgtgtgctgagttacgtggaaagccgtttccataacaaattcctctgctactacggcttcaaagactacatcggctcgctgcacgggttgacgacgcgcttaacgacgcagaaccacgcgcagtttcctcacgtgttaggtgctagtccgcgtttctcgtcgcccgccgaatttgcgttgcatgtcaagggcttgaagaccgcaggcgtgccggcgcccatggccgccactgtggcgcgtgaatcgttggtacggagcgtttttgagcatcgttccttggtgaccgtgcccgtgagcgtggaaaaatatgcgggtatcaacaacagcaaggagatctatcagtttgggcagatcggctacttttcgggcaacggtgtagaacgcagccttaacgtgagctctatgagcggccaagattatcgtttcatgcgccagcgctacctcttggctacgcgtctggccgacgtgctcatcaaacgctcgcgccgcgagaacgtgctttttgacgcggatcttataaaaaaccgcgtcatgctggcgctggacgccgagaacttggattgcgaccccgaagtgatggccgtgtacgagattctgagcgtgcgcgaggagatccccgcgtctgacgatgtgctcttcttcgtggatggctgcgaggcgctggccgcgtcgctgatggacaagtttgccgcgttgcaggagcagggcgtggaggacttttcgctggagaacttgcgacgcgtgctggacgccgacgcccagcgattaacggacgccgccgggggggaggtgcacgacctgtcggcgctcttcgcgcccagtggcgtcggcgcggcgtccggcgtcgggggtggcggtcttctcggcgagtccgtcgcgggcaactccatttgcttcggcgtgcccggcgagacgggaggtggctgctttctcgtgaacgccggcgaagacgaggctggcggcgtcggcgggagcagcgggggcggcgggggcagcgggttattgccggccaaacgcagccggttgtaaccgccagcaaacgccgcgacaacggccgccgcagccacgagcatcgcaacaacagcagcaacagtcgcagcccccgtggccgcttttcagaccgcaacaacagcagcaacagcagccaccgacacagcagcaccaggcgacaccgtatcagctaccgccgcaacagcggcgacagacggcgtcgcatcatcaacagcagcaacagccccgaaggttagcgccgcggcaccagagacagagaccgccgccgcgctggcaaactccgacattcgcgtcggcgcccgggccgcctgaggaaggggaggagtgtcagacacagccggtcatctccgagcccccgtcgcccgaggcggaggagccggcggcggcggtggtggaggaggttgcgccgcaagcggcggcaacagcttcgggagcagaacccgcgtcgtcgacgacgtcgttatatattaacgtcaacgtcagtcggcatagcgagcggcccgcgagttatttgtgcaccgactccatgtctctggccggcgccagaccggacgacagcgtctcgtacgtgagcgagtcgagtcatggagatgaatttgttacagaaactatgcgtagtgtgttcgaaatgcaacgaatacgccatggagctggagtgtctaaagtactgcgatccgaacgtgttactggcggagtccacgccgttcaagagaaacgcggcggctatagtgtatctgtaccggaagatctacccggaggtggtggcgcagaatcgtacgcagagttcgctgctgacgctctatctggagatgctactgaaggcgctgcacgaggatacggctttgctggatcgggcgctgatggcctactcgcgccagccggaccgggcggccttctaccgtaccgtcctccgtttggatcgctgcgatcgccatcacaccgtggagctccagtttacggacaacgtccgtttcagcgtcagtctggccacactcaacgacatcgagcgcttcctgtgcaaaatgaactacgtgtacgggatcctggcgccggaggccggcctggaggtctgcgcgcagctgctggagctcctccgtcgcctatgcggcatctcgccggtggcgcgtcaggaagtgtacgtcgaagggacgacatgcgcccaatgctacgaggagctgaccatcatcccgaatcagggccgctcgctgaacaagcggctgcagggcttgctgtgcaaccatatagcggtccaccgtccgtcaagccagtccgatgtgaatatccagacggtggagcaggacctgctggacctgacaactcgcatcccccacttggctggagtcctttcggccctcaaaagcctattctcttcttcatcggcctaccacagctacatccaggaggcggaggaggcgctgagggagtacaacctgtttacggatataccggaacgaatatattccttgtcggattttacctactggtcccgtacctcggaggttatcgtcaagcgggtgggcatcaccatccagcagctaaatgtgtatcaccagctgtgccgggcgctcatgaacggcatcagtcgccatctgtacggggaggacgtggaggacatcttcgtgctcggggaaaaggcgttggacggggaggagcgcatgttcgtggggtcggtctttgccgcccccaacaggatcatcgacctcatcacatccctcagcattcaagctttcgaggacaacccggtgttcaacaagctccacgaaagcaacgagatgtacaccaaaatcaagcatattctcgaggagattcgacgtccgctgcccgatggcacggggggcgacggccccgagggcgaggctattcacctgcgtggacgggaggcgatgtcggggacgggtacgactttgatgacggccaacaacagcagcaacagcagtactcacagtcagaggaataacggtggcggcggccgggcccgtggaggaggcaagaaagctgtagggggaggggcgaatgggcaggacggcgacggcagcgagaacggcttacgggtgcgcaactgcgacgaacacgaggctctcgacttggtggacgcgcgttcccgcatccacaacgtcacccgcgaggtgaacgtgcgcaaacgcgcctacctgcagaaggtctcagaggtgggctatggcaaggtgatccgttgcatcaaaacgcaggagcgcctgactagcaaactcatcgatgtcaacctagtggggcccttgtgtctggactttatctctaagctcatgaatgggtttctataccgcagccaataccaccaggaccaagacgtggtggacgtgggggatcagttcacgtacgatgagcacctgtatgtggtcaataacctgatccacaagagtctgcctgtggaatccctcccgctactgggtcagcagatctacgagttgtgtaacgggcccctcttcacacactgtaccgatcgctatcccctctctcacaatgtggacatggcctatgcctgcgacaacgcgggcgtactaccccacgtcaaggacgatttggtcaaatgcgcggaaggtaccgtgtatcccagtgagtggatggtggtgaagtacatgggttttttcaatttttcggactgtcaggacctaaacgtgctgcagaaggagatgtggatgcacgtgcgggagctcgtgctctccgtcgcactatataatgaaactttcgggaaacaactctcgatcgcgtgcctgcgcgacgaactgcacccggacagagatgtgattctcacgtataacaaagagtggccgctgctgcttcgtcacgaaggaaatctttataagtccaaagatctatatctcctcctctacaggcatctgtccagaccggatgagagtggcgacgtgccaacagctcccgtggctaagccctccaccctgacggccgcggcggccgtctcgggtgccttcagggagccggaccgaccttggctgccaagtccgtacccctcctcctcgactgcgggcgtttcccggagggtccgcgcgacacgcaagagaccacgacgcgcctcatcgctgctggatttggcccgcgacgaacatggaatccaggatctggtgcctggtagtctgcgttaacctgtgtatcgtctgtctgggtgctgtggtttcctcttcttctacttctcatgcaacttcttctgctcacaatggaagccatacttctcgtacgacgtctgctcaaacccggtcagtttcttctcaacacgtaacgtcttctgaagccgtcagtcatagagccaacgagactatctacaacactaccctcaagtatggagatgtggtgggggtcaacaccaccaagtacccctatcgcgtgtgttccatggcccagggtacggatcttattcgttttgaacgtaatatcgtctgcaccccgatgaagcccatcaatgaagacctggacgagggcatcatggtggtctacaaacgcaacatcgtcgcgcacacctttaaggtacgggtctaccagaaggttttgacgtttcgtcgtagctacgcttacatccacaccacttatctgctgggcagcaacacggaatacgtggcgcctcctatgtgggagattcatcatatcaacaggcacagtcagtgctacagttcttacagccgcgttatagcaggcacggttttcgtggcgtatcatagggacagctatgaaaacaaaaccatgcaattaatgctcgacgattattccaacacccacagcacccgttacgtgacggtcaaggatcagtggcacagccgcggtagcacctggctctatcgtgagacctgtaatctgaactgtatggtgaccatcactactgcgcgttccaagtatccttaccattttttcgccacgtccacgggtgacgtggttgacatttctcctttctacaacggaaccaatcgcaataccagctactttggagaaaacgccgacaagtttttcattttcccgaactacactattgtctctgactttggaagagcgaattctgcgccagagacccacaggttggtggcttttcttgaacgtgcggactcggtgatctcctgggatatacaggacgagaagaatgtcacctgtcagctcaccttctgggaagcctcggaacgtactattcgttccgaagccgaagactcgtaccacttttcttctgctaaaatgactgcaacttttctgtctaagaaacaagaagtgaacatgtccgaccccgtgttggattgtgtgcgtgatcaggctctaaataagctacaacagatcttcaacgcctcgtacaatcaaacatacgaaaagtacggtaacgtgtcggtttttgaaaccacaggcggtctggtggtgttttggcaaggtatcaagcaaaaatctttgttggaactggaacgtttggccaatagctccggtgtgaactccacgcgtagaaccaagagaagtacgggcaatacgaccaccctgtcgcttgaaagcgaatctgtacgaaatgtgctctacgctcagctgcagttcacctatgatacgttgcgcagctacatcaatcgggcgttggcgcagatcgccgaggcctggtgtgtggatcaacggcgcaccctagaggtcttcaaggaactcagcaagatcaatccatcagccattctctcggccatctacaacaaaccgattgccgcgcgtttcatgggtgatgttctgggtctggccagctgcgtgactatcaaccaaacaagcgtcaaggtgctgcgtgatatgaacgtgaaagaatcgccaggacgctgctactcacgacccgtggtcatctttaatttcgtcaacagctcgtacgtgcagtacggtcaactgggtgaggacaacgaaatcctgttgggcaaccaccgcactgaggaatgtcagtttcccagcctcaagatcttcatcgccgggaactcggcctatgaatatgtggactacctcttcaaacgcatgattgacctcagcagcatctctacagtcgacagcatgatcgccctggacatcgacccgctggaaaacactgacttcagggtactggaactttactcgcagaaagaactgcgttccagcaacgtttttgacctcgaggagatcatgcgcgagttcaactcgtacaagcagcgggtaaagtacgtggaggacaaggtagtcgacccgctgccgccctacctcaagggtctggacgacctcatgagcggcctgggcgctgcgggaaaggccgttggcgtagccattggggccgtgggtggcgcggtggcttccgtggtcgaaggcgttgctaccttcctcaaaaaccccttcggagccttcaccatcatcctcgtggccatagccgtcgtcattatcatttatttgatctatactcgacagcggcgtctctgcatgcagccgctgcaaaacctctttccctatctggtgtccgccgacgggaccaccgtgacgtcgggcaacaccaaagacacgtcgttacaggctccgccttcctacgaggaaagtgtttataattctggtcgcaaaggaccgggaccaccgtcgtctgatgcatccacggcggctccgccttacaccaacgaacaggcttaccagatgcttctggccctggcccgtctggacgcagagcagcgagcgcagcagaacggtacagattctttggacggacagactggcacgcaggacaagggacagaagcccaacctgctagaccgactgcgacatcgcaaaaacggctaccgacacttgaaagactctgacgaagaagagaacgtctgaaccaggagaagaaaaaaaaaaacagacaaaaaaagtgacagagacttgtgatatacggggttaaactggatatctaggtgctgcatgtgtattttctttgtgattttgcttcgtaagctgtcagcctttcacggtccgctatgtttttcaacccgtatctgagcggcggtgtgaccggcggtgcggtcgcgggtggccggcgtcagcgttcgcagcccggctccgcgcagggctcgggcaagcggccgccacagaaacagtttttgcagatcgtgccgcgaggcgtcatgttcgacggtcagacggggttgatcaagcataagacgggacggctgcctctcatgttctatcgagagattaaacatttgttgagtcatgacatggtttggccgtgtccttggcgcgagaccctggtgggtcgcgtggtgggacctattcgttttcacacctacgatcagacggacgccgtgctcttctttgactcgcccgaaaacgtgtcgccgcgctatcgtcagcatctggtgccttcggggaacgtgttgcgtttcttcggggccacagaacacggctacagtatctgcgtcaacgttttcgggcagcgcagctacttttactgtgagtacagcgacaccgataggctgcgtgaggtcattgccagcgtgggcgaactagtgcccgaaccgcggacgccatacgccgtgtctgtcacgccggccaccaagacctccatctacgggtacgggacgcgacccgtgcccgatttgcagtgtgtgtctatcagcaactggaccatggccagaaaaatcggcgagtatctgctggagcagggttttcccgtgtacgaggtccgtgtggatccgctgacgcgtttggtcatcgatcggcggatcaccacgttcggctggtgctccgtgaatcgttacgactggcggcagcagggtcgcgcgtcgacttgtgatatcgaggtcgactgcgatgtctctgacctggtggccgtgcccgacgacagctcgtggccgcgctatcgatgcctgtccttcgatatcgagtgcatgagcggcgagggtggttttccctgcgccgagaagtccgatgacattgtcattcagatctcgtgcgtgtgctacgagacggggggaaacaccgccgtggatcaggggatcccaaacgggaacgatggccggggctgcacttcggagggtgtgatctttgggcactcgggtcttcatctcttcacgatcggcacctgcgggcaggtgggcccagacgtggacgtctacgagttcccttccgaatacgagctgctgctgggctttatgcttttctttcaacggtacgcgccggcctttgtgaccggttacaacatcaactcttttgacttgaagtacatcctcacgcgcctcgagtacctgtataaggtggactcgcagcgcttctgcaagttgcctacggcgcagggcggccgtttctttttacacagccccgccgtgggttttaagcggcagtacgccgccgcctttccctcggcttctcacaacaatccggccagcacggccgccaccaaggtgtatattgcgggttcggtggttatcgacatgtaccccgtatgcatggccaagactaactcgcccaactataagctcaacactatggccgagctttacctgcggcaacgcaaggatgacctgtcctacaaggacatcccgcgttgtttcgtggctaatgccgagggccgcgcccaggtaggccgttactgtctgcaggacgccgtattggtgcgcgatctgttcaacaccattaattttcactacgaggccggggccatcgcgcggctggctaaaattccgttgcggcgtgtcatctttgacggacagcagatccgtatctacacctcgctgctggacgagtgcgcctgccgcgattttatcctgcccaaccactacagcaaaggtacgacggtgcccgaaacgaatagtgttgccgtgtcacctaacgccgctatcatctctaccgccgccgtgcccggcgacgcgggttctgtggcggctatgtttcagatgtcgccgcccttgcaatctgcgccgtcgagtcaggacggcgttttaccaggctctggcagtaacagtagtagcagcgtcggcgttttcagcgtcggctccggcagtagtggcggcgtcggcgtttccaacgacagtcacggcgccggcggtactgcggcggtttcgtaccagggtgccacagtgtttgagcccgaggtgggttattacaacgaccccgtggccgtgttcgactttgccagcctctatccttccatcatcatggctcacaacctttgctactccaccctgctggtgccgggtggcgagtaccccgtggaccccgccgacgtatacagcgtcacgctagagaacggcgtgactcaccgctttgtgcgtgcttcggtgcgcgtttcggtgctttcggaactgctcaacaagtgggtttcgcagcgccgtgccgtgcgcgaatgcatgcgcgagtgtcaagaccccgtgcgccgtatgctgctcgacaaggaacagatggcactcaaagtaacgtgtaacgctttctacggttttaccggcgtggtcaacggcatgatgccgtgtctgcccatcgccgccagtatcacgcgcatcggtcgcgacatgctagagcgcacggcgcggttcatcaaagacaatttttcagagccgtgttttttgcacaatttttttaatcaggaagactatgtagtgagaacgcgggagggggattcggaggagagcagcacgttaccggaggggttcgaaacatcgtcagggggctcggacgaacggcgggtggaggcgcgggtcatctacggggacacggacagcgtgtttgtccgctttcgtggcctgacgccgcaggctctggtggcgcgtgggcccagcctggcgcactacgtgacggcctgtctttttgtggagcccgtcaagctggagtttgaaaaggtcttcgtctctcttatgatgatctgcaagaaacgttacatcggcaaagtggagggcgcctcgggcctgagcatgaagggcgtggatttggtgcgcaagacggcttgcgagttcgtcaagggcgtcacgcgtgacgtcctctcgctgctctttgaggatcgcgaggtctcggaagcagtcgtgcgcctgtcgcgcctctcactcgatgaagtcaagaaatacggcgtgccacgcggtttctggcgtatcttgcgccgtctggtgcaggctcgcgacgatctgtacctgcaccgtgtgcgtgtcgaggacctggtgctttcgtcggtgctttctaaggacatctcgttgtaccgtcaatctaacttgccgcacattgccgtcattaagcgactggcggcccgttctgaggagctaccctcggtcggggatcgggtcttttacgtcctgacggcgcccggtgtccggacggcgccgcagggttcctccgacaacggtgattctgtaaccgccggcgtggtttcccggtcggacgcgattgatggcacggacgacgacgctgacggcggcggggtagaggagagcagcaggagaggaggagagccggcaaagaagagggcgcggaaaccaccgtcggccgtgtgcaactacgaggtagccgaagatccgagctacgtgcgcgagcacggcgtgcccattcacgccgacaagtactttgagcaggttctcaaggctgtaaccaacgtgctgtcgcccgtctttcccggcggcgaaaccgcgcgcaaggacaagtttttgcacatggtgctgccgcggcgcttgcacttggagccggcttttctgccgtacagtgtcaaggcgcacgaatgctgttgagaaacagcggcggcggtggtgactggggacggtgatgatgctgctgagactgagactggtggtgagagtagtggtggggctgcgtcgcctgcgacggcgggtggagatgaggcggcgtggactgggacgaggaggaggggccgcagccgttggtggaaactacgtgcaacggcgacgcggttaagggagaccgtatcgcgtaggacgacgtggcctcctcgtataggttgttgccgctggactgacacagctcctgaatgagctctttgtagcgctcaaaggactcgctcacgtcgttgggaatgtccatctcgtcaatcttgcgttgcaaaatagtcacgtcgatcttgacgctgctggccgagacggcgtgacacagcacgctgataacgacgtggtcgcgcacgatgttgagcgtgacgctgtagtcttcgcgcgccgccgtgagcatctgcgtgatgcagtcgcaggggatgtgcacgtcggggttttcgaagatgacgtgcatgtgcaaccggccgtcctcggcgtgcataaagggcacgatgtcgtggttagcggcgtgcagcaggtaataaatttggaagatgggcggctggttggtggagagcttgagtagctcgctgctcttacagaacccgtaataaaagtttctatttttcatgatgttggacgtctgattgatgaaggccaccatggcgtcggaggcggtgggcaggatgcggttgtcctcgcacgaggtgcaggcgatgcgcgagacctgctcgttgccgtacggcgagatgtcgaggcaggtgtgctgccggtgcgagtggaaattgaagggtaagcagatggactctttgcccgtgatggccatcttcatcatgttgaggtacttgagctctagttcggggtgctcgcggaagatgtcgtgcaagtcgtgcagcgtgaggcgcgggcgcgcgtcggccggcgacggcggttcgccgtggttgttggccgacgtagcgccgttcaccgttgacgccactttgctggccagctcgcgttggcggcgcttgcggagcagggagcgcaaggccgagcgtcgttcgcgcggcgtgcgcacgccgctcacgctagacatacttgtctatcacgtacgtggggtccaccagcttgatgtcgcaattctccaacagctgcgtgaaatcgcgcataaagtccgccaggtgcactttgcctttgtaggtgcgttttgtaatctgaaaggccttgaagagtgtgatgcagagccacacacgtcgcggaagtcgacttatatagtaattgtcgtgacagatggccagtttcacctcctggacgtggtgggggtgcaggcgtccgaagagcacggcctcgttggtgacgcggatgttgccggcgcactgcgggtcgcagaaaaagtgcttgtagatgcccgtgacgcccgcctgacgcaggacgtggcaaaataccgggtcgggtcgcgccagtgcgccgtcgacgccgctcaggccgtgatagtccgagtcgcctccgggcgaggtgggcgcttcgagtccacagcgcgccacgtcctcgtgcgccgcgccgagtggcgacgtgcattcgcgcaacaggtcggccaataccagctgaatgcggtccaccatcttcacattgttctgacagtacgagacgacgcggcggtacagctcgcgcaggacgacgttatcgtaataggagcaggccatgagttcgcacagcagacacacggtactggtttggttcttggtaaaaaaggcgggtacgggacataggtaaatgggacccacgttcttttttagcgtgctctcgctgaaacccccgctggtgccaccgccgttgtgacggcccggatcgtcacctcttttttctcctccttcttcatcctcctcttcttccatcatcatccttgcgtcttctctttccgaggccgtggataacgcgtctagtcgcgcgaacttagtgtgcgtaagttccgtgagtggcgtggtgctcatgacgccggtgccggcccacatatagaaaagcagctgcacaaagcggtcgcggctaggtgagctgtgttctagaaagttgtcgatcagttcttgtggcacttcgacgtgataagggttgtttttttgcttctgttgcgggtggcgccgaggcttgttgtaaggcaccgtgtcttcgcccatgaccatggcccgcaccacggccagatggtttagggtgacattctcgttatcaaccgcgtcgcccacttgtttttcaaagcaacgatttatgaaaaagtgcaggtggaaatcgaagaccgtgagaacgtggtgtcggaacaggtcgtcgatgcgcagatcggaaaagtgctgctgcagcagatgcgtaaactcggacatgatgatgagcgtgctgagcgccgcacggggcgcgtaactgcatttgaagcacagcaagctgtactcgaggagccagctctggtcgcagtcctgtttgaggcagatgctgatgatggcgcataggttacagcgcgtgtcgatggccagcggcgcgcacagtcgccgcagttgttcaaagtcggccgccgaggtttcgaggccggccagttctgcatctaggtcgcaggcggccgaagcgccggcgggtcctgcgttactactgccggcgacggctccgccgcagctagtggtgttggtcgcattggtgagtacggtggattgcgtgccgccgcacgtggtttcttccgcacagcagttgagcagttcgtctacctccgaggtgccgaggctgagcgtctggaattcgtaatgacggtaacggttggcggggtgttgaggattcacctggtatgaggcggccgccgcggcggccagcgcttcgtccataggtacttgacgcgggtgcgcgtgccatagcagctcagttgtcaagtccgagtgccactgggtgtactcggtgctccagccgctgtaacgcgaaacggcctgtcgttgcggactgcacaaggtagcggcggcgacggagctggtggacggggccgggctggtcgggggaagaaacgtggtgtggggcccgtgagggggagtcgttgggccgttactgctcacgtgggtactcggattcatggcgatcggcgccgctgattgaggacgcggagaaagaatgtcctgggctaagcagcgggtgccgtttctggacgatgacgacggagaggaggaaaacgacgtgcaggatgacgtggattctccggtgccgacgcgaccgctggtgatcgacgaggacgcggagcccgcggctggtacgagcggtgggctcgaggggggaggtggtgacgacgaggacggtgaagacggacacgcgctacccgatcttgacgacgatctgctattacagttcgagccgatgctgccgcgcgtctacgatctgttgctgccctctctggacgcgcgcttaaatttcgtgaacgcgggtcagaagtacgccgccttcctcaagtacgtgcacggcgactgcgcgacctgcagtcacggagagatcctccgtgagaagacgcaactattaacggcgatcgtcagcaagcttatggacattaacggaatcctggagggaaaagacgagccggtgccgggtaaataaatcggcggtggcgtcggtgcgatggagatgaacaaggttctccatcaggatctggtgcaggccacgcggcgtatcctcaagttgggtcccagcgagctgcgcgtcaccgatgccggcctcatctgtaaaaaccccaattactcggtgtgcgacgccatgctcaagacagacacggtctattgtgtcgagtatctgctcagctactgggagagccgcacagaccacgtgccttgttttatctttaaaaacactggctgtgccgtctccctctgctgttttgtgcgagcgcccgtcaagctcgtttcgccggcgcgccacgtaggtgagttcaatgtgcttaaggtgaacgagtcgctcatcgtcacgctcaaggacatcgaggagatcaagccctcggcctacggagtgctgacgaagtgcgtggtgcgcaaatccaattcggcgtcggtcttcaacatcgagctcatcgccttcggacccgaaaacgagggcgagtacgagaatctgctgcgcgagctgtacgccaagaaagccgcgtcgacgtcgttggcggtccggaaccacgtcaccgtaagcagtcacagcggcagcggtccgtccctgtggcgcgcccgcatgtcggccgcgctcacgcgaacggcgggaaagcggtcctctcggaccgcatctccccctcctcctcctcctcctcgtcatccgagttgctctcccaccatggtcgccgctggcggcgccgctgccgggcctcggccgccgccgccacccatggcggcggggtcgtggcggttgtgtcgttgtgaggcctgtatgggacgatgcggatgcgcaagcgagggagacgctgatgaagaggaggaggagttgctggctctggcgggagaaggaaaggcggcagcggcagcggcgggccaggacgtcggagggtccgcgcgtcggcctctggaggagcacgtgagtcgtcggcgaggggtgtcgacccatcaccgtcatccgccgtctccgccgtgcgcgccgtccttggagcggactggttatcgttgggcaccgtcatcgtggtggcgagcgcgctccgggccatcgcgaccgcagtctgggccgtggctgcccgcgcgctttgcgactctgggcccgctggtgctggctcttctgctggtgctggctctgctgtggcgcggtcatggccaatcgtcgtctccgacacgctccgcacaccgcgactgacgagttccaccaggctctgtgccgtctcttcgcgcccctctgcgttcacgaggaccatttccatgtgcagctggtgatcggccgcggtgcgctgcagccggaggaagcggcggtagaaacgtcgcagccaccggcgcagtttgcggcgcagacgtcggcggtcctccagcagcagctggtgcatcacgtgccacgttcttgcgtccttcatctcttcgtgacggataagcgctttctgaatcgcgagctgggcgaccgtctctaccaacgcttcctgcgcgaatggctggtgtgtcggcaggccgagcgggaggcggtgacggcgctctttcagcgtatggttatgaccaagccctactttgtgtttctcgcttacgtctacagcatggactgtctgcacaccgtggccgtccgcacgatggcctttctgcgtttcgaacgctacaacaccgactacctgctgcgccgtctgcggctctacccgcccgagcggctgcacgcgttgttggacggtgtcaccgcctcgctgctaggtgaccttcaccgtttccttttcggggtggaccttcggctgcccgtgcttcaccccaccagctcgccgtgcctagcactactacgcgccaagcgcttcgacgtccgcgctgatttggccgtataccaccgtaaccagtggtgtcaccaacggcagccgcggtcgccgcagctgcggggcctcatcgcagccttgcgccggcacgccgggaaggtaccctgcggaaacccgctctacgtactggcccgacaagcggtgcagacgttttgcgacacgtgtccgcgatacctggtgccgttgcgggcactgggtctgcacgacgagacgcgcggaggaggctcgacggcggcagctgcggcggtaggacacgcgggcgccggacagcaggcgcgtcacgtagagcccaccaagatcgtcctctttgcactcagcgccgcgctgcgcggcggcctcatcggcagcgtcatcgacctgccgctctggtgtctgtgtcgactcaagtgcgagcgccatctggacgcgcgctcgctggtggccgtggtctgtcggcagtgcggacactgcctcaacctgggtaaggaaaagctacactgccagcaaaattttccgctcaactcgatgttctattatcgggaccgtcaagaaaagagcgtcatcttcaacacgcacgccgagctcgtacactgctcgctctgcggcagtcagcgggtggtgcggcagcgcgtctacgagctcgtctccgagacgctctttggacagcgctgcgtacgcgtgggctggaaagccgtgctgggcctcaacgcggcttgtgccgtgtacgatcaccggctggctttcgacgtcattctgccctgcgcggcacgcacctgcgactccactgtggtggtacgcggcgtgacggtcccgcgtctcctgcgcctcacttcgcacgggcacggcctgctgtgcgcgcgctgtcagacgggcgagtaccgcgacagctgtttggaaagcgaagacggcgccccgctgtgtcggggctgcgcgctggttaaacagaccgcctgccacgtcggcggccacattgtgcagcaggcgcgcggcggtttagcagcgatttcctcctcgtcctccccacacggcctgccccatgtctaacaccgcgccgggacccacggtggccaacaagcgggacgaaaaacaccgtcacgtcgtcaacgtcgttttggagttgccaaccgagatctcagaggccacccacccggtactggccaccatgctgagcaagtatacgcgcatgtccagtctgtttaacgacaagtgcgcctttaagctggacctgttgcgcatggtagccgtgtcgcgcacccgacgctgacagcccatggggaaaagtaacagcaataataaatcaccgtgaaagtgacacgttgttttatatcaaaaaaccataacaatcctcttgtttttattgcccgctactgtcagtgtcggttacaaaagatagagaaaccgcatgtgttgaatagtgtcctgtacggattgcgccagttgtcgcaggtccaatcgcactagtcgcaatatttctagagcactgaggacgttctgcgtgagcaccgtgataggcggcgaggcgaaactggtgctggcggcgccgggtgccacggccacaagttcatctcgacatagtggtgtttctcccagccggttttcttgaaagacggacccgccaaaggcggtggagactaatgcagagtcggctgtccttgatgtatcgtcttgtacgtgatgtatctgtccgtcgtcgtctgcggccgcggccgctcgatgacgatgtcggcgcggcggctgctgaactcgcgcgatgggtggcgggttttcacgcagaaactgaatattgactggtacgcggttgaaaggtaccggcggtgttggagcggcgccagacgcagcgacgttgtccgcggatgtgttatcatcttggtcatacagcgggaaggtggggaaggcctcgtccaacaccagccgactgtggtcctgttcgaacgtggagggcggtcgcagcacgcgtacaacggtgtggtcctgtgcgttgtaaatgactaggggaataaactctaagcgggtggggaaacgcaggtaatcgcgtagccgtctgatttgggcttgtagccagcagtgctccagcggcgtttcggtccacgtgtcctggagcagttgactgagattgaggtcccgggagcgttggatgcggaggaagtcgcggtctcgcgacgtgtattcgaggtggcgcgctactaatacacgttggcctttcagcaggtcggctacgtgcacgccgagacacacgggtatgccgaaaagccaggagcccagcgcgtagtctagggcggtttctgtttgaataaaaacatctaaaagtcctggctctgtggtcgtgtttgtgtctgtggtggttgtgtcttggcgtcgcacgcggatcatctgaagcaccggctctccggtggggagctgcggttgcgtgtacccctcggtcaccatctcgcattgttgcgtgaaaatctgaaacaacgtctgtaccaattcggacaccgaggcgtaggtctcggcgtactggggtttcagttctagccacagacactgcagcatgtcttgtggaaagaccagcgtggccatggcgtagagccatagcttgcctaggggtggtgtgcttttttgcgggcctacctggcacagttgctgtaccagtttattttcccaaaacagtttattgagctgcatggcgggccattgggtgggggtgatacagaaggccttgacctgttcggggaggtggtcggggggcattttgtgtgtgttattgactaccgcgtgtatcacatcctgatgtaggtgagctgtgagggagggtagtgacatttgcaccgggtacttgaggacggtgtagatgtactcggggtacagagctgctatgagtacacaaaactcttgcagacttaggcgcagcacggtaccgcggcccggtctctgttcccctacgtcaccaccctcgccgcttcctacgcgatcggcggccgtcagctcctgctgcgtgtcgatgcgctggtgccaggcggtgctcaccagataacaaaagagcttaagattatgtaacgtgtgagtctccgcggggtgcgtgtggctctgatgctgcgtgaggtagggtcgtaggtcgtactgcgagatctgcggccagaaagtgcgcaatgtctgacagacggccacggctaccgtgatggctttataacgtgtggtgacgacgttcttgagtcctccgccgctacagcggcgccgccatgccaggggccggccatcgtctcgcagcgccaagtacttaaaggctacgttgccgtaatcggtgaccaggtgaatgggttcgccggcctgcgtgacgatttgccgcatgccgaagacgtctaccacttcaaggaaggtgtcgtggtgacgcgcgaaacataggcgacgcaggcggtcgcgcattatcagcgcgggatcggtctcgtgcgttggcggaagcacgctaggaatgtcttccagcctatagactagcgatgagccgttgagcttgttgagcagatactggtgacccagctggacgtgtcgttccagcgcgttcaacccgcgtgtaaaggcgcccagcgaagtcgtcgcctgcggtttccgggggttgggcagggctccctcgttggagagacgcgtaccgcgtcgcttggccagttccgcaaaacgagtccgcagatcgcggatcttttccaactgcgaccgaaagtccagcccgtagctgaaggtctggattccgtgtaacagcgcaaagtattccgtcgccaacgtttcctgcagttctaggtcgcctagcgtctgacccaagcgctgcaacagttcctgcactttttgatgacgcgcggcgccgccggctacgcgtccgggttccagtcgctgccagaccgcttccaccgcctggaccatgtcgacccgcggcgtagacgcgccgttggcagtcgcctcttgatgctgtgcaataaaattttcacaggccgcgttttgttcgatttgatgcgctagcgtcacggcgctctcgacggcttgctgttgcaggttccggtagtgggtcctgcttccgtgatgcgggtgcgtagggtccgcggtgatttgcgcaagggcttcctccagaaaagccagcatccagcgcaccgtgcgctccgccgacaggtacggcagttgttgcgtggctttgcccaacagctcgcgaagtgtctccagcggcttttccatcagcgccttggcgtcgggggtggtcacgtccagtccgccgctcattttgtggcgcgtgaccagatcagtccacaggttctgcgccgtgctcagttgctcgtcgcgttgtcgcaactgcgtctgtactttctgattcagcagatcggcctcgtcgctgagcgctttccgggccgcgtcggcctgctgatctagcagcgttttgaaaacgggccgctggaagtcagcgggcgggggcgtgatccgacccgccagctcctgacccttgaagggtttctcgggtacacgcgtgacggagctgttcccgggatcctggcgcagcgagcgatctagccgttcgctagtctcggtcatctgttgtctagtctcttgtaactgtccctccatcttctgttgactgctgcggtagcgtgcaaagtcgccctcgaactcgctgcccgtgatggctgtagttggatcgccctgttgacacttctcgatgaactgcgcttgatggacggcgtgttgcagggcctgctgcgtctcatggatcagaagttgcggacccaaaatttggtccaagtggtttagcgaggcttgggtttgcatagccgcttctcggtgcgggtgacagcgccgctctacatcacccgtcagcacgccgtgcagacactcgttgattcgcccgtctagttttttgctcagctgctgcagcgccgacagcaagtcctggttgaacttgtctagtagcggttgggcgcgttgatctaggcccaagagcagctcgagtgtggcctccagtggttggtgcgggatggtggagagcatctcgcccttaacggcgtccaccacgcgttgcaaatcctgctgcacctttttttggtagccgtccagtagctgccgttgctgttcttcctgtttacgtttctccttgtctaaaaagtcttgcatcttggtggttaacgtttgttgcatttgatgcatgacacgatggctcggtgcccgggccaagacacgctgcacgtcctccacagaagttaccgtgagcttgccggcatcttcttgccattcacgttctagccgttccaggtgctgttcttccatctcgtgttgatatcgctcgtagagttccgttacctgaggtccgacgcccagtcgtccgaccatatgttgaaagaaatattcatgattacggaaaaagtaaaccaactcccgtaacgcttggaaacgtttttcggatgcgccggtaccggctttctcgatctgctccagtttcttgaccatctgcgcgtacgtggcgttggcggcacgcagatcctcacgttcgtgcgagtcgggtggcagttgctgcaacaacaaactgacggcgtcaaaaaacgtcggtcgcggcgactcgtcgcgcgccagtcgcatcactaatgtgtggaacatgctcagtacggcgttgatgagtcgcagacgcgtctgttcgtcgcgacgtaacatctcgcgtaattgtgggtgtcgcttgatggtctgttcggtgggcggatcgtcgtacgagagtccgtcgaggaaacgctgcgtttcctcttcctcttcgtagaggcggcttagcgcgagttgcgcgttctgtaggcgctgctgcacttcgggtagctgcaggccgcctagcgcttccagctgagctagctgctcctgtaccaaggccagtgtcagcgccgagccgcggctgcccgggtcgcgcaccagcgtctcgatgacatgaagcaggtcgtgaatctgcgtgaggcgaccctcgttttgctgcgtggcttgctggtacgcgtgtcgcagctgcaggatctcttgcagtagcggtacgttgtcgcgcacagtgcccgtcatgaggtagctcagttgttcgcgtatgacgacaaatccctcttcgtagctgccgtcacacagtttcaggtcgcgcaggtcgtaaaagagtctcagtacctgctcgacgacgcgttccatctgcttcaggtcctctaccggcaaaaagccgttgaggatgtgattgtgcacgcgcgttagcagctgcgtgctcagacggtccaggtccatctgcaactctagcattttggcgttgcccaggcgaaagagttcctgcttggcgttgtcgtccaacggctgcagcgctttcagaatttcgcgtcggttcagatcgctggcgtctaggtcgtgaatgtcgatgctggtgatgaggccggccaagtgctcgtaaacgccgtggtactcctcgcgttgacgttgcaacacccgacgtcgctgttcgatgacctgcgtcagacgctgaaagtctacgggtcgcaggcagacgaagctgtcgctaacgggcatcggtcgcttggttacgaaacgttgcagtcgttgagacagttcgttagtgggcttgctttccacgtagcgtagcatctcctccacccaggcgatgagcgccgggccgtgctgacgtccgtagggatcgaagacgacttgcatcttctccagcagtgcgcgatccagcgtcgagtacgtgcctttggtggtcttgtggctcaggtagtcgtgcatgcgccgcagatccaggccgtggtgcagccagttgagcagaaaggcatccaatttcttggataggcccagataggcgcgtaccgcctgctgcgccgccgattgcggaccgcaggggcgacgcagacacgagcgctgattgacggcatggatgatgagctgctggagacgatcggtgaggaaagcttcgtcgaaggacggcgccgtggccgttgccgcgttagcgccgctttcggtacccgccgcgtgcaacgtccaggcgctggtgttggcaggcaacggcggcagcgtcagagccttcaactcctgctctacctcgtcgaccagctgttggtagcggcccagggccggcagggccccttcgccgcagctgtaggacggtggtaccgcggacgaagaagaggccgccgctatcgctgaggaggaggaggcggtggccagtgttttggacgtcgtggacgggggtttctttttgcctccgtgtttgctaccgctgaggtccttgcggcgtttctcgggtgtttttttgggtgaggacgagggatcgtagacgggaatgctgggcgccacgccaggagggcagcccgggtcgacgatggggtcgggcagcggaggtaaggaaggtgcggcggtggtcgttgtcgccgccgtgtccgcgctttctcgaacgacgccggtgaggtcgatatcgcggtcgcgataggtggagaccaaacgtgcggcgatctcagcctctggcacggtcgccacatccagcatgtagagaaaaagggcctcatagtagaaagcgggcgatagctgcacgccgaagcccgtgagcaccatcagcacctgatggagaccctcgcagtgatacacggcggcgttgtgacattccgcggagctgtgcggatcaaagaccaacatgtggtcctcggtgaagaccacggcgcgcgccaacgagttgacggtgacgagtacgtaggtgggacgcggtttggcgtgcgcgtaccgcagaaagtcgaagatgcccggacacatgtagccgtccaggtcgcacgtctcggtggtgccgttgaagggccgcgagagcgcgtgcacggtccggccgaaccgcgactccaggcggcgcggcacttcgtcgcccagtcggtagaccggcagccgcccgccggcgggcagcttcttttgcaactcgcgctctagccgcgcgtccagacgcgcgccctcttccatgatggcgtccagcgcctcggtctgcaggacggcgctcgttccacccaggtgcaaggcgtgtaggaacatgatgccgttgcagacgcattgattgcccgctcgcgctccaaagcgagcgatgtcgccctggtggcagctggcctgcgtgactttcatggcgaggccggcggcagggacaccgatgtcgagccggcgggcgggtcgatcgaagacaagatgtcctgctgcgcctggcttacggggacgatgtaccagtttaataggtcgctcgcggccaggtgtgcgggttcgtagcgcgcacccaggacctccggtacggacgtcgcgcctgccgtcgattcttcgtgatcggtgtcgggcgtcatgcggagtcgcggcggttggggcgccgattcccagggcgcctccaagaactcgcgtaaggcgcgatccgcttcggccgccgccgcaacgcccgtgcccgcgggccaggtcatcggcgctagcgcgcgatgtcggtgcagtaggctcgtcgcttccgtcagacagagctgtgcgccgcggcgttccaagttctcgcgacttagtacgtcaaagacggctagcgcgcgttgcaccgcggtaacgacggcgccattggaacgttgcgcctgctcgagcgccaatgtcacgcgtgtttccaacactttgattttggaggccgtctttttgagcgccttgctcatctgggccaccgtgcggtgacccttggcgtgtcggcttacttcctctgtgtcgctgctgatctgacgtacgcgcacgcgaacactcagcaggcgctcgtttaagccgcgcagattctcggccaacagccgatcgcggcgaaccagttcgcgcaactgttctacgaaacgcgtggtaggtacgcgcagtccgtactgaccctgtacctccacgtacaccgtcacgccgtcctccgagaggcgcgcccggccgcgcgccagaccgaaacagagtcgcgtgtgtcgcagatagtttctcagactgccggcgctgctgcgcatcacgtcctcgatcagcgggttgacggtggtgtacaggttatgcgctacggagcgcgccatgagctcggccagcaggtccacattgggcgtgacgggtacaccgctgaggtgctcgagggtcgtggcgatgtcgaagacgcaatcgcgtaccgtcttaaaaaccgcggcgtcgatgtgcttgacaaaggtggtcaggttgtaaatggagaccaggttctggtacagcgtcacctgctcgggcaacaatacacgacacagctgaatgagcgcgaaaagacgcggcgaacccacggcttgaaacaggccctgcgggataccaaagatctccgaaaattcagttaccaccaccaactgcgcgaagatgctggggaactcgggatgatggctgaaggctagcagggaggcgtagttgacgcggccttcgttcagattaacgagcgcgcattcgcgtaagatgtcggagcgtgtgacgccgtcaagcggaggcaaaggcgaggccgcgccggccgcgccgcgagacggacgcaaggtaaacaggtgcacgccccacttgctgtgcaggtcccgatacaggtactcgcgctctgcctccgtggcacccttcgtatgtgcctcaaagtcttcttccgtgtactgaaccgcaaagtgcgtattgacgttcagtgtcacgttgctccagacgtgctgtagttcctccttggagccgatcaacgtggatcgatgctgctccaaaatcaaccgccgccggtggtcgaacaggaacgtggggctgtacacatagaggcacatgaaaaacgtgtaaaaattgtagatgatctgtatgagtttctcgcgaatctcgctgacaaagagcgagctcttctgactggccggctggatcagcgccatttgtgcgtaggccgcgcaggtatcgtgattgaaacccagttccaccagtagcgttaccatctgcgtcagatccagtagccgctgcacgcgtcgcggcgtatgcaagtggtcttccagcacgcgatcgcacacgcgcgcgtaagcgtctaggttggcgcgcggcgaaacttcctcactcaacagacgcgagatcagacccgggtggaaaaacatacgttcgggcgacaggtaaaggttcacggtggagatgcgcgtgctaatgatgggaaacatgaggccgctggcgtcacgcgcctgcagattacccacgaacagcttgtagctgacgtcacgcatgtgttcggcaccgggcttctggtcgccgtcgatatcggaactgacgaaagagctcatgtgccgcacgctgttcttgacgtagttttgaaactccacggccaaatcgccgttaaccgaacggtagtgtgtgtaaaaaaaatgcatcagaagcaccgtgtccagttcggtgtcggtgtcgcgccgaaacaacacgtagggcatgagcgtgcaggcccagtagatgagccgctggtaggtcaggtccaggagttcggccacggcgcgacaattgacgtagggccgcgcctccgtggcagccgtttccagctgcgtgatcacccggcgaaccagcggctgctggcccccggaactcgaaccgcccttcttgccgcggcgctcggtcgacgcgttgttactggcgatcaagtccgccgccgccgcggtgccgccgctctgttcggctattacggtctggatctcgcgcagggtctgcaacagcttctggaaagccgtcagcgtggccccgttgtggtagaacggcaaccggtcctcgtctccgccgccgtcgtgctggtgtcgcaggaagcggtccagctgttcgtgcaactgctcggcggcgtacagcgggtcgcgcgccgtctgtaccgtggcgtggcttaggaggtaaaagaccacgttctgacgcacgaaggcaaagtggtaacccgagctcggcaacgcacccacgaaggcgcgcacggcgctcgcggtcacgtcctgggcatccaccgcgccgatctccaattggctcacggtatttaacgcctccgctttgtccgtggcccgtgcccgcagctgctctatcaactttttgaaatctaccgtgcgccttgccatcatggacgcgcgcgcggtggccaaacggccgcgcgacccggccgacgaggacaatgaactagtgacggcgctcaaagccaaacgcgaggtaaatactatatcggtgcgctacctctaccacgccgatcaccaggcgctcacggcgcgtttcttcgtgcccgagggcctggtagagttcgaggcgcagccgggcgcgctgctcatccgcatggagacgggttgcgactcgccgcgacacctctacattagcctctacctgttaggcattcgcgcctccaacgtctcggccagcacgcgctgcctgctcgaaagcgtgtacacggcctcggccgcgcgcgccgcgctgcagtggctggacctgggcccgcatctgctgcaccgccgcctcgagacgctgggctgcgtcaagaccgtctcgctgggcatcacctcgttgctcacctgcgtcatgcgcggctacctttacaacacgctcaaaacggaggtgttcgcgttgatgataccgaaagacatgtacctgacgtgggaagagacccggggacggctgcaatacgtgtatttaatcatcgtctatgactatgacgggcccgaaacacgtcccggcatctacgtgctcacctccagcatcgcacattggcagaccctggtcgacgttgcacgcggaaagttcgcccgcgagcgctgtagctttgtcaaccgtcgcatcacgcgcccacgccagatccctctgtgtaccggggttatacaaaagctgggctggtgcctggctgacgacattcacacctcgttcctggtacacaaagaactcaaactgtccgtcgtccgtttggacaactttagcgtcgaattgggagactttcgagaattcgtctgagcggcgctgacagcatacgaggaggagacacagaagaaaaaataaacacagcgcacacagactttataaaccgtagttatcggtgccatatagacacactttattgaaatctacctgatttctttgttcttttcctcgtaaacttatgactccggctgacgcggacgaggaacagcgggtgtcctcggtgcccgtgtatcggtgccggccaggtaggattccgagccgcggcgcggaaaccgagacggaggaatcgtcggcagaggccgtcgctgatactaccgggggagatgacagcgagctcgaggaagggccgctgcccgggggtgacaaggaagcgtccgctgaaaataccaacgtgtcgagcggcgtagcgtgtgtagcgggttttacgagtggtggcggcgtcgtcagttggcgtcccgagtcgccgtctcccgacggcacgccgtctgtgctgtcgttgacgcgtgatagcggtcccgccgtgcccagtcgtggtggacgcgtgagtagcggtctgagcaccttcaatccgaccggcgcgaccaggatggagctggacagtgtcgaggaggaggacgatttcggggcttcgctctgcaaagtatcgccgccgatacaagctacgcgcatgttgatgggcaaaaagtgtcattgtcacggctactggggcaagtttcgcttttgcggcgtacaggagccggcgcgggagctgccgtccgacaggaacgcgctgtggcgcgagatggacaccgtgtcgcggcacagtgccggtttgggcagtttcaggctatttcagctcattatgcgccacggtccctgtctgattcgtcactcgccgcgttgcgacctgctgttgggtcgcttttatttcaaagccaactgggcgcgtgaaagccgcacgccactgtgttacgcttcggagctgtgcgatgagtcggtgcgccgttttgtgctgcgtcacatggaggatctacccaagctggccgaggagacggcgcgttttgtggaattggccggttgctggggcttgtacgcggccattttgtgtttggataaggtgtgtcgccaactgcacggacaggacgagagcccgggcggcgtgtttttgcgcatcgccgtggcgttgacggccgctatcgagaacagtaggcactcgcgcatctatcgtttccatctggatgcgcgtttcgagggcgaggtgttggaatcggtgttgaagcgctgtcgcgatgggcagctgtcgctgtccaccttcaccatgtctaccgtgggtttcgatcgcgtgccgcagtacgactttctgatctcggccgaccctttctcgcgtgacgccagttgggcggccatgtgcaagtggatgagtaccttgagttgcggcgtttctgtgtcggtgaacgtaacgcgacttaacgccgatgtgaacagcgtgattcgttgcctggggggatactgcgatttgatacgcgagaaggaggtgcatcgacccgtggtacgtgtgtttgtggacatgtgggacgtggccgctatccgcgtgattaactttattctcaaagaaagcacgtcggagttgacgggggtttgctacgctttcaacgtgcctagcgtgttaatgaagcgctaccgtgcgcgtgagcagcgctactcgctgtttgggcggcctgtctcccggcggctctcggacctgggtcaggagtcggctttcgagaaagagtattcgcgctgcgagcaatcgtgccccaaggtggtcgtgaacacggacgattttctgaaaaagatgttgctgtgcgcgctcaagggccgtgcctcggtggtctttgtccatcacgtagtcaagtactcgattatggccgacagcgtgtgcctgccgccgtgcttgagtcccgatatggcgtcgtgccactttggcgagtgtgacatgccggtgcagcggctgacggtgaacgtggctcgctgcgtgtttgcgcgtagcgacgagcagaagctgcatctacccgacgtggttttggggaacacgcgacgttactttgatttgagcgtgctgcgcgagttggtgaccgaggcggtggtttggggcaacgcgcgcttggacgcgctaatgtcggcgtccgaatggtgggtagagagcgcgctggaaaaactgcgtccgctgcacatcggcgtggctggcttgcacacggcgctcatgcggttagggttcacgtactttgcctcttgggacttgatcgagcgcatctttgagcacatgtactttgccgcggtgcgcgctagcgtcgatttgtgcaagtcgggtttgccgcgctgcgagtggttcgaacgcaccatctatcaagagggcaaattcattttcgaattgtatcggttgccgcggctctccatcgccagcgcgcgctgggaagcgctgcgcgccgacatgctcgagttcggattgcgcaactgtcagtttctggcggtgggtcccgacgacgaggtggcgcatctgtggggcgtgacgccgtcagtgtgggcttcgcgcggcaccgtgttcgaggaggagacggtgtggtcattgtgcccgcccaaccgtgagtgttacttccccaccgtggtgcggaggccgctgcgcgtgcccgtggtgaattacgcgtggttggagcagcaccaggaggagggcaaggcgacgcagtgtctgttccaggcggcaccggcgatccaaaacgacgtggaaatggcggccgtgaacctgagcgtgtttgtggaccagtgcgtggccctggttttctactatgactcggggatgacgcccgacgtgcttctggccaggatgctcaagtggtaccactggcgctttaaggtcggagtatataagtactgtgcctcttagtcgggggcccgctggctcggcgcggctgtattattagacgccgggcgtcttcgcagcgttcccggtcgtcgtgtgtgctctctataaaactttcgctcgctcgcgcccgctccttagtcgagacttgcacgctgtccgggatggatcgcaagacgcgcctctcggagccgccgacgctggcgctgcggctgaagccgtacaagacggctatccagcagctgcgatctgtgatccgtgcgctcaaggagaacaccacggttaccttcttgcccacgccgtcgcttatcttgcaaacggtacgcagtcactgcgtgtcaaaaatcacttttaacagctcatgcctctacatcactgacaagtcgtttcagcccaagaccattaacaattccacgccgctgctgggtaatttcatgtacctgacttccagcaaggacctgaccaagttctacgtgcaggacatctcggacctgtcggccaagatctccatgtgcgcgcccgatttcaatatggagttcagctcggcctgcgtgcacggccaagacattgtgcgcgaaagcgagaattcggccgtgcacgtggatctagatttcggcgtggtggccgacctgcttaagtggatcgggccgcatacccgcgtcaagcgtaacgttaaaaaagcgccctgccctacgggcaccgtgcagattctggtgcacgccggtccaccggccatcaagtttatcctgaccaacggcagcgagctggaattcacagccaataaccgtgtcagtttccacggcgtgaaaaacatgcgtatcaacgtgcagctgaagaacttctaccagacgctgctcaattgcgccgtcaccaaactgccgtgcacgttgcgtatagttacggagcacgacacgctgttgtacgtggccagccgcaacggtctgttcgccgtggagaattttctcaccgaggaacctttccagcgtggcgatcccttcgacaaaaattacgtcgggaacagcggcaaatcgcgtggcggcggcggtggtagcggcagcctctcttcgctggctaatgccggcggtctgcacgacgacggtccgggtctggataacgatattatgaacgagcccatgggtctcggcggtctgggaggaggtggcggcggtggcggcaagaagcacgaccgcggtggcggcggtggttccggtacgcggaaaatgagcagcggtggcggcggcggtgatcacgaccacggtctttcctccaaggaaaaatacgagcagcacaagatcaccagctacctgacgtccaaaggtggatcgggcggcggcggcggaggaggaggcggcggtttggatcgcaactccggcaattacttcaacgacgcgaaagaggagagcgacagcgaggattctgtaacgttcgagttcgtccctaacaccaagaagcaaaagtgcggctagagcgcgtgcccgggaacgcggcccgcgcgcacggcgcggtcccgcgatggagaaaacgccggcggagacgacggcggtttcagctggcaacgtgccacgtgactcaatcccgtgtataactaacgtgtccgcggacacccgcggccgtacccgccccagcagaccagccaccgttcctcagcgacgtcccgcgcggatcggacactttaggcggcgcagcgccagccttagctttcttgactggccggacgacagcgtcacagagggcgttcggacgacctccgcgtcggtcgccgcctccgcggcccgtttcgacgaaatccggcgacgccgccagagcattaacgacgagatgaaggaacgcacgctggaggacgcgctggctgtcgagctggtcaacgagaccttccgctgctctgtcaccgccgacgcccgcaaggacctgcagaagctggttcgtcgcgtcagtggcacggtgctgcgtctcaactggccgaacggttggttcttcacctactgcgacctgttacgcgtcggctactttggacatctcaatattaaaggtttggagaagaccttcctgtgctgcgacaagttcctgctgccggtgggcactgtgagtcgttgcgaagccatcggccgcccaccgctacccatactcatcggcgagggcggccgcgtctacgtctactcgcccgtggtggaatcgctgtacctggtgtcgcggtccggtttccgcggcttcgtgcaggagggcctgcgcaactacgcgccgctgcgcgaagaactgggctatgcccgcttcgagaccggcggcgacgtgggtcgcgagttcatgttggcgcgcgacctgctggccctgtggcgcctgtgcatgaagcgcgagggttccatcttcagctggcgagacggtaatgaggcgctgacgacggtcgtcttgaacgggagccagacttacgaggatccggcccacggcaactggttaaaagagacgtgctcgctgaacgtgctgcaggtatttgtggtgcgggccgtgccggtggagtcgcagcagcgcctggacatctccatactggtgaacgagagcggcgccgtcttcggcgtgcatcccgagacgcggcaggcgcactttctggcgcgcggactcctgggcttctttcgcgtcgggttcttgcggttctgcaacaactattgcttcgcccgcgactgttttacccaccctgaaagcgtggcacccgcttaccgcgccaccggctgtcccagagaactgttttgccgtcgtttgcgcaaaaagaaggggctctttgctcgaaggtgagccgcggacgccgtcggtaccgtctccaccacagttgccaccgtcgccgtcactgccaccgacatggagcccacgccgatgctccgcgagcgggatcacgacgacgcgccccccacctacgagcaagccatgggcctgtgcccaacgacggtttccacgccaccgccgccaccacccgattgcagcccaccgccctatcgacccccgtactgcctggttagttcgccgtcgccgcgacacacgttcgacatggatatgatggaaatgcccgccaccatgcatcccaccacgggggcgtactttgacaacggctggaaatggacttttgctctcttagtggtcgctatattagggatcattttcttggccgtggtgttcaccgtggtgattaaccgggacagtgccaatacaacaacgggggtttcctcatcatcggggtaacggggatagagcatgtgcttgactgtaccatcattgctgctacggaataataactacgctacgacctggcctgtggtgtgtgttgttttttgtgcacgcacgacatgacactcttttgccgcaccgccaacagcaccgccggctacgtcgacatgaacgtctgcatcggcatgatcggcgtggtttgtttcgttttcggggtctttattctcatcttttgctccacgttgaaagctttctacgtgcggcaaaagacttaccacctcctgggtaccgagtcggacgacgaggagaccacggtttgggaaaagcgccggatggagtcggatacagacttttaaaagaagccataaaaatatgggaattcccctgcctacgtcttcatgacgggcgcctttttcttcgcctcgggctctgtctcgtcgtcattcgggccaggactttttaatggccaacagcctgtggcaccgcctccgaacgctcgtgggcaacagtcggcagaatgaacaaattcagcaacactcgtatcggcttcacttgcgcggttatggctccgcggactttagttctgacgcttggactcctgtgtatgaggatcaggagtttattgtcttctcctgccgagacgacggtaacaaccgccggcgtgacgtccgctcacggtccgttatgtccgctcgtgttccagggttgggcgtacgccgtgtaccaccaaggcgacatggccctcatgacgctcgacgtgtactgttgccgccagacctccaacaacaccgccgtcgcgttctcgcgtcatcttgccgttaacacgctgttgattgaagtgggtaacaacacacatcgccgcgcagatggagtctcctgcctggaccattttcgcgcgcaacaccaggattgcccggcccagacggtgcacgtgcgcggcgtaaacgaaagcgcttttgggatcacccacctgcagtcctgttgcctgaacgagcattcacaactctcggagcgggtggcctaccatctgaagctgcgacccgccacgttcggtctggagacctgggccatgtacactgtgggcattctggccctgggctcgttctcctccttctattcccagatcgctaggagcctgggggttctgcccaacgatcatcactacgccttgaagaaggcttgataatgataactgcacatcctcacgagtgcccttacctatcatcacactaagaataaagaaaatcgatcggtgtcgtgacgtgtggtgtgtgtttttcactgttatcgggtaccagggaggaggggttaagaggtcacaggtgcgatttaccgtaaggagagtcacacttaagaaaaaggtggaaatccctcacccgtcttattcccgtcagccgtcagtgacgtgaatcgcccctcacgtcagtgttgtcccctatccgcgtgagttgggtggctcaccgtcaggtgctccgagacgcgcgtactcggaaactgcgtcaatgcggtcggtcagccgaccctttgatgtagtacatcgcgtgcgaagatgaaaaacatcttaaaccgggtcgcctaaggggaaaaccccacgtgtcttgggcgcgtcatgtccggcatcttcatgtatataagacggtgtttcaagacgacgtgagacccacacgcgggtttcacttctttctttaattatgtctccagtctacgtgaatctgttaggtagcgtgggcctgctggccttttggtactttagctaccgctggatccagcgaaaacgccttgaagatcctctcccgccttggttaagaaagaaaaaagcatgtgcgctcacccggcgttctcggcaccggttacgccgccaacatggcgtaattgacggtgagaactcggagaccgagcggtccgtggacttggtggccgcgctcttggccgaggccggggaggagagcgtaacggaggacacagagcgggaggacacggaggaggaaagggaggatgaagaagaagaaaacgaggctcggacgcccgaggtgaaccccatcgacgccgagggcctctcaggacttgcgcgagaagcctgcgaggccctcaaaaaggccctgcggagacaccggttcctgtggcaacggcggcgacgagctcagctgctgcagcacaacggcccccagcagtctcaccagtaagcaggggtaaacaaaaaaaccacagactccgggatagtataagaagggactttaccgctattgctgctattcatagagaaggatagaaaggatgactacgaccacgcatagcaccgccgctatcatgagcctgctggacgaggccgagtggcgacagacgcagatggacgtggggggactgatccaggcgtcggcgttgggcaaggtggcgcttcgctacgcggtgaggaaactgatgaagcgcggagccaggctgcggcacgactcgggtctctacgtgtgcatctgcgacccctcctacgagtttctgcagatgaacctgagcaagatcagttggctggagcgacactgccccccgttggaccaggagctcatcatgttcggggtcatcgaggcctgggaggaagcttcggtgcggcccacgcgtcagctggtgttgttcatgacgcccaagtgggacgtgttcgcctacgactccggtatcctgtttttcctggcgcccagcatggcgcagttctggcacggtgccatcgtgctggagtattggaacgctttgttcccggtggaggtgcgctcccacgtccgtcagcacgcgcacactatggacgacctggtgatggtcttccaccagctggactacgaaaagcaggtgctggaagcgcgtcgcgacaagaatacggaggggccgcgcacttttgccaagtcggtgaacagctacgtgcgcgccatcctggaatctgagcggcggatccgcgaagggaaaattcctatgaccttcgtggatcgcgactcgctgcgagccaattcgttggcccacatccaggccaccggggctcagccttctcacgccccggcgcaacgggtgctgtccgcgccgccgagtttgccgtcgcccgtgtcggaagaagaccccgctgccgccgccaccccttcgtcctccgccgccaccacccccccgtcctctgtcgtcccgacctccgtcgagagcgagttgtcctcgtcgccgccgctgccgccggtcgtggtgaaggatgtgatgtacacggccggggagggcgacgtggtacagatggtggtcgtggtctagaaggagaactttgctgctagatgaccatgttcagctttttttttgtagtattttttcatagttgctatacctcagttatcccccctattagccccacatgctgcttaataaacatacttgtttcattttctttctagtgccgcggttttttgtcgcgtccacgggctgcgcgggtttcaggtaaaaacaacgtgtgtgataaacgtgggtttttacctacgggaaaggggagggtagaaatgtgagtcttcgtcaataaaaagtcccgtgtcgtccccacgtaggtttctgtgtggctgttgttgacgctgctttggagcacgggaaacggtgtttcggtccgctgtacgtaccacggcacggacattaacatcacttccaacactacgagtatgaactgtcagttaaactgcacgtgcaataatacgcaaatctacaacggcccctgtgtcgggaccgaagccagactacccttgaatgtaacgtttaaccaatcacgacggcaatggcacagcgtcatgcttaaatttggttttcagtatcatctggaaggctggtttcccctgcgtgtgttgaacgagagccacgagaccaacgtcacggaagttcacggagaagtcgcgtgctttaaaaatgacacaaacataaccgtgggacaattgatgctcaacttcaccggccacagttacgtgttgcgagcggtagcacatacgagtccgttcgaatcacacgtacattgggaagaaaccaacgctactagtaacatcactagtaacgtaacttctttggaaaacactaccactgtgatgttaacactggcgaaatacgcggaaagtgattacatctttctacaagacatgtgcccgcggtttcttagaagaacccttaagcttacaaaaaacaaaacaagaaacgcaacatttacgggaactaatgtgacgtcgcttcccatgtggacaccgaaatgcgacggatggaagtattggatcacgctatccatgatgtggagaaaccgccgttcggctctgctccgagccaaaagtcgcgcattgggacactgggcgttgttgagcatatgtactgtagcggcgggcagcatcgcgttgctcagcctcttttgcatcctccttatcggacttcgtcgcgatttgcttgaagatttccgctacatttgtcgggacgaggggggttccagcacaaaaaacgacgttcatcggatcgtctgacgtcaacgctgatagtgtctataaaggccgtgccgccgcgccgtagttctccgaaggcggacggaggagtctgtcgaccgcagcggtggctggagaagcgcagcgtcggcgagcgaaggtagaggagtccgtcatggacgacctacgggacacgctgatggcctacggctgcatcgccatccgagccggggactttaacggtctcaacgactttctggagcaggaatgcggcacccggctgcacgtggcctggcctgaacgctgcttcatccagctccgttcgcgcagcgccctggggcctttcgtgggcaagatgggcaccgtctgttcgcaaggtaagccccacgtcgttgaagacacctggaaagaggacgttcgctcgggcacgttctttccaggtgttttcaacgtgcgtggattttttctctctaccaggtgcttacgtctgctgtcaggagtacctgcacccctttggcttcgtcgagggtccgggctttatgcgctaccaactcatcgtgctcatcgggcagcgcggcggcatctactgctacgatgacctgcgcgactgcgtctacgagctggcggccaccatgaaggactttctgcggcatggctttcgtcactgcgaccacttccacactatgcgcgactaccagcggcccatggtgcagtacgacgactactggaacgccgtcatgctctaccgcggtgacgtggagagcctgtcggccgaggtgaccaagcggggctacgcttcctacagcatcgacgaccctttcgatgagtgtcccgacacccatttcgccttctggacctacaacacagaggttatgaagttcaaggagacatccttcagcgtcgtccgcgcgggcggcagcatccagaccatggagctcatgatccgtaccgtgccgcgcatcacctgttaccaccagctgttaggcgcgctgggccacgaggtgccagaacgcaaagagttcctcgtacgccagtacgtcttggtggacactttcggcgtcgtctacggctacgaccccgccatggacgccgtctaccgtctggccgaggacgtggttatgtttacctgcgtcatgggaaagaagggacaccgaaaccaccgtttcagcggccggcgtgaggccatcgtgcgtctggaaaagacacccacctgtcaacatcccaaaaaaacccctgaccccatgatcatgtttgacgaggatgacgacgacgagctgtcgctgcctcgaaacgtgatgacgcacgaggaagccgagagtcgcctgtacgacgccatcaccgagaacctgatgcactgcgtcaaactggtgacgacggactcgcccctggccacgcacctgtggccgcaggagcttcaggccctgtgtgacagcccagcactgtcgctgtgcaccgatgacgtagagggtgttcgccagaagctgcgagctcggacgggctcgttgcaccactttgaactctcctaccgctttcacgacgaggaccccgagacctacatgggcttcctctgggatatcccgtcctgcgaccgctgcgtgcgccgacggcgtttcaaggtgtgcgacgtcggtcgacggcacattattcccggcgccgctaacggcatgccgcccctcaccccgccacacgcctacatgaacaactgattaaggaggggacgacgagcacggtggtcctgtttgtctatgtgcatgtttttgtatataacacagcattttatataacctttccctgtcttttttactcgtaaactgtgtactccgctggtcaataaagaaaaccacgctgttagaaaaccacgtcgacggtatttttattgatatcgacgtctcgtcctgagacagacacgtagaaaaagaggaaaaaccgcgttcagagatgccgtaggttttcggccagatcgtcccgcgggtcttcgacgtcgctgccgtagctagtgctcggcatgctgtcgggtccctggaagcgtgtgtgggccggccctcggggtgcgggtggcgggctgcgtcgccttcggtgacgtcggtggtggctgtaggctaccgagtagggcgaaaagagggtcacgctgaccatgcggcgtcgttgccggggcggctgctccaggtccgcggagctaatgccgtgcgaccccgacaaagaagaagaggagagtaagagacccgtggtagaagaagtcccggccgaggtgtacgtggacgcgggcgtggtggttcgtgtggatgacgacctggcggacggcagcgaaacagaattcggagatgctgaggacgacgacgaagacgcggacgacgaagaagctgcgtcggtcacaggacggcgaaaaacatcggcaaataaatcgcgatgttctgtgatctcgggttccgactcctggcccagaggcgctctgtcgaggagttccatgaagcgcttgggtgtcaggcccgtctgccgagaggcgccctcgatcatcatgctatagatgcgctggaggtgatacgtctcggtggtgatcttgccttcgtggaagttatagaagatctgcagggtttcgggccgttccacgaacatacgtcgacgcaggtagcggctgggttgctcgggcacgcggaaaacctcgccgttgccgtacaggttcttggagaagaaaaagagctcgccctcgcgcgccgtgggatcggcttcgagatcgagctgggcctcgcgcggctcgccgtcgttctcctgctcttcgtcctcgtccccgaactcgccgcgctcgcgggcgtccgagaccgattggatctttttcagcagcttgtacgcgctgaaatgtaaatatcccgggcagaggtacacgttggcctcgtgcagctgcgtcagtagttgcaacagattgtacagcatcggctggaaggccggactgctgtgttgccgcgcaagttccagcccacgcaccagcgtgacgaaagtctgccgtgtttcgggggcttgcgtgtaacaaaagtaaagcgcgtcgcaaagacggttgcagcgttccaccacccagtcctgcatcatttgtagctccagcgcgtgtcgcagctgtaagtgtcgcagcgtcaacaacagatacatgtcgtttagcgcgtcctccagggtgcgtgagcccgggcgtttgatggaggtgaggcagcgcaacggtcggttacgacgttgtgttacgtcggacaggttctcggcgcacagatccaccgcctcgaccgtggtgaagggcggtgggtggaacagcaggttataggtggtgaggcgcggatagcgcgcctcggcctcgggagacgcgcgcagccccagcgcgtcgcgtacccggtgcaaccggaccagcgctcgttttagcacgccgaatgtcacatcgtcggcgcccaggtgcacgctgatgtcctcgggcttgacgccggtttgcgcagcgcggcagagtcggatgagccctctaagcagccgcgtcttaagcggctccgagtacagcacgtcgagctgcgtgcgcaggtcccgcaacacatcgcggctgttgcggtagtgattagcgagaatgcagatacggataatctcctgggccacgggctttaccttcataaaagcgttgcgcacctggaagtccaccagggcctccagcgcgtatacagggctgggcacgccaaagttgagcagccccacaaagttggagcagccctgggtcaacatctcgagcagcaggcgccggtgctcgtctccaaacaggtcaacccgaaagttgagccagtcgtccacggggagaacgggcagtggcgggcccgatggggctcgcgatccctgggccatgatggggccccctttgaaaacgaaaccaaaaccagagcggaacttgagaaatcaacgctttattgttctccagtgacgttaaatacacaacggggttatgggggacgtgacgggggtaagggctgaggtgactgaaggtgagggggtcgcggcgactcgcacagaggtctggctggctagaggtccgtcttcttcgtcggcgcgatgccgcagggcggtcgctagcgtgtcgcagcgttcgccaccgttgccgtcgttgttggagacggagggttctgcccgcaggaatgctgcggttgccttgcaggagggaaacagctcctcttcttcctcctcgttttcttcgggcttttgctcgtgaggcggcacgcgtgtgcggggacgacgggcgttgcggggcttcttggaatcgtgaagcggcgccgggtcgctgtgacggagctcgtcgtcgtcctcctctccctcgtcgttgttctcatcggcctcgggcggcccggccgccgcgctgtgtgagagttccagggccgccgacaccgagtccgtatgaccgatctggaagagcatgcggtaggcctcgctgtggtaacagccgtcgaagacttgtgcgatatccaaacctgagttcatcaacaggtgtaggaagctgttctgcaggtagtggcgcaggtgtccgatgagacggatggagcgcgcccacatgtgcggcgtctggtgcaacaagccgatgaggacgtggcacagttcgcggtggcgctcgtgtggcagcaaggctaccagttgatgcacctctacgcccagcgccgatttttcgccgcagcgtttggtcaactcgtcgcgcgcgtagctcaccaccttgtcctggtgctcgcagtagtggcgcagctgggccgtgaaaaccagctggttgaagagcgcgcacacgcgcgacacagccgtctgcagttcgtcggccggcgtgggcggctcgcggagactgggctgcaggcggcagcggatactggccgtgacttgctggatctcgtgggggtccagttcggccggcgcgcgcttgagctgtgcgatgccctggtggaacttgcggtagtcgcgctcggtgcagaaaacgaagaggttgctgttgcggcgcgagcagccgccgggcggcacgggcaagtgcttcagcagcagcttcttcttgccttcggcgcgtaccgtgcccttgtacgctttggaaatcgagcctgccacgttgtcacgcatctcggcggctcgcaggactgaatcgtcgttggagaagtctcgggtggtgatgatgaagttcatgacgacgacggcggtggggcggtaatagtataggtccgtgcgagcaggccgccgccgtgggggccgcggagggaggagagggacgggaacgatcaccgctcggagaaaacaacgtcgacgggggacgtcgtttttatcgtaccgtgccgagacagaagttgcgccggacggcgttgtggcgcgcaggggctccgacgtggcgttataatgaagccggggcgccactcctacgccacgcgattggccgtcggcgtccgcagtcgggcgaaatctgtgtaccgtgatgacagatcagggggacgtgtaccgtatatgaggggaaatggcgacgggttctggtgctttctgaataaagtaacaggaaagctcataccccgctgaggttatgatgcgattgtgagagtcgatgggggatttttgtggatgtgtcgttggacgcggttttctggccgcctttccacgtaccgctgggaaaattgaaagacacgctgcgtttggcgtgctgattgcagtttttgctattggggtctaatgacgtagccactgattgtgaattgttgccagccgctagatttgtctccgctgtagctcgctgattctgctgcgatctcaggaaagcgcggcggtccagcaactgaccgcggaaacactgccgcatgcgttgcagaaagtcatgacccagcagcgcgtacaggatgggattaatgaggcagtgtaggtggggcaccacacgcgccagcgtgccaatggtgcgtcgcagtgtgaggtgttcacactgcatgggccaggcggttgtggcataactgttgaagatcatgagagagacgtagggagtctgtagcgccacgaaggagatgagtagcacgctaacaaaggttaaggtacgactcctttgtttctgtgacgtgcgctgtacggttgagtaaaagaatgcgtagaaccacgtcatcattatcacgggtgcggcaccccataccagcgtcagcagcactttccacgaaagcagcactgtgtgcacttcttcagctacgaagtacagtacacaggtggcgtgcccattagtattattggtatcgttggcatcgtgatgcatcaccaccgtggtgtaaacagctgcgggcacggaaaaaattagtccagcgagccatgtcaatagcaaaatcatataggttgaacggtatgattggcgtgcgtatgttcgtttatgaaggacgcgataacgatcggcggcgatcagagctacggtggcaaagcccactgtgcagcttgagtagtagatcaccgatagaaatttacacgaggccacgccggccggcaacagccactggttgctgagtacgataaagggtagcacagtaagcgtgagaaaattagtagagtagaggttggtcatgtaaatggtgggcgtcgaatagccaagcacgcggttcgtgagcagctgcgtgatcaacactatggcgttaagtggaccgcccacgaagatgatgaatgtgttgagtacggcttcggtggttcgaatggcgaatagcggccctgtcatgttgcaagtgtcattgatgtgcggaggagtgttgttgcgggtctgggcggaacagcacacggggcgaaaaaacagaagaaacaagtcagcggcgcttaaaagaaaaccgcgtatccgcctccgctattaaactaccccccctccctctaggtggggcgctcaccgagttgtggatgatggtgtccatcgtgggcgaatagcagaccgcgggcgcagtccggggcgacgacgcttccgggttctggagaaaagccagcatgagtttgcagtttatcggtctacagcggcgcgatgtggtggccctggtcaactttctgcgccatctcacgcaaaagcccgacgtggatctcgaggcacaccccaagatcctgaaaaaatgtggcgaaaaacgcctgcaccggcgtacggtgctgttcaacgagctcatgctttggttgggatactaccgcgagctgcgtttccacaaccccgacctttcctcggtgctcgaggagttcgaggtgcgttgcgcggccgtggcgcgtcgcggctacacttacccgttcggtgatcgtggtaaggcgcgtgaccacctggctgtgctagaccgtaccgaattcgatacggacgtgcgccacgatgctgagattgtggagcgcgcgctcgtaagcgcggtcattctggccaagatgtcggtgcgcgagacgctggtcacagccattggccagacggaacccatcgcctttgtgcacctcaaggatacggaggtgcagcgcattgaagaaaacctggagggtgtgcgccgtaacatgttctgtgtgaaaccgctcgaccttaacctggaccggcacgccaacacggcgctggtcaacgccgtcaacaagctcgtgtacacgggccgtctcatcatgaacgtgcgaaggtcttgggaggagctggagcgcaaatgtctggcgcgcattcaagagcgctgcaagctgctggtcaaggagctgcgcatgtgcctttcctttgattccaactactgtcgcaatatcctcaagcacgccgtggaaaacggcgactcggccgacacgctgctggagctgctcatcgaggactttgacatctacgtggacagcttcccgcagtcggcgcacacctttttgggcgcgcgctcgccgtcgttggagtttgatgatgacgccaatctcctctcgctcggcggcggttcagccttctcgtcggtacccaagaaacatgtccccacgcagccgctggacggctggagctggatcgccagtccctggaagggacacaaaccgttccgcttcgaggcccatggttctctggcaccggccgccgaagcccacgctgcccgttcggcggccgtcggctattacgacgaagaggaaaagcgtcgcgagcggcagaaacgggtggacgacgaggtggtgcagcgtgagaaacagcagctgaaggcttgggaggagaggcagcagaacctgcagcaacgtcagcagcaaccgccgctcccgacacgtaaaccgggcgcctcccggaggctctttggctccagtgccgatgaggacgacgacgacgatgatgatgacgagaaaaacatctttacgcccatcaagaaaccgggaactagcggcaagggcgccgctagtggtggcggtgtttccagcattttcagcggcctgttatcctcgggcagtcagaaaccgaccagcggtcccttgaacatcccgcagcaacaacagcgtcacgcggctttcagtctcgtttccccgcaggtgaccaaggccagcccgggaagggtccgtcgggacagcgcgtgggacgtgaggccgctcacggagaccagaggggatcttttctcgggcgacgaggattccgacagctcggatggctatccccccaaccgtcaagatccgcgtttcaccgacacgctggtggacatcacggataccgagacgagcgccaaaccgcccgtcaccaccgcgtacaagttcgagcaaccgacgttgacgttcggcgccggagttaacgttcctgctggcgccggcgctgccatcctcacgccgacgcctgtcaatccttccacggcccccgctccggccccgacacctaccttcgcgggtacccaaaccccggtcaacggtaactcgccctgggctccgacggcgccgttgcccggggatatgaaccccgccaactggccgcgcgaacgcgcgtgggccctcaagaatcctcacctggcttacaatcccttcaggatgcctacgacttccacggcttctcaaaacaccgtgtccaccacccctcggaggccgtcgactccacgcgccgcggtgacacaaacagcgtctcgggacgccgctgatgaggtttgggctttaagggaccaaactgcagagtcaccggtcgaagacagcgaggaggaagacgacgactcctcggacaccggctccgtcgtcagcctgggacacacaacaccgtcgtccgattacaacaacgacgtcatttcgcctcccagtcagacgcccgagcagtcgacgccgtccagaatacgtaaagctaagttatcgtctccaatgacgacgacatccacgagccagaaaccggtgctgggcaagcgagtcgcgacgccgcacgcgtccgcccgagcgcagacggtgacgtcgacgccggttcagggaaggctagagaaacaggtgtcgggcacgccgtcgacggtacccgccacgctgttgcaacctcaaccggcttcgtctaaaacgacgtcatcaaggaacgtgacttctggcgcgggaacctcttccgcttcttcggctcgacagccgtcagcctcggcgtccgttttgtcgcccacggaggatgatgtcgtgtcccctgccacatcgccgctgtccatgctttcgtcagcctctccgtccccggccaagagtgcccccccgtctccggtgaaaggccggggcagccgcgtcggtgttccttccttgaaacctactttgggcggcaaggcggtggtaggtcgaccgccctcggtccccgtgagcggtagcgcgccgggtcgcctgtccggcagcagccgggccgcctcgaccacgccgacgtatcccgcggtaaccaccgtttacccaccgtcgtctacggccaaaagcagcgtatcgaatgcgccgcctgtggcctccccctccatcctgaaaccgggggcgagcgcggctttgcaatcacgccgctcgacggggaccgccgccgtaggttcccccgtcaagagcacgacgggcatgaaaacggtggctttcgacctatcgtcgccccagaagagcggtacggggccgcaaccgggttctgccggcatggggggcgccaaaacgccgtcggacgccgtgcagaacatccttcaaaagatcgagaagattaagaacacggaggaatagttaagaaacacacacgcagacgtactttttaatgaaatcatcggatagtgacgtgtcgggaaaggaggacggacggagggtcagggatggggagatgtgagaaagttgtccgcgggcaattgcatgtcgcccagaaagaacgtggttgctccggcggcgtgcatctgccgaaacaccgtgtggtgattgtacgagtacacgttaccgtcgccctcggtgatttgatacaacgtggcgatgggggtgccctgcgggatcacgatggaacgcgtgcgcgtccacagcgtgactttgagcggctcgccgccgcgccacacgctgagccccgtgtaaaaggcgtcctcgtgtggcaagttggccaccaagaaacaccggtctgtgatctgcacgtagcgcaagtccaactccaccgtctgccgcggttgcactccgaagtggatatcgtaaggcgcgtgcaccgtgagcgaaaacacgttgggctcgttgagaagcggacagttgagcgcgtcgccgctaaaaaagagtgacgggttgcggctaaatcgcaggtcgtacccgcgctgcgcgctcgtcagcaggtagaaggaaaaggcgcgcggcatgttgcgcgccgtgatcttgtccgagacgcggtgacagaaggaggtggccacggtgcccagcagttggcgctgttccgcgtccacgcatagtgaatccacgttgacggtgaaaatgagacccatgaattcgtactgtacgtttttggacgcgatccacgcctcgtcctcgccgggtagcgccgcctcgtcgtcgtccatcgtgccgcggaactgcgcgaggtagcgcgtaatttttttgtgtccgtacgtggttacgcgtttactgatccaggtcagatggtccacgcgacacagcagcgtcgcgccatgccgcgtgacgctgacccgtccaaagggcgccgtctcctccaaccccgcaacgccgctcggagcaccgccgcagcccggctttcccggcgtcgtgaaaggcacggcgtaatgcgggcaggcgtgcggcacgaagggcaccatgaccagttgtgtgtgcagaaaaccgatctgcaccgcctgcgactgccgcatggtttcctcgtcgtaaaccgccatggacgagcagagcccgcccttggtgatgagcggttgcagcaccacggagctctcgctggtggagcagagcagaaagaagagctcggcgtacgccgccttgggcgtcaccacgttggaccagtcgtacttgtagccgcagccctgcgtgttgttgtaaatgacgggaaacgagagaaagatgcagccctgcacgtacgaagctttctccgtcacgttcgaggccgtgttgtactgctcggtgatggacaccaagtacgactcgtaggccgtcaggtgcgaggccgaacggtgaatcttggcgtggcgcacgcagcggccgtagttgtcgcggtccgcgtcgcgtagcgcttcgatccacgaggtcaccacgtcctgcgccggcagacgatagtcctgctcggggtccatgtggcggcacagccgcaggcgctctgccagttggcgagggataccgtcgtgcgaccttttgaccgcggtggtgcccgtcgtcctcgtctcccctccttcgtcctccctgttttctcttctctcattcccggtctccggacccgcagccgctacctcttgctccgcggttttctcgcccacctcgctcgtcgctgttgccgccaccgcagcggcggcgacggacggcggcggtaacagcagctccgtgaagctgacgagcggcagcggcgacgacggtggcggcgacgacacggcgacggtcaacagggtcacaagcgtgggcttgtcccccataatctggtcgccgccaccgccgtcgttgccggtccccgtttcctccggcgccgcggtttccgccgtctccggatgagcggccgcggcgcgggctcggcgtcccgccgtccgagacggtgtatataaaccgcgtcggcctcgccggcccgagcgcgccggggagaagaatctcttcccgggccctgcgttcaagacggcgtgccgtgacgctcgatgggtccgcttcatcagactgcgtacgctttggagcgtcagacccagggcgcatgtagccgacttggaggactttgccgccttttatcgcaccctctcggacagtgagcagcaggagttcgagcaagaagccgaactcgcctcccgctcacaacgcgtgcgagacctgcgcgaggcccggcgccagctcaagatggacctgatgtgttacggcggttgaaaacgcgcatgatctcgcggagccatctacgcgcctgtcagggcgatgacgacatcggcgatgacggctcctgatacgcgccgacagctgcagcacgtggagacgctgcgtcggtttctacgcggcgacagctgctttgtgcacgatctccggggcatgatggactatcacgacgggctctcgcgccgtcaacagcgtgccttttgccgcgcgggtcgcgtgttgacggacccggagcccatccagagcgagacggagggggagaataaacagtttacggagcacacacacaaagtagtctcgttttttattaaaagtgtctttgtatttccctgtcttgtgttgcccaactgctgtcaggtctccgtagatcgctcccgggtgcccgagacggggggcagatggctataaaaacccaagtagcggcgcgccccggcgctcagtcgcggctgagcgtgtggaggacggggtggagcgggtcgccgagactactactgcttctgcttttttgtctcctgtggatcgtcgcggactgccggcatgtccggccgtcgcaagggctgctcggcggccacggcgtcttcctcctcgtcgtcgccgccgtcgcgccttcctcctctgcctgggcacgcgcgtcggccgcgtcgcaaacgctgcttggtacccgaggtcttttgcacgcgcgacttggccgatctgtgcgtgcgacgcgactatgagggcctgcggcgttatttgcggcgcttcgagggctcgtgcgtgtcgctgggctggccctcgcagtgcatctacgtggtcgggggcgagcattcgccgcactcgctgaccgagatcgatctggagcactgccagaacgactttttcggcgaattccgagctctgcatctcattggcacggtctcgcacgccacctgccggtaccaggtgttcgtggacgcgtacggcgccgtgttcgcctacgacgcgcaagaggactgcctgtacgagttggcctcggatctggccggattttttgccaagggcatgattcgctgcgacccggtgcacgaatccatctgcgcgcgtctgcaacccaacgtgcccttggtgcatcccgaccatcgggccgagctgtgccgccgctcgcgcgcctccgctcgcggccgctatctacgttcgctgctggctttccgcgagttgctggcctgcgaggacaccgccgctcgctgtgcctacgtagaggcgcaccgcgaggcgcagctgaccctcatctggcctgagaagcattccctggtgctgcgcacggcgcgcgatctggggctctcggcctcgatgctgcgccgctttcaacgttcgttgtacacgcgcgagcccgtcatgccgctgggcgagatcgagggcgctgaggacaagaccttctttcaccgcgtgcggattctctgcggcgacacgggcaccgtgtacgcggcgctggtggggcaggataagttggtgcggctggcgcgcgacctcaggggcttcgtgcgcgtggggctggcgctgctcatcgacgactttcgctacgagagcatcggccccgtggaccgcagctcgctgtacgaggccaatcccgagctgagactgccgttcaaaaagcgtaggtgagtcatcagtgtacacacgtccagaaatagggcgacggtgtttttataaccgaaagtagcgtgtttgagacacgcgcttatagtcggttttttcaccgtcgtcgctctaggtttgattttcgcgctcttgtgtctcccgacaggctcgtcgtgggctactttgactcgctatcgtcgctctatctgcgcgggcagcccaagttcagcagcatctggcgcggtctgcgtgatgcctggacccacaagcgcccgaagccgcgcgagcgtgcgagcggggttcacctgcagcgctacgtacgcgccacggcgggtcgttggctcccgctgtgctggccgccgctgcacggcatcatgctgggcgacactcagtactttggggtggtgcgcgatcacaagacctaccggcgcttctcgtgcctgcgccaggctggccgcttgtactttatcggcctcgtcagtgtgtacgaatgcgtgccggacgcaaacacggcgcccgagatctgggtctccgggcacgggcacgcctttgcgtacctgcccggcgaggacaaggtgtacgtgctggggctctcgtttggcgagttttttgagaacggtctctttgccgtgtacagcttctttgagcgcgactacgtggatgaaatcgtagagggcgcatggtttaagcacacctttgcgggcatgtacgaactctcccagatactgcacgaccgcaccaatctgctgcgcgtatgtcagctccacgccggtagcaagatccgcctgggcggctcgcccgcttgtactttcactttcggctcgtggaacgtggccgaggccgacgaggccaacaattttgtgatcggcgtgctagaacaggcccactttgtagtcatcggatggatggagcccgtgaacaaagccgtatttatggacgcgcacggcggcattcacgtactgctgtacggtacgatgctggttaagttggccgagacgctgcgcggttttatccgtcagggctccttctggtttcgttgcccacggcgtttttgcttctcgccgttggactcgagcgcaaccgtcgccgcgaaaccggtgagcagccatacatcgcccgcgtacgacgtcagcgagtacgtgttttcgggccgtagcgtgctggatagcgtgagcggcacgggggcgtcgtgaaggaggagactgtgatgactagctatatagccgctgtctggctttaccgccgtcgctccgcgtcgcttcgccgccaccttcttcttcctctcagtcatgaaccccgtggatcagccgccgcctccactgccaacccagcagccggaggagcaggctaaagaagaccatgacgacggtgacgagcgcctatttcgcgatccgctcaccacgtacgagtatctcgacgactgtcgtgatgatgaggagttttgtcaccagttcctgcgcgcctacctgacgccgattcgtaatcgacaggaggctgtgcgcgccggcctgttgtgtcgcacgcccgaggatctggcggccgccggcggtcaaaaaaagaaaacgccggcgcccaaacatcccaagcacgccatggtgtacattcgccgcagctgtctggtccattcagcctgcgctacggcgcacggcaagtacgacatccgcggtctgacgctcgagtcggacctcgctgtctgggccgcgcttcgaggcgtgcccttgccgcccgatccgcagcattttcgctggctcaacgccggcgctttccgccgtctggtgcacgaggcgcagtacttgccagagatcagtcgcgccgccaaacgcatcgctctggccgtggccacggggcaatacgtggtgtgcacgttgctcgattacaagacctttgggacgcgcacccattacttgcggcagctatgctcgatgaccgaggagctgtacctgcgcctggacggcactctgtgcctgtttctggagcccgaggagcgcgaactcatcggccgctgcctgccggcggccctgtgccgcgggttgcccgtcaagtaccggacgcaccgcgccgccgtttttttccacgccacgtttatggcgcgagccgaagcggcgttgaaggacctctacgcggccttttgcgagtgcggcgacgggcgcgacaacggcggtaatcacgacggtaaccacggcggcaatgaccactcctctttgtcgccctccgcggtggcgtcccaccattcccgtttggaacacgccgagctgaggctggagcgcaacagacacctgggcgcgtttcacctgccagcgatccgccacctcacggccggcgacgtggcccgcgtccagaacagcgtatcacgtgacctgggcttcgccgactggtcgcaaacgctggtcgacgactactttctgctccccgcgggctgggcctgtgccaacccgcgtcgcggctacgccatgtacctggcctccaacgccgtgctggccctgcgtatcattcggctgctgcgcgccagtatacgtcacgagtacacggcgtgtatacgtatgttgagcggggacgtgcagcggctcatcaggctgtttaaaggcgaggctgcgctgctgcgcaagggactcgctcagaaccccgtgcaacgtcgagaactgtcgcggtttcgcaaacacgtccacgatctgaagcgcattcgcttcaccgaggacacgttcgtggagaccttctgcgactttctcgagctggtgcagcggattcccgactaccgcagcgtgtcgctgcgcatcaagcgcgagctgctgtgcctgcacgttttcaagctgcgccggggctgtcgcgcgccgccgacgcccgagacggcgcgcgtccagcgtctgctttggcactcgctgcgacacggggacgcgccgcaggatcgcacgcggctgccgcagttcagctcggcgctctcggacgccgagctgagcaaccacgccaaccgttgccgccgcaaggccccgctggaactcggacccgccgtcgtcgctgccccggggccctcggtgcgctaccgggcccacattcaaaagtttgagcgtcttcatgtacgccgttttcggcctcacgaggtcggaggtcacgccacatgaagccgcggcggcgcgttataagcaccgtggggtcatcgaccgacgaggcgcggcgatgacgagcaggcgcgcacccgacggcggtttgaatttagacgattttatgcgccgccagcgcggtcgccatctggatctgccctatccgcgcggctacacgctgtttgtctgcgacgtggaggagaccatcctcaccccgcgcgacgtagaatactggaagctgctggtggtgacccagggtcagttgcgcgtcatcggcaccatcggactcgccaaccttttcagttgggaccgcagcgtggccggcgtggcggctgacggcagcgtgctgtgctacgagatcagccgtgagaactttgtggtgcgcgccgccgactcgctccagcagctgctggagcgcggcctgctacacagctactttgaagacgtggagcgcgctgcgcagggcagactgcgtcacggcaaccgctcgggcctgcgacgcgacgccgacggccaagtcatccgcgagtcggcctgctacgtgagccgcgcgctgctacgtcaccgtgtgacgccgggcaagcaagaaatcaccgacgcgatgttcgaagccggcaacgtgccatcagcgctgttgccgtaacaaaacaggaaggaaaaaaacacacacatgaaaaacccggagaagacagagaggacgagcgtccacacaccgctttggtcgtagacgtactttttattcttggtacattaaaaaacaaacatatactttcttgtgactttttaccataaactgttccgccctgctgcttcgtcccaccatcagcaacagtactccccgctgtcgcggcggtcgcgacggtgacggtcccgctcgtcgcgttgaggatagtcgcgcggcggcagcgggggtggtggggatcggcagatttgttcggggtgattaccgttcgcttccataaacgctttaagagccatctcgcgtaacgtgtcttcttcgcgttcgtcgggggggacctggctaaagattttgagcagggtgacggaggagacacccgtgtgttcgaccggaatgtgtcgactcgagggctgcgcttgcaaccgcgccacgcatatgtcgcgggtgatgagtttctggcgcaggtgggtggcgcgcgggtcgcgcaacagcggatcgcgcaccataaactcgcctacgaggcgttgggagctattgctgccgccggtgtcaccgataataggtctgtcgggacaggccagcaggcgcagggcgcagtacacgtagtcggtgcaaatgaaggcgtcctgctgacgcacgacgcgtaaaaagtcaaacaacgccggcgtgctcgcgtagagcgcgtagtcgtagttttgactaacggcccagtagagcacgtcactaagctgcgcgtagtcttcgcgcagcgacggcagttgtacatagatgaggtaacacagctccgagatgctctgcagctggtgctggagatagcagcgcagtacgcgaatggtgcgttgaaagtgcgtgatcataagctcgacgcctactaggaacgccagatcgttgagcgtgtgctcttcgcatatctcttcgaccgaaagcagccggagcatgccccggtggttctcgttgagccgctgcaggttttgccgatagaggtagagcgcgccgcgcgaggtgtagtgggcggtatagaagagcacgttgtaatcgcgtagcgtctggtagacctcggtgagccgcggcgattcgggcgtgccgcgatgccgcagctcttcgtccagccgccgcagagacgtggcgtactggccgtccgtcactccttttcgtgacgtgagaaagtgaagcgctagcgcggccgcacgccccgaacggctctggttgttgacctgcgcggctacccggcgtaccgtgtcgccccgcacggtggtccgtatggcctccaccatgtggcgcgctttcttttgcgccacgtagtaatagttgatgatcaccgcgtgcgtgattatccgacgcgtgagatcgcgctcgccaggcgctacgttgtttaagacggggtcgacgaggctggtgagcgcaaaggccggcatgggtatgcattcgttgaggcggcggaggtgctgcacgtcaaagtcttgcagcacgaatttgagatactcgacgtgctgcggcgcgaccacgctgggctcgaagcccagattgtcggccacgctgacccggtaacattcgcgctcaaagtcttcgatgtcgctgtcgcagaaggaaaactcatcgccctcggcagcggacggctcacctggcgccacgggactggtgcttctgctactgttactggtggtgcgactgctgctaccgccgctgctgctgttatcgtcgccaccgccgccggcaccgttctcgggcagcgagggcacactaggcggtcgcgagactttaggcgacttgccggccttgggtgtcgccggcgagccccgaggcgcgcccgctgcgatctgcggttgccgacgcgacgacgatcgtttcttttcgctcggtttcttggcggcgccggtgccgccggtctcgcgcacgagctcgaaggacgacggagcgtccgaggagacgctgtagggcgacaaaccggcctccatgcgatccagatcttccgtggcgctgcgcgcccgcgtgctcgtgaaaacgctgtcctccgcctcctcatccgccggtgtgtcctcgttgctcgaggggatataaatcaccgtcgagggttcgccagagcgacgtgacgagctgcgacgccgcgacgacatcctctcgtctgctgaggtgcgttcggctcagttgcttacctgcatacatggaggagacccgggcgggacgttatatagtgagggccggctccggcgggcaaaccgaagatacagcctcgggcgcggaaagtgtcctcgccacgctggccgcggtgaggacaagaagacggagcgtggtgtgcgacgggcccccgggctcgcccactgactcggcgcgtcacatgagcgatctggctagcctggcgctcacggccgagttcggcctgggctgtctggaagcttacgtgcgcatcaacgcaggccaggtgttgcccgtggtctggccgccgggctggaacctagtgctgcaggagatcgagacggacgaggacttcaaaccggaggacgtgaaggcttggagtcactacctgtgttgccagacgcgcctggccttcgtgggtcgcttcgtgaacgagggcgtgttgtcgccggatcagcagaagaagaccgctgtgtgcctcatctcggacgagggctatgttttttgctatgtacgcgaggacaccgccgtctactacctggcccgcaacctcatggagtttgcgcgcgtcgggctgcgcgccgtcgagaccctgcactgcatgcgctacctgacctcgtcgttggttaagcgctactttcgcccgctgttgcgcgcctggagcctcggtttggataccatggcgcgatttatcatccgccaccacgggcagttcatgccgttgacgtacccgccgggaacggaactgcgtctatgcaacctcaggtgtttcgaaaacagcgtggaaggcggtcacttgctgcgcaacatcaaaaccgctttcggaatgcgcgttctcggcctgggaaccgtcagcctcaagggcgagaacgcgccctttcctcacttgcgctggcccgtcgaccttatccccatcgtcatcgcctataccggggccgtctacgcctgcgacgtgcgcgacgaccgctacatccgggtgggagataatctcaacacgttcatgtgtctgggacttaacctgctgtttgaaaaccgacgtttcagcggccacaacggcatctacgatcgcgtgcccgactgccccaaaggacgtcagcaccgttgactgtgacgccacgagtgacgacgacgctgcttggggcataaaacaccgacgctacttcccgtttgactcgcgtgccaattttttcgctgccaacgccgtcaaggccgcctcttctggccctccgccacccttcgctcgagcacggcggtgttttgccgtcgtttttttttccggatcggcccgatttctttttgtccactgacgcgcgaccgcgatgtcggtaatcaaggactgttttctcaatctgctcgaccgctggaggcctcctaagacgtcgcgaccgtggaaacccgggcaacgcgtggccctggtctggcccaaagaccgctgcctcgttatccggcgtcgttggcgcttggtgcgcgacgaaggacgggatgcacagcgtctggccagctacctctgctgccccgagccgctgcgtttcgtcggcagcatctgcacctacaactttcttaaacacaagggcgatcacaacgtgccgtctgaactgtacctgggcgcctcgggcgccatgtacctgtggaccgaccacatctactctgactcgttgacctttgtggccgagagcatcactgaatttctcaacatcggtttgcgacgctgcaacttcatcaccgtcccagaggagctgccgcacaccgcctcgcttagagcgctggccggctgcatgcacatccacgcgttcgcgcagtggcgtgctacgtatcgcggccgactcatggtcatgggtgattacagcgtcattcgcgtctccacgattcggctgtacgactggagcgagattaacgactggagggtcatggtcggcagtaaccacgtggaacctttaggctggttggtgagcccctacgacgtgatcaacctcttcgtggacgactgtatgcgcgtctttgctgccaacaatcagcacgtttgcatcgtggccgacagtttgatggagtttgtgactcgcggcatgacacgctgccacgaaaacggcatttattacggaaccaggagcatgcggaagctaaataagcctacctgtccttacggagtggaccaccaactttttgacgacgcgtgaacccgcgtctcccacggaccgtgtgccttttttttccccgttcctgtaaataaaaagctgttttttatttttcatacgaaccgctcgagtcgcgtgtgttttgacggggctgggtggagagggaaggtcgcgccgccgcagcatcccgcatagcctctacaaactagcattctggtgagatacatgttcataaactctcacgggaaggctagttagacaggctatgggaagaaaccgtgtttcgcgtgccgaatacaaaagaaaaaagaccggaggcggggtgtttttagagcaaaaccttacagctttttaataaaaaacaaggtagtcaacataatcgttaacccttggggtctgctgttactgaatcttcttttcattttctttggcttgattttctttgtgttcatcagtcttttgtggttgctgatgttcgctgccatctccgtctgtaatcaaaacgtcatactccccggagtaatcttcgtctccgtcggtggtggaccccccctgactgagagttacgttcttgctgggggtggtattactaccatcagcgctggtactgggttgttccaccgtcacgctgcaaaaacacgataaccgcgttcacaatcacgttattttttgtatttcttacctgtgttgaattccccagattccgtttacctgcgcttcgatttctgagaaggtgccgccaaagccaccgtcaaggtcacggctagtaagctcaagatccatagcctccgagccatgctgaggtcttgtcggcgtcgctgctgacgaacgcgtctggctgtgtgccgttaaataccttgggtgacgacatctcgaggtcatgtggccgcttctgaaaaacaacgtagtccggacgggtcgcagatacgcggtttttcaacctcgacggtttacgcctcgcccccaacatgacgcgttcgggacgaaagacgacgtcaggggattcacggtatttagccatgcagcgtgcggcgcctctctcatggatccactgtcaccgtcgcgatgggaggtagccctgttccccagctcaccaccgtcactcaaggactcatgccatctgtgcgcatggactttcgggctcgccggcccttgcgccgcttggctttctacgcgccgcgagctcgtcggaggcttttccagaatcatatacatccagaacagcgccgagtgctggtcggtgagggagacgaagagatgttgccggatctgccgatggagatcgacatcgtcatcgaccgacctccgcagcaacccctacccaatccgctggtgctattgctggacgatgttcccccccatgtacccggttttgctccctaccgcgtcccccgtccccaccccatgattcccgaagaacattgggaccagttttaaataaaaacattttatttacatctgtacagggatcatataaaagtctatatatccagtctattgtcagtatttgtgtgctcaagttcagtgtagacttgtggaaaatatatagtccgtaccgcttggggctcagtccaaagtccgtcatgatggtatgcagattaccatgtgcgtgggctcaggcgacgacggaggagacggtgggaattctattaagtgaggaggtcgtggaggaagtggaggtggtaatgtccacattttgctttcccggatccaagggacgagcagtcgccgcgtgcggataggcacctggacttcaatgtccttgtgcgttaacaagttttctttttcctcctcttcctcagtgaattctggcaagcgttcaaagccgcgtgggcatatcagaagtcggccacagcgatagtaacagatgaggataagcagcgataaggaggcgagtatgatggatattatacttgtgattcctatgcaggacacggagaacaagtacgcgtttctgcgagtcatgtcgaatatataagcttcctgaagtccgcatgtaagcaccgccacggaattcaggatagcataactcatgaattcctttggtatgtcaccttcagatttgttgtaccattccaccgtgacgttgagggtatactgtttagcgggcagcgtgcagcgtgtttcattttttaacaactcgattctggtggtgttatgagaagtatcattaccgacccactttttccatagttcgcacatgcccaaaagatatcccgagactgtacttccacaggtgttatttgtatagttgtaagcatttccagagtaccaataagtatcgttttgagtacagttcaaaagccagagggtagtcaggtaagactcaccgcggttgatgcagttttttgtcaggttagctacgctccaattatctccactggacgcattagctgatatgttgccttggatgaaattgaatgtcccggttaggtcggtgtagtttgaatacaaacctccaacggctgtgcgggtgactccgttgggcccggtaaggagagatacaaagatggtatctgtattattatttcgggcgtcattgttcgttgtcacctgtgcccagtggtaattcagcatcaccagcatagcatgtatcccgagcatcttgccggacactgaacataacggcgtttgtatatataaagaccgttccaacgcaacattgaggtgtcattgacgtctttattgacgtggttttaccgcaacttcctcttttcgcaggttgaatgaggaacccgcgtagatccccaacgccggtttcatcataaaccaccgtgagaaccggcgcgggtttcaacacgaaaccgcgtcactcacggacgtaggttatttcgaaaacctacgttaatcctgaacgcgttttgtgtcacgcgtccccgcgactcacatctagctcgtcttctgacgctacccacgaatttcgtaaccgaatccgcttcagcgtttccattaaactggcgcaatccacttctgactgactcggtcgctcgatgcgcacggacccgtgatctaacacgaacatagtgtagtgggaattcgtggcgatggacgtcaaccgaccgcagaacccatcacgagtgcgtcgcgtgagaaacatgaccgtgttgacgggggcacgcggtaaccgacgtcgaaacagctcatacagggcgttgctggtcatgacgaccggaccttgcgatagcgccacgcaaaggccaggttacgtaggtattgtttcaaggtggtaaagtagtgcaggaacgcgaatagcaaagcgcataaaagcagggctaggaggacactgctgatggtcatggtgttatagcgtttgttagctgtcgggtgatcggggacctcccccgaggaactgtcgtcaggtgaggtaacgctgatggggatttccaccgtccaattaccgtgtgtaacgcggcaggtgtagttttgattgcaaaagatggctacgtaacatccctgatggaaagtcccatccaaggtgggaagtagcggattgcattgaggctcgctatcctcgggcaccttatcaccgtaatgaataaaagtaatattaatttcccctggaaagaacccgtaagatgtacagaatgcttcagctctgttgtcattctggtttcggacaccgccctttaccactgggtgggtgacgggggtttgaaacccgctataaatgacggaccattgagtgcaattacccttgagatagttcctttgtattgtagtatccccctcgctgatgtttttaattttaccgtcgatgtacgttttgttttgcttcaaccaactaatttcgtaattggggcccgtccatagtgtcaggttatccttgagctccattaaagtttccccgtcccacccaaatccctcgtaaccggctacaaaactaccgttttccgtggtattacactcgtgcgtccacgtcagcacgctctgtgaccggtaacccaacgcaatttccagctctaacaggttttgctcggtttggttaaaaataaggtcacctttggctctttccccgtctaggtaggtggggtaggccgccgagacgttggccatccaagaaatggtaccgttggcccgacttgacgttctatcgctggaattaacgtgataggtaaaaaagtgttgcccgtcaaaaatccccacgacggtcaacgtcatatgcgatgtatcatcaaaaatccccgtgtacccgtaacgcaacacgtgcattcccaccactctcaacatccatagcacaaacaacgtcagacaccacgttgtcatcatggcgttttattaacagttcctcggacatgatcggcgttatatactttcagtccgcgttttgacccctcctatcttctttgatgatgtatcctcttagccgtgtgttgtttactcctcctcttcgggagaccgtgccggatccgacatcagtggctccgagtcctcccgaggaaagaaaagtcgtcgaaacagccagcacaaatcgtgccaaaatagaaggacggccgccttttttcttcttttgggaatctcggcgggcctctgggggccgcacggagcgcggcgtcgaggtagatgtctgcggcgcctgtggtaaaccgtggtgtcccaggatctcttagacacctgttcgtccagaatcaacatttccaaccgacagtgacggggccggccgacgaagtgtgtgaagagcgcgtgatccatgctcgtggcaacggcgtgccgcgctcgtgtcaaagagacccgtccacgggggacatggccttcttatagcagcgtgaacgttgcacgtggcctttgcggttatccgttcagtcctcggtgcgtaaccgctggtatcgatgcggcaggcgaatgcgcagccgctgacacaatcgctgggggatccgtagggccaacaagaagaagaacagagtgatggccgagaccaacacgatgtctctcgccaaggtcgcggacagttcctcgtcggcgcttacggaggggtgtttggcgagcccggatccgggcggtctcggatatagtgagcccaatcggacgtagaggcgctcgattattttcatcgtaccgttctcgcagcgtaaacagtcatagcggcccacggtaagattagtgaccatgcggctggtgtacagtttagtcacagggacggttcgcattttcagtccgtcttgcaagatgttagtggtgatgtcgctgaaattgcggatcaccgtgtcgttctggtacaaccacaggtcaaccacagactcgttatgctgccaagtaaaagccacgccgatgatctcgtcttcggtcacattctcgtagtagcagatagaaatacacatcccgtgtaacgtccacgtttccccaggatggatcgaggccaactcagtcacattcaagcggcaggtcgagttggaggacttgctacccaggtcaacagcacacggggaagaggcagataagcaaagaacaaaaaacacccatcccagcggtaccgtacctcggcgacgctccatgccggcgcctgacggtcctttgtgcgcgctccccataagtacccaggcttttgaccccagtcggtacctacgtcagcatggagccccgtgtccgaggaagaaggaggagaggacaacgaggtccccggtaagattaagggtaaacatccgaaaccggtttatccccgccaatattcccaataaaatacaaaacacgcgttccttgacatcgattcaaaatttattgtgcgcgataccgcatcgccaaccacgaacacagtccaaaaaccagaaacatgaaccacagcccaatgtccgccttctggtgatcggtccgcgtacaggcggacgtttcattcgccgaaccgcgtctggtaccgctactgtgggcgatgggaccgacgtcggagtcgcggcgttcgttggcgccgctgccgcgtcgggtaccgctgccgcagatgagcgcaccgacggcagagccgcgtcgctcgccggcgcccgtcatctgacattccgttttcctgccgtgactgcgaatcatccgcttcatggctctcctcgtttactcccgctgctgctcttcctcagagacggccgccgccgctaccgcagaggcttctcccgcggcagtttcctctgccgcctcgttttcctcttcggtgttcagacgccggtacgattcggaacaccagtagcacagcaggtggcagagggaggtcagggccaccgatcccgcggccagcagcccgatcttcggatccgtcagccagtaatccctccgcagatgatagcgccgcctagcgccgtctacccgatgccggtggctgcagttgttgtccgcgatgctctggctgatgaagggcacgcacagttcgcgctcgtcctcctcgcacgagggcagcagacccgaggtgccggggatgtagtggaccacgcggtgccgttcaccctcccaaccacagtttatactgcgcaacctggagggatcgggcgtccacaggtaccgcgtctgtgagcgagatccgaaagctaggtcgcaggagcggtccgagtggcgcaggtcgtgcacgtcggccaccagcgccgtggtctcggtcgccaggctgtgggtctcgttgcccagcacgcaggtgtaggtgcccgcggtctcggtgataagccgaaacgagaggctcagccgctgcgccgcgccgccgtcctcgaagcgccagcgcccgccggcgatgtaacagctggcgtcgttgtgtaacacctgaccgctgcgtgcgtccaccaccagcgaacgcacgatctcgggccagtagcagaggtggactcggatagagacctctggccagtcgtgcgcggggaagatgcaggccacctccagacggtcgccgtaaggcagcaactgcggtgagcccgggttccgctcgcggttgcggtcgcgcaccggctgcagacagggcgaacgcaccaccggaggcgcatcgaggcagcagttgccccactcgctccaggcgatcagcagcggcagccacagcggcggcagccggccaccgcccatacctgtctgtgtttcagagctccttaaaaagaccacacgcgaccacatattatatataaggtgcgattggcagattatctttattggtagtgtttgacacgcataagcgaccggggatggggggaaataaaggaatggctcggtgtattctaaatcgtcatgggccgtcgaaccaggtagctcgagacccacagtcctaagcatagacgaaacagggcacgatgcgggggttctcggggcggacaggccacggtcagcgtatttgtcgtcattggcggcgattcacacggtccaccttcctcgttctcctcctgtgacctcctattcagttctccttgtcccgctggataagtgacctgcggctcttgaacctcatgatcatcatcatatcttcccgcattattccttctctcgtcgtttccacttgctcggctcccatcattcccttctctcgcgccctctctcgaaacgtcctccacttcttcacgttgagtgtgcgttgaatttcttgtctcctctcccgtaagctgttgacgtggttcctcgttctgccggagcaccgtgggtgccggcggtatgacggccagttcttgcgcttcggccgccgggttctgtcccggaacccacgtgcgacgccacaacgtggttctttgcacaaaccacgtacgtactcgcgtggccgtctggctcacgacgttgctttcctcccagcgggttctgatctggctagagacttgctgtgtccaaccgtggcaccgtaggcggaacagctgccagcggaccgtcagttgttggcgtagttgacggagtcccgcaccgccgggtcgcggtccgccggtgttgggaccgcttcccgcgggatgtctcagacgcccgcgtccgaaacaccgttggttggagaagcgtattcgcgtcaggagcagcgagtccctgctgcggaccgtcagagcgttatagcgccgtctttcgtgccgtcgccgcactgcgttgtcactcgcgccgtggctgacggtgctttctgcactgtgtggtgattcggcacgttctgcgtccgcgtctcgtgcatcctctgccggctgcgatggtggatccggaggggggaacgagggtctcggaatcgcattacgcgactgatttcgccgccgttgttcttccaccagatactgcagctcttggtactgccaacgtatcccgtttcgcgacggcagttcgggtgatacggcgtgatgctgtgatgacggcggtctcaacggccgcggggaacgcacatcgtagacgggcaaatgcgggagcgatcccgaccaaagcggcggtcggtccaggtcaacggcgtttcgccgtgtcatgaccgacgccgctctgacttggaatccggcgtgctgcatagcttggcgcactatggacagctggtacgtcgctccttgtatttcccgtagccactcgtcctcctcgacaatgtccaagccgtgggcccactgcggccgctgaaaaaagagtaagaatggcagtctacacagtagcagcgggagcagatgataacgcaagaagcgaccgcagtgggcccacagcatgctcttggtctttctagggccggtcaacagctttatgaagggaatcagggacgtcggctttggaaagcccccttggatcctttcggtatcgagagcgcgcctggcttcaaatacgtcaaaggcctgtccgccgcgccagctggcacggagttggcgtttcacagtgatttcatgcaatcatttcctacgcgacttgcttacagatcggtttgggggatgagcacgatgccgtgcttgtcatgctgccagagcagccacagcttttgcggtattcgaaagtagaaaatgataatgatgataataacgattacgaccgctaaaacccagagggcgtgtgtagccacgtgttggtgctgtgggcttggttgtaacggtgtttccgctgctgtggcttcaaaaccaacgtgatgttctacgtgactgttaggggtggtggattttttgggactggagtgtttatgatgggtagtgcttatcgtcgtcttcttggcggtggtggttgttctcgtggtggttgttttttgtgttgtggtagttgtcgttctcgtagtcgtagtgggctttttggtggtggtagtggggaatgtaccgttttcgttcactgtcagattgtaacatgtgtctaaagtccatcgaaaaccatggttatgttgttggtgacgccaatcgtctagcgatgtcatagtacgataggtagtactatactgcgcggtaacgttaatgaggaggaggctgtaattactcagacatgaaaaattaaagcgcgtgctgttaaacgttgttgttgatgtgccagtgaaaatgcataacatgtagccttgcccgcctggaccgtatgaccaacgaacttgatcgcgaggggggagaacatctaccgcgttcaacgtaacgttggtacctatcttgccaaccaccggtatgcaggcatcatggaggctgatgtagacaccaaagatgcatgcagccgttaggtaaagtaccttttcgcgatgaaaggtaatgtacctgagcagcattctaccacaggtgatttccacatgttctcaggttccgtagggactgtccctatattcaaacagtgagtttgaaaccggacatatccgtccgctcacgataattagtccgtagtgggcaggccatcggtccctttgtaaaggtatcccttggtgtcccatttctctcggagtctttgaggaatcttgaagaaaaacagaatgacgactatgataatgatgatgacaatgagaatccatgcgctgtgtgcggcatctttggctctatgtgcctctacgttaccggtaaacgagtccgcaaagcctttcggcagacccgttacattgtaatctttaggtgacgttcctcgcgtggatcttttgtgctgcgtatgtttatttggcgtggtttttaatcgcgacaacgtagttttttgtccgggtcttctggtggttgtcgttctagaaatcagcgataatgtaaaacatgtgggaaactcacagttaccctttggtggacattttcgcctgcaatagtttctgggatctgagacgtttacatgaagaatgcttaatgtggaattgtgacattcatacaacagtggtgatggcaacggagtggttttcattgtcttttgtctaccaggtttaggagggtcgtaggtgcagataggatgcgtattttcgccgttgctgatgccgacgcatgactggttataccagtgtactttttgtcctggatgataaccatgtccactaccgagggtaactggatcacctactctgacagtgacctccatacaggtttcggaatacctgtaaaatatcattgcggtcacgacagaccatcggaaaagatcatggttcacgatatggttaatcagtctccgcataacacaaacacctgttgtataaccacgtatatgtacgtcattatgtttacggtattcaaacagtgagctgaaaaataaacgtacatagcttttagtttcctcgacggtgattctttaagtggcggcgagcatactgttgtatcggtattgtgtgaatttattccaagctttctggggaaatttgaaacaaattaaaacgataattgttataacgataactaggggtatgatccacattgtatgtggggtggcagtatcgtgttgtgcttcaacgttaccggcggtataatggaccgcgacatgtgtgaagttggttgaagttaatgtgtatgacctgtgtacgggtgtgggtgaatacatggataacgtggttgtacaacagtgtgtttggtaggcagaatgtacactgacattgtaacacagggtattgtattttgctattgttactccaagggtttcaaaagaattaaaatagtaatttctactatatgtagttgttaaattaataagaataagtgtatgattctgtacacattgccacttaatgttcggagcgttctcattgggttgtacactgcactcgttattttgataaatacatagtgcgttagtaactctcggtttgtctatataccattgaaaagcatcgtctttgactgacaatttgttaacgggagataagctgatattctggccactgtagccaactatagaagtacatggcgttgatatgtagttccaataattggattttcgtgtacaaagaatgattgttatccatcgaagtaataacgcgtaccggaacatcatagttctgtgtccgtcatgaacacttgtccatactgtttactgtctttccagcgatcgtaaacttttcgaggtgctcgcagacagatgataataaaaataatgagaatgatgacaataattagcatccaagaataatgtgttgtcgttctctgatattgtatttccccaaccgggtgttccacacgttgtgggataatcgtagtcgcgttgtcaaagtttaccgcagtctccgtgcttcccaacaacgacgcactggctcctaacgttgtccggtcactgttatttgtacgcgttgtattggcggtcttcgtgagtccataatttccgttgtaattttccgacgtagatagtcccgggctagtcattgtgggcacaaaaccttctccctgataaaaagcacattactataattctgatttactacacaacaatttccaccaccccataatacaaacaactatcagaatcaaaaacacgacaacacctaccaaggccaggtgtgtgttgttttccgagggcgtttgattggagaatccagcaacagcacgtagttgtggtgttaaaatggcatttctagtcccgttactctccgcgccagtcactgtcggcgtcgttgtaacgatggttgttacgttattagctgaggtagttttcagagatttcagtgtcacggttaagttgtaccacaggaacgtttcattttcgccgcttttcatgaaaccttctgctccgtaacgacccgagttgttcaacgtcaggttgaagatggtgatctggctagccgcacaacttagacttaaacccacataaggcgttgaaaatccttctttggtcttgtagaaacagatgagatcactgtggttgccgtcccagcgaaaccaccgtacgctgatgtttgaagtgaagttagataccagggtaacgttccctccctctggcgcatacacgtagatgacggattccaaaatcacgggggcaaacaacgccaaaatcaatagtttattgtacacatgatgcactgtccaacggaatcgtggaaccgtcataagatgagaacccacgccggaaaccatgatttatttaccacggtacgatttggaaacagtcacgctcaaacagtactttttatttcctacgttaacagaccacgttcttcatcgtccacgtggattcgccagcgccgccaagccgattgaggcaaacccaaatcaatgagcaccatcacggcggcgaacagcagcatcgcaacgccccagctgccataggtgaatgccaagttagttatgttcttggatgacgtcctgttttcgacacgctgttgccgttgataactaacgtgtttaaacgcgctggaatttaccgctagagtcgacgtaatgggtgacacattcgccgtggcgtttgtaactaccgtgggtgtcactacggtggttgtgctctgagccgccttgggatgcaccgtcaagttgaaacaagatagtgttatatgtttgtcggtacagttgtcaccttttcgataataagtgccactatgattttgagaaaggttgtacataaaaaacgttgtccaagaacagccgaacgctacacgatgtcctaatgagacttgggtatatggtccccacagggtacaccatggccccagcgtacttccattctggtaacgtccccattgggttatgttacaacctgatgacgccgagccgcataactcaacgttttgtcccactgttgtagataccgcgctacagttaggcagcctatgagaaaccacgacccaattcgttgagccttcagaggcacaaaccatcaaaatcagaaccagcgcgtatctggaaacccagactttattaaaaaggcagctcggcatgccccggggcgtgcgggcaaaagctaacatgttgagtgctacatatgtgcgtgagcgcgtattcaaacagtgagttatcaagcacaccccagcccacccgttcatcttagcgtgcactacccgcaaaagtccctcccaccccgtttcagactctctgactgaaaacaaatatgcaaaagcaaaacacaacaaactatacacagctggctaactagctacacggtagcgacgagacgttgatagcggtatttcagaggacgggcgatgtcccggagacggtctatgcagaaacgacagatggattgtggtacgcgaaacaggctggcgaaaagcgtcaaaagtcctagcaagacgaagccggtgacccaggtggtgtggaaaatcaggcctccgtagaactgcttagtgatgatgagacgactccacggaacgagttcttcctcccgcgacaacagcatcgatcggtcaggaggaggcgcgatcgccagggatggtgtacgagtgctcacgctggaggtgaatgctgcttcgtcccttgatatagccttgttactctccgcctcggtgatgtcgtaacagcaggactcgaacgtggcacaatcatggagacgcaaaccgatcaaccacacaaaagacaacacgagctttaagcgtgatctagatacacgatacgcagcaaggccgggatctacacagtcagagtagcctagaaacatgttagcgccgtagggacgcttaacatttcaaaagcaacgtaaacacaatagctacagctgcgcggttctgtggaacttcacgtgcgatctttaggacacggtcagattgtaacaagagtaatagaaggtggaattcgcatcttctcttctgaaatagtaattcctgctgttttccgttgtcagattcagtaacgtcaggcggtcataggtgcaattgtacgtgaggttggttacttcatatctgtaatgctgctcattagaatcaccagggagttgcgggaagaacgagcaaatggacttataaccagacccgagtagccaagataaaaaatcttccgttttattcttgagaccctgaaaagtaacgttaccgccgacggtccctgagtaattagcgcaagtaatattcttgggaatctgacggttgggagacttccattccacaggagcagtcgtcgtgctgattgaacaattcgcaaaaacataataacagtacgcggcaagtagtaccatcaatctccacgctctaagcatcataacgatactctttcagccttacgatcaaaatattgcactagtggtgacgataaacgatgcaaaaacaaaaaaaaaggacgtgctacaatccgagtcacttttaccgtacccagacaacggtgctttatagactcatcacttaaggcgggatgtatttgcaagtcagcaaagacgacagttttttcgccgagagaaccagcggctgcatcacaaggccggcatctgattccctgtgcctatttcactcctcatttatacatatccagacctcatgtgatacgaggatcatcttacggggaaaaacccttgtcttatccagtgattgggtcccatatcatcccctgagaattcctcactatcccccggaccagagccgaacgattccaaaccggatacgctacatacctgccacagtgggcagcttttaccatgccagaaaactcggtcgcgatccttatagtcaaagatgacgacgacgcatacccgtcgttcggcaccctacccgcttcgcacgctcagtacggctttcgactactacgcggcatatttttgattacgctcgtcatctggaccgtagtgtggctcaaactgcttcgagacgctcttttataaaaacatacgcagaaaacatttatgttccgtgatctcctgtggtaacatagcaacaggaacctgcactttccttgaattatgttctcataaactgtaccgtcctggagtacgctatgtatcacgcgtcttttcatggagcgcactgtatgccgacacacggagataacgaaggaaattccactcgcagatctgccttgtctggagatggggtaggaatacaacggcgtttaaagtaaagacagatgaggcacatggtgaaaataaagataatacatataagtagtttattacgatctttcatgacggagtggaaaagcggggttgtacaatttctgagagctacacaaagcacaaatttatcctgaatgaactagtgtgggtactttgtaatcacggtatgtgggtagcgttgtttctagttcgtagtttgcgtttcagggttgccggaacgttaaagtaagtcaaaacgcagattataattaccgtcaccacggcagctgtccaaccagcgtgaatagatatgtgggaattggtgtgtttagaatgacgtggagacaatacggtaataatataattggtgctgtttatggtagtagtacaattgtcaagatagtttagtatgtcatattcatcatagtcacttgtattacatggcaaatcgcattcatacacgtattccgtgtatgttcctgaatcgctagatgtaacgttattaagtctgagaccttttgtgtcgttaaaacatgtaaatcgcggagagcatgatttgttttcgtggtactgtttatgtatgtatccgttccatccacaaagttcgcaactgccgtagttccagaaactggaatagttgcagggattattactaccgttcaggtaaactgtatctccctgagttaccgtgatgggtctttctacatgttgactttgcgtaaaaaatcgccggtaaaatgttttttcttgttcatgtaaaagtaccggaactaaaatgctagttagaatggttgcagttgctattagcgcggctagtaacagtagtttagtgttacattgtatacccatgtttttaataactatgaatattctgcttcacaccataagtgcttaacccacaaaaaccacacggagacattattggctaaaaataaaaacaaaagtttattgatgtgcatgttaggttttagtctaaaattcatctgggtcgtatttgggaagttttgtataacgcggtcttctggggacgcgacggctacccatgtataaggctataagtgccacagataccactatacccgcccatacagcatgaattcccaggggaatgttagtgtttttttacagtttttattacattgtcccacgttctgctattatgctggtctgattcctcttttgttttacatttatcaggtataggagacgatgttgcagttcctgataacacggttaaatagtagttttcctttttaccgtcactgtaacgttgcaaaacgtattttccagcgtgttcggtagttacgttgtatatagtgagagaggtcttattgcagtctaaacacatgccgttcagtggggaagttgaataataatgtccaatgctgcacagttggtgtgcgcgaggtccatattttatccattctatatcgtgccatacatccgttctactgcagtttttcaaagtgacgtatccaccgacatatcctgttacattaattacttcgtaatttaaattagagtgtttataaacggtgtacaaactgccattgcaagttatgttgctggtattcaaccagggagtagtactatgaatggtagaaaacgttaatgttggcgtagcgcttgacgatgattttgaaagcgttgaagtggttgctgatgcgactgaagaagcggtagagggtttgtgcgtggttccatttgcgatagctgaagtgctgttagcatcggtgacagagttagaagaatttgtgatagtggaggcggtggaggtaaggcaattgcacggacaggagcacgtgtcattgcaaccttcagatatcgtaatcatcagtaacgtccacttaaccgtaaatctccagtccataacgttattaaatttcggttaacgggcattgatgtttcttcggacgttgttgatctttcttgcccgtttattttctgatatggtctcataagacatttatccggaaacgttgcttagtcctcgtgctcaggattgtatcgaactatgaattctgattcacttatatcgtcacttaatggatgatattttttatttagagctcgtcggacgaaaaataggagaatgcaggctacacaaattaatgctaacgtccacgtagtgcgtctgccgtgtgatgtgttagaatgattgttatagcggtataaatgatctatagatgatgtggctgtattgtcttcataattggtcggtttatgagaagtgtcccattcgtgctttggttcttcacatacccagggattcacgtgtgtcccgtttgtgttgtttctaggatgtatttgcagattaaagttttgattttgttcggagggatgcccagttttataacatcgaaagctatatttaccagaatgagtaaaattaagaccgtacagagataaagataaattacgatcgcatgtaaaacataaatcatagtgatgttttagataatttgtgtgccactcacatagtatacgcgaatggaggattttcaatgaatggttatgatattttccatttcttatgttgggatgggtgtattttccgtgtgtggatatattaaaatgtctaagccaggctgttttgtagcacgatgtgatggttaggttgtgtgttatagtaatattgtctccttgtgccgcctccaataatgtttcagattcttttgatatcgtattatttgtactgttaggcgatgagcaagttggaagcggtgtagtgacgttttcatttgcatttatcatagtagtagtgttggttgataatgatatagtttgcaaagtcacagtactatcggttacatgctgtgtcgatgaattcgtgtcgccgtttggtgaagttgttattacagttacgttagttgtagatgtttgggtagatatggtggaaatagttgaggtcacgtctgtgccttttacagagcttgcagtgaatcctgtggatgtgttgacgttgccattggaggatgtgaacatagtggtagacatttcggtggtttgtaacgtagatgtcagttgtgtagtagatattaagcttgtgggtgtaatcgacgtggaagtattggcgatagtggtgttgttacacttgcttttctgcagaatccaaaaaataataaacatgcatattatttgcgtatatgatgacttgttccaccgtcgatgttgtgtgcgcatcttttactccaaatccccgtccaccgtcaacaacagaggttccgtatctaggtccgtccgcaaccgttcagcgtcctgttccccgattcgttgcgaccgcagaaagcagatgaccagtgcgccaacaaagatcatcagtcccgaaacccaggcgcaatggagtgagaggccggaccactggcgttttaaatccgagataattgctcggtctgcctcttgggaatccgtaaccacaactctccctggtcccggataaaagcatcgacgcgtttccaaagctcggcagaagctacgtgggtggatgatgaggtaaaaagcctcgacatcaccggtatactgatcctgcaggaggtagactcccgtatctttaaccgtaagattgtacagcgtgagattttggcgcgtgcacgtgaaagttgcgccaccctgatgcgtggtttctttataggcgtctgtaatgatgcaaagtggcggcatacgacgcatgtatctgctgtagatatcataacgttgccagactacgctgtgatggctagtgttaagcctggtaaccagagtacgtgtacggtcctcgcaggtggcgcggtaattggcgagctttaggggttttttggttggttcgacggcgttcgatgaacttccctgagttgtgaacaaaaacagcgacgtgactatgacaagcgtgaggggggtgctgtaggtctgcatggtgcaaaacacgttctcgccttccttgtcagacgtcgtcgtcctcgtcctcttcgtcgtctgtgcccgtcggttcgatcaacggggagttatctttctgtctggagggtcggtatggaatccgttcgtagatgttctgctttttagccgcgtgttgttccagctttttgcgtgtcaggctccgataggccagacattgatctacctcggtgcccgtgttgtttttctcctcctcgcgcgcgtaaattacgaagaagaccaccagcaggactatcagcgtggccacgaacgagcccgcgccccaggccgagtatgcgcctagcattgtaatgggttctgtgacccggcatttgcacatcgcgtggcacttgctgccattggtagatgtgctattcggattgcacttacatgttaggtgggtattttctgttttcacgagacaattggtggtaaccgtattttcggcgcaaacggccacgtagcttatcaaaccgagtgctaaaaagcacaccgcgtgcattacacgcggatacatattaaaacaccgtgttccacaagcaccgcacacgtcgatcctccccgcacggtcttcagcccgcccatgacatgatctccctcacgttacccttcaacactctgtagtactctgtctcggcttccggtccccatgtcctaatcataacaaaacaccgtgtcactgtccatctccctgtcttttcgcgccgccggtcccccccaaaccatgtctctagatgccgccagccaccaaccggcggcacggcggctcttggattcggcattggtgcgccgcgtcttggcctgcatgatcatcgtcatcatgatcgccattagcatctggatcctgacctacgtgctgtttttctaataagaaccccggcccctgacggtaattttcctttcttctccgtttctcctcagctgccgtacgtgatgcctcacggccatctccgacaggccctctccccgacctcctggacatgtgagggcttgttgctcctcctgggattgctggtgctcttctttcaccaccacaaccagtcggccgtagagaggcgtcgccgcgtctcgttcgtcgaggtcgatcgactgccgcatgagagcggatggtattcttccgatgacgacggagaccgggatggcgatgaggaaactggagagagccacaacagaaacagcgtgggactgtccgctgtttttagctgagactggcgtgcgacctgtaaaccgttactcgggtctcaagatggtttggaagttgtgactcatcttcctgtgggcaatgcccaaccggacgcgagtgtcccataaaagccgggcgctccggcgagaccatgccatcctcgccttcggacgccccgctcctcttctctctcctctcctccccgctgccgcggccactgccgccgccgcccataccatcggcatgtcggccgacaaatcgcagctgtcgtcgtcgccgccgcagctgtagcagttaacgtcgccggccttcaggaggagatggcgctctgcgtcgtctcttcgtcccgcctccctctgtggtcgtgggtggtgcgagagtacacgatgggtggctctcgtctcgggggaccacagggggaggggggtaatttattattcgtattactgtaattttgtatcgcttaatttgtttagagccgcacgcttgacaacgccttgtatagccttatttatcccgatgacttttttctccgtacaagaaatggacgtcacttgagcagacacagtttcatcgaccacgacagtctcatgatctgactacctctgacccgccaatgagaaaaccgaaaagtaaaagatgaccgcgccctcggagtccttttttccttttcaatcatgaaagcaagaggcagccgagagaatgccagtaagagacgaccatcgcagacacagtacgatactcatcttagaacgaaccagcgaataaccatcacacgtacagcagaatctcatgaactagtcaaccaacgtcataaaatcttcacacaatcgtttttgcgaacttttaggaaccagcaagtcaacaaaagactaacaaagaaaaaccatcttggaattaaaaaaagtagcatcgttaccttatgaaccagcagcattcagtatatacaccagatataatatatttattaatgtatcctctctttctcctgatgtaattttgtttttgtaaattcaattgttgaaagtctctccctgggggaattgcatatcttattgatgaagaagaaatccctgccatatgtgttgtcaaactatcattatttctctatatgggtattttttttctaagaagcaaaagactagcagcagccaaaataaacctgatgaaatctttaactgaactcccagtggtctgtgtgtatatttctgttggtggtcggttgtctgaacccgggtgggttgttcggaaacggcgggacggggaaacggatggaaacagcgtcgctatatacgtgacttttgatctaaacggacgtcgctaggctgacagtttacgaattgctaaacaagatagtcaggaacaaaacaagcggggctttgcctggtaggatttcctgtggaaacaataaccggatgtgattgtggctggtacataagctggttctggctgcaagcgcttttcactgcattaggtttggcgtttgcttttgcctgggaacgctatggctataacgggaaagaaccggtttggcaacattccattgtggggggggggtacttatagcgtgcctagctatgacgttgatatatgtggatgcggataatactcgtaatgagctaaaagcgacgactggtagtaattttaccattacgcataggaaagatccgttgacaactaagtggaaaaccgtttttggtaacaatggtgatcagtggttgtgcaacgttacgggtataggtaatgctactgtgaatagtaacgcaactatttgtgtgtcgagctgtggtcataatacgttggatttatgtaatttaaagtcgggagattctggcttcttcgatctgtctcgttggttcggtgaaaacatggatgaatacagtggtgatgtgtggcacttggaagtcagctaaatgttgtatcgcttagtgaattggtgttcttacagttttcatgtaataaactacgtgtaattcgttaaatttgtgtgtttttttgttagtattctgcgtaacggtggaataaaattgcgttgacctagttagatttcctgtgtagaacaatgaccggacgtgcttggactggtacatacgcaggggctggacgtggttaccggtcactggactcggtttcgctgtagctgtggttcaacctgaacatggctcccagagctgctaggaaccggtccagtcacattttttggtgggtggggggtactaaaaaagtatttaatattggggtttaatgataaaatccaggttatggatatgaggaaactgaatacctcgcagggtcgaaatcttaccacagttgatgatagaagacggttttccatcgggtgggaaacatgggatgacggtggagagtctctatacgatgtgactaataatggtacaacggtcatcaatacaacagcctgtgtttcaagttgttcgcatacgtcgcttgtgctttgcaatatgacgcagcagactgattcgttgtacggagtgggtcatcggttgaatgacgaagaagatggtgaactgtggagagtttcggtttcttaataatcccatacgacgtgtgttcatttatatctgaattttaggatgatgactatagtataactctggggaacaaatatcatacgttaatcactttaagttacgccgttaggaaaagaaaatcagtccgaatgaagcatagtcagccgaatgatacagcaatagcttgtttacaacgtgttcttttttacattatgaacgtgccttgctttttatacacacatggagacagaggtccctcagcccttgtcacgacaactccctttttctaaaccgtatgtgctccaaaccgcatctcctcatcgtcacgtgaaataccatgggaccccttttcgtcacacacgtctttccgcttactcaacgcgtcagcccgcgctcggcagagctaccatataaaaacgcaggggtttagcggcttccccagatcgctgctgccccggcgttctccagaagccccggcgggcgaatcggccggctggtcggtcggcgctcggacggatggggagaacggcggtgacttagccgcccgtggccgggagaagacggaggagccgagatgacaacagcagtcgtggaagggtcgccaagccccggtccttctcttctgtctggtcgaatctcgttttcttttttcaaccgctctttttgtcacctttttatgtgagtttctcttccgcgtctcccggccgtaccatccacccatgcagcatgcacgcgtgtatgtatgcatcgtctctcctccgtcccgactaccatcagcagcaccactaccgccacccccagcgccaccaccgctgccgtcgccaccgcgttatccgttccccgtaggctggtcctggggaacgggtcggcggccggtcggcttctgtttttttttttttttattttttatcttctcctttccttaatctcggattatcatttccctctcctacctaccacgaatcgcagatgataaacaagagggtaaaaagaaaaaagctacagacatttgggtacctcagctttccgataactcgaagaattcaaagtcgacgattcccaacaagagaaaacagaacaaaaacaaggtcatttttatttatcctcatcgtcaacaacaactaccgacaacaacgaaacaccaccaagaatgtcaatccgcaagggtgttcctgccccctcgacgcgcctgtcgcgatcctcgtggcgaggaccgcgatctccgtataggtagatgaaattatcccgtgtccggtcctgattccccgcatgccctgcacatcctgacgcgtcggtcagcagccaaacaatcataggaaatgaaccagaagaacaaaaagatcatctctctcggtgtatagcaacaccaacaacaaccgcatcgcaacatcttcatccgcaagacggaaagaaaacaacaataatgagaatgaaatcaccacaaccaagccagatttcacgtccatgagtttttattatattattatcaaaacgaaaaacagaaaaactgtcatagataaatataaaaaaaaatagaaaccacaaacgactactagtactccaatcttagatgtatatgctcctagataagatttagtattaccataatcatcgaagaatgaaagacgacgatgattccttaccgctcctgccacccggtctgtatgtagagagagaagagagaaaacggtgaatccaagatccccgggtcggcgtcggcatgccgctgatcgcagtggccccacctcggcatgccggcgccgggcgaggaattgctcatgaaaaaagtatctttctgtaaaaaaagaaaacaatacatgattaaccgaaaagaaaccaacaaaaagaacccgagatcagtcgatttcgatcactacgataaacacatggaagatttcttgaaaaaagaaaagagaaagagaccaccttcccggcggcggacacgctcctctccgtcgccgttctgcaccatgattcgatcaataacaacatcatcatcggagaccatcttttaatcaatcagcgttgcagtagtcgactccctggacacgaaggagtcatccatttttatcctcgcacttcttcgctctcaaagccgcctttaaagttgaaatgaaaggatggaaacatggaatacagttttaattgcacgtatcaccattttactacaaaaagaaaaaaaaacaacttacacatagtattaccttaggtttacggataagtagagtgtaggcgtttttgaaacagttcagccaatgcaatcttgtctcggcataatcactctttctgcatataatagtagtagtagatttattcacatcaacacagcgaaaaactccagcatcaaagtacacctagagacagcccttaaaatatagtttgcagcttttagatgtacttacaccaaagaagattaccgtccttacgagaaaacagatactcggatataggaatcaagacagctctgcactgaaaacacactctcctgtcacgacaccgcgccacaccagaggcgtacgcgtgacttcatcgcaacgatccatcgtgatgtccctcgcagaacctaaaaagaccaaaaaaaaatcttggaccacagttgtcgattcttgaagacaatattctcgtgagaactttgagattcgcacttgaaacctcttaggatccacaaaaacaacaacctctgtatggaaaatgcgctattttatctcagcttttctcccaaacctcggtttcttcctattcttatgttttccctagtatatttgcctccttataagaaaagaagcacaagctcggtcgcacggattattccttctgctaatctattattttgttccttttttttttctttgccttcacccccttcactccctgtagcaacacagagtagtagacacaataaatgagaagtttgcatgcattttttgccgtgtccgtggtctgttatagcgtgtggagtgctcgggatgggtggacgtggggacggattcctgaggctacaaagatacgcggagacgtcgtggcgaggggatgggtttattggatatcggtgaagcagcgtggcggcgaaagacgcgatccctgggctggtagatccccctaccacgtctaccagggacgtttatccttgggacacgtaaatgtctcggccggcatccacgcgccacgttcaccgcgtcgtgcccagcgccatgtgcgggtcgtttcggcgtgaagttggacggcgtagtttcggggattgtgaaccgtggctgagggtgtagaagggacaggaaagagcgtgtgatctggccgagccgtagcatgtgggtgcgatgcggtggatgtggtgggctggggtggttttgggcgtggagatgtggagatgggggtgatccggatgcgtggcaataggcctcgagcttgggcttctcccgcggatggtcgttctaattgtacacggcggccgtggcctccgagtaaaaaaaccaggtgctgacgccagacagagacgccgtcctcggaatcgtgtgcgcgaaagcctgttccgcggcagcgtacgacgttccagtcagcgaggccgtcgcgttggcgcgccaacagtaaggttacgacaggttggcggcccatggttccgaagcgtccccacatgcaccagcagtcggcgtcgaagtcgcttgcgctgtcggcccagtcgccaccgccgcggcggatttccgcgcgtgggacggggtagccgagcgctgcgccctcgccaatgttgtgaagtagatgcgtgagttgatgttgattctctgtgcaaaaatgagcgctttcctgtgggttggcgttggggtatgtgtgtagttggggttgtgtttgaccgtagaggtgttggcgggcctgtgcgcaagcagcgtagtccgcggcgtcaagctccatgtgcgtgcggtgttcttcgtcggcgtgtttgtccgaggtttggacatgcggttgtgtgttgctgtggtgtaagggtaaggtgtgttggtcctctgggtgaagcggcgtggtgtgggtgctgtttgtgtctgtggttggcatgattgtgcggcatgtgtgtgtggtagtgggtggaggttaaataggcgagctgcgtgtgcgtgccgtctgtgttccccgccgcgaaaggcccccgtccccggcgccacccccgtccccgtgtccgccgcgaaaggcccccgtccccgccgcaaacgccccgtccctgccgcaaaaggcccctgtctccgacgtcaccccgtgtctccggcgccacctccgtccccggtcccgcaacgcgccgtccccaccaccgtccccgccgcaaaaggcccccgtgcccggccccgcacacccacgcacaccccccgttcccggcgcaacccccgtccccgtccccagcgtaactcccgttaccagcgccgtcaaccccagtacgcccgaaaacaccgccgtccccgccccgaaaagcgaagcgccgcgcaaaagcttagtagaaactccgtgcaaacacccgccgcgaaagccctccgagcgcccgcaacaccccgtccccagcgccggcccgtgaacaaacaccgcagaactccttgacgcaccggcagcgcgcaggaagcgccgtggggaacacgccgcagaagcggcggcgcgcttacggcgccaagaagtcgcactggcggcggtcggggtgtgtctggggcgcggctgggtgggtgcgtgcgtggggtgggtgtcgggtgtgccgggtgtgtcagggcgtgtgccgggtgtgtcagggtgtgtcgcgggcgtgtggcgggtgtgtcgggggtgtgctggcggggtgtgtcaggggtgcggtgtgcgcggctggatggaagcagtgtgccacggggtccgcgacccccccccctcccctgggcgaccgcctctgcgtgtgtcctcgacgcgggttgtgccgtacttcgtctgtcgttgccctcgcggtcccctagggacttcctcttttccgcgtcttgtctctggccgttgtttttcgtgtgtccccagggacccgcgctgccgtcccctgggaactccctcttttccccggggaatcagacagacacagacacgcgtcttctttgcgacgtgcgccgcgcacgtcgcttttattcgccgtcgccgtcctccgcaccacacgcaactattcgccgtccacacacgcaactccaattttcacccccccgcaaaaaacacccccccgcccctcggggactgcatgttccacatgtacgcgctagacgtgtaatccactcgcagttcggggacgcaacgcagccagatcacatccccttgcagtaccagacgcagggctagttctagagcggccgccacggcgatatcggatccagacatgataagatacattgatgagtttggacaaaccacaactagaatgcagtgaaaaaaatgctttatttgtgaaatttgtgatgctattgctttatttgtaaccattataagctgcaataaacaagttaaagcggggtttgaacagggtttcgctcaggtttgcctgtgtcatggatgcagcctccagaatacttactggaaactattgtaacccgcctgaagttaaaaagaacaacgcccggcagtgccaggcgttgaaaagattagcgaccggagattggcgggacgaatacgacgcccatatcccacggctgttcaatccaggtatcttgcgggatatcaacaacatagtcatcaaccagcggacgaccagccggttttgcgaagatggtgacaaagtgcgcttttggatacatttcacgaatcgcaaccgcagtaccaccggtatccaccaggtcatcaataacgatgaagccttcgccatcgccttctgcgcgtttcagcactttaagctcgcgctggttgtcgtgatcgtagctggaaatacaaacggtatcgacatgacgaatacccagttcacgcgccagtaacgcacccggtaccagaccgccacggcttacggcaataatgcctttccattgttcagaaggcatcagtcggcttgcgagtttacgtgcatggatctgcaacatgtcccaggtgacgatgtatttttcgctcatgtgaagtgtcccagcctgtttatctacggcttaaaaagtgttcgaggggaaaataggttgcgcgagattatagagatccgcgtcaccttaatatgcgaagtggacctgggaccgcgccgccccgactgcatctgcgtgttcgaattcgccaatgacaagacgctgggcggggtttgtgtcatcatagaactaaagacatgcaaatatatttcttccggggacaccgccagcaaacgcgagcaacgggccacggggatgaagcagctgcgccactccctgaagctcctgcagaagcttcgaattcgagctcccgggtaccatggcatgcatcgatagatcgcagccttaattaaggatgcatgtttaaac

SEQ ID NO: 9 - DNA, 233739 bp, Human cytomegalovirus
catgctgtggtaccaggatacatcgcgggaaaagagtcgctggcgaaactcggccagcagacagtgcagttcttgccgaaacttggtgcccacgaagacgtacagcagcggattgagacaacagtgacaaaaggcgagcgactcggtcaagatgagcgcacgtttgagagatctttcgaactcgcagctgctggagatccatttgaggagttttaacgtgtccacaaacagcgttaggtggtacggcagccaaaagatgataaagacaagcacgaccgctataagtacccgtacaatgcgacctttgtggcgcgactgagacaccgcaacgattctggaaatgcggtagtagcagtagctgataacactgagcgggatcacgaaagcaccgagcatgagttctacgttgaggatgatcgggtaactgacctctaagtagtcgtagtcggtcatacattgattgttttttttggtcaccaccataaagtgtggaatggcgatgatcacggcaaagatccaccaaaaaatactgaaaaggcaggcctgttttacaggccgatatctcatgtaaacaatagcgtagtagcgatcgagtgcaatctccgtgataaaacacaaactggcaaacatagccacgtagaaacaggcagtgagtaacgtacacggcacgctggctagggagttgtgatctaggaggtattgcatccacagaggtagtgtacaaacgaaaagcaaatcggcggccgcgaggttgataaagtaaacatcgccggagcattgaatccgacgtcgccaggtgatggtgaagatcaccaagaagttgccgatggaaccgaagagaaagacaacgccgtacagaaacaacgtaactggctttgactgattaagcacgtcggtgaaaacacaaggagtcgcgtcttcatcgtagtcaaactccgtcgtgagttccgcggtcgtcgtcgtcggtgtcatgatagcaccagttctgccctcggtgcatggacgccgtctggtccacgcaccgagagactgaggcagcgtccggtttggtctatatgagcggttcaccacgtcggcgagatgacgttttcacaccaacctcttcgagccgacgtgaccacgaagaaacgtgcaattagcaaaaatagatgtgcggcggacgcgtgagagaggatcgaattacaacagaaattcctcctccccggactccataggtgcattttttctgtcataatgggtacgtttggtgtgtttggcccttctttgtatgtccttttgtagctcaatatcaatgtcctggtaaggtatctcctgcttcacgcagcaacaggcgaatacccttagggttgtccacatgtccttcctcatttgagtgcctactaggatgtagatcccaggattcagacaagcgcgaacgtaggccaaaaactgaccgacgtatagacagaagataataacgttttgaagtgtgtcattgtacactcccgccagaagacggatggattctaaaaatagcgccaggttgaaaggaaaccaaaagctggcaaaagacacaaccacaaccaaaagaacgtggagcgtctgcatgtgccatttaccaacgtagttaatgataaaccgcaccatacggttgtacgtgtacgccatcagcgcgatgggcgccaggtagccgcaaatgttaactttggtgttcaaaaacacggggaaccaacccgacgtctcgttagcgaattcaccaacacactcgttgttggtatggctgtacatcaggtaatgtggcatccccatgagcacggctagtatccaaaaaatcaccacccaacaggtggcccgcttgttatttcgcacgcggttcaattctacaccccaaacgatgacgcagtagcgatccatcgacaggttgatgagaaaacaaacgccggcaaaaagacagatgtagaaacaagcgttgagtcccgaacaaaccacctctcggctgagtttagggtgatgcttggcatattctagaaaaaacggcaggccgacgacaatcaacagatcggctacagccaggttgcagatgtaggtatcgctcggagattttttcttacgacggtagtacaggatggtggtaatcaccagcacgttcagaaacgtgcccacgatgcacatcaaccatacccccaaccgagtgtactcgaacaactgataaatttcggtgctgtttaaggtgtggtttgtcatgttgctcacctgcgttaaggtttgattatttgtagaggtggtcatcaccttacaggtactatcacctgtcgaacagtcctgtaaaaagcattacacgttagtcgtctaagcacccagattcctcacatacagtttcaccgtcccttggcttacctggtgtaagtgtcaatcacaaaacccacgtctagacctcacggtactttttatgtcctaaagccacgtgctattctgacgcactttgcggtcgcacatgttccaaattacgtgagtctttgacgtcgatgtcagtcttttcgggtggtttacagaccggagctgccaaccgcagcccacgaacgacgtgaacaagccacgtcactgaagaaactccataaaataggctgccaagtgccgctccacgccgcggcaccatgcgccagtcctatcgctacgcgtctggggccgttgttcggaggaccctcaagggtttacgaaagctcattctctgccaagacttgcggcaggacatccgccacttagttcgtagctatgctgatatgaacattagccttcccatttcagcgccacccggatggcgtctagattttgtagagtttgaggacatctttggcagcgcggctgtcaccgacgggcccgaaacgccctggggtcagctcatctgctgcgaagaatcgctcgagtctctgggcgtcctgcagttctctaccaccgtgttgcccagagtacacgggccgcggtcctcttctgaggacgaggactcggacgatgacgactttttcgtgtatgtagaggaaattgagccacctagccaggcccgtctggtgctcctgttaggacgttacgaaaccgtgtggtgtctagaccgcgatcgcggggtgctttactacctggcgcacagtttggacgattttgcgcgacacgggctgttgcactgcgaggccatctacggcgagcaaatgcgcacgccgctgctaaccacgcaaccggatcatattatctgcgaccttcgcctgcacgacaacagcatcagcgaactacagcgtgtgacctgtcgttatcgcggcgaatgcgtgcctctgcgcactccgggcgagatgacacgtccgctactgctctgcggccaggccgagaacctcaaaggcgtctggcccttcatctgtatggagacggagcaattcaacgacctgttgaagttctttgtggaccgcttatgctgtgaaaccatgataatgggtgtggtgggcgaatcgctaccctccggcgtctttcacgccgatttcgtgatcctggtcgaccgagcctgcgaatttttctattttgacgtgtctcgccgcgagatctggcggttggctgacagcgtggatatgttgttaacagtgggtctgctcaaaatttaccaggccggccggcgttttcactacgccgtggacgacgccgaacgtctggaagtgccgggtcgctgcccccacgaaaactttcccttctgggaccgctttgggaccgtggagcgtgtacgggcctctacacgccatcacgaactacgttataaatggttaatccgcaaggacaggtttatcgtccgacccgactggtgctctatgcgtaacagtctggacgaagtctccggcaccgccgatgtcagttgggatccgcggatccgacccgactatccacaaacctccgatctggagtgtgccaaacaatattggcaagagctcaacgatcatgtacgcgaacaaacagcccgctacgggcccgtgcggcgttacagcgtctggtgcggcatgagctctcgcctggaacgggcggttaaacgtctacaacagcggattccccgtcagaacctgatgaatcccagcctgatgaaccaaggactatgcgtctactactcggacgaagaagaggatcaagaggaagacgacacgtccgacgatgacgaccaagaaaaggaaaccgaaaatccacaaaacaacattggaagcctcactaggactccctcctccccaggatccctggagggcgtcgaggaacgcatgctgaacgtgatgaaagaggccgtcgcggaacaagataggaaaaagacacagaagaaacacaagatagacacggcgcaacgccgggtgctcacccgccgggcggcccgggccgccgtgctggagggccgccccacgcccaaacctaccatgcctcatcctgtttcttacttgcccttttggatgtaaaaacaacatcaacagtttacgagtacaaaacaggaaaggaatacaaataaaaaaagacgccgtgacactttggctctttcctgtgcaccgtcatcggcacgtgctcttttttgaaatccgagaggtagccaacagcagggagccagatggcgacggacgtcgggaccgacggacgcgactcggggtccttcggttagcggtctgttcaggtggatgagggctcttcacggtcgggcactcggctgtgcctgtcatccacttggagagctcccgcggtccgattggccctccacaggcgcgttggacggggcgtcggagagtataaactggggcgggcgcggggtggcgaagcgggaagcgctgatgtacctgcagctcgaacgtctctccggtaactatcggcggccggggctgtgaaccgctcagtggctcggaccgccggctgtttctgcgcaccggtccgaacgctaggtcggttctcagaccgaggcaaatcaacgtcgcgaacgacggtgaaaaatcggagcactttccgcggcgcttgggagcggggtgacggtgtagcgttgctttctctgtatttggctcggcttctgtcagtgacgccggttgtccggctgagagtgtcgctcaatgatggatccggctgcgggttctggccctgacggcgctgcagttatgccgccggagctccccgcgctgcctgtggcggccgaggatcccatggcgttataccgacaagtgttgcgggattttaaggaactgttcttttgcctggagccaatggaaatcacgcgttacgttcatcgtaacgagggacgctgtctgtccttgggtccccccaagggctggcatgtgatgttacgtacggaggacgggatcattaccgccgccaaacaggcggcgtcaaagctcatctgttgccgcgagccgttgacgccgttgggatacgctgttattttgttgcccgagccacgtcgcgatcaccatgatggcatggtggctactccgtacgtggtttttatgggtcgcttttctcgcgtctacgcctacgacactcgtgaaaagtacatggtgttggtatcgcacaacctggacgaactggcacgttacggtgtgtcacgttcggagattgcgtatcgcgacgtgattcacaccactctgcggagaatgacggtacccgttccgcgacgatatcctaagggcgcgcgtaccatgcatgttttgtttctcaatgacaccacgcccgagggctcgtacgccacggccgaacgaatcctgggttgcgacgtaaagttgcatacaccgggttacggtacggtgattatgcggttgatgaaaacggtacagcagttacaccgcatttggcccttttgtgcgctcaccgaggtggagagccgtcgttggtggtgggctgtccgtgctaatctggccacgccgtggtatgtgctaggcgtgacgggacgtccgcgaccgggacgcagttttgtggccgaagtgctggtactgctggactggttcggtgccgtgtacgccatccagatggacgaccccaaccactatgtgcggcgcgttgccaacaccatcacggagtttttccgcatggggttgctgaaaatggtctttcgacaccggcgttttgagcgcgagcgtcaacgtcagacgcgtatggaacaccgtcacctgtgcccgcaccaccacgagcgtgccgtagaccacaagcgggacattctcttcaacgaagacgccgcgttgcccgatgagcgacgcgagcgcgagcggcgtattctgcagcagcagtatgactggctctgtttaacggagcgttttgacccgcacgagggcgcgtgggagcgtctggaccccaacacgttggtgctacaccgctacgacaccaactcgcagagctacgtgttggatcccgacattgtcggtgtggaagcagccgagcgcgaggccgctggtcatcaggacgatacgggcccgcggctgcattgcctggtgacgacgcgttcgtcgacgcgcgagggcgcggagcgggtgattaccgccctggtgcatcagtcgcggttagtgacgtactcggacccttttcccttaaagagcctgacgggtgtgcgcgagtacatccagatttgaacgtcgagcggaggacgcagaataaaacgtgtcgcacaaagaagtctctttctctgcttcttttctggggtgtctagctggcggcctcttttgacatgtggcgtacacgttgggaagacggagctcccacgtttacgcgaaacgatgaattcctctattgccacacgcgctacgaaacttttctgcgggtcatgggcgactttcagggcatcttcgagtgccagtacagcgccgacgtgcttcgcgactgggtccgtaaccacgtcgaccaggtgctgtcgctcggcattccgcacaactggttcctgcaggtacggcccggcagcaccatgccggagctacgcgaccagctgctggacgacgtgatttattgccccgaacgccttatcgtgctaggcaagtgcgtgatcatggtggaagatcactacgaagagacggagctggtgctctgcatgggtggcggtacgcgcctctacatctacgaaccctcgcaagagattctgctgctgtgcgcgcgtcatctggacgagctggcgcgttacggtatgatgtacaccgaagccgtataccgtcagccacagacgccatttgctacgcgggtaccgcacgacgtggtagcgatgctgctgcgtcacggtcatgacgccgacgcgttggccgcctgcgttggcgaacaccacggacgcgacgtgaactttcatacacctggacgccatgccaaaacgttgaaactcctgaccagtttcggctgcttgacggactgctggcccttcgaggtagcgccagccgcccgcttggccgagtgcgaaatgtacgtcacgctgcaactgcgttgccgctggtacctgctgggtgccgtgggctcttaccgcgccggtggtttttttgacacgtccttcctcatcatcttcgaccgtttctgtcgtttttacgtggtgattgtcaagtcgcatctggaccgctcgccgcccctgcagcgtctagccggtgaaatctaccggctggccgacagcctagaggaactttttcgcgccggcctcatgaaggtgtacgtgcgtcgccgctacgaacacggtctacggcgcgcggccaggctggaacgcaacggaggctgcgtacacatgggcgaggcggcgcgtctgcactttaccatgttcgacagcggcgtagaccgcgactacgcgcggcagtttcgctggctctgtcgaggcgaccgttttcgcgccgaaatgctcaataactgggacggttgggacgcgtttaccatttggcaggcgcgcgtggtccgcggcgacttcgcggaacgtcgtcgaccgcgttccttgggagacggtgaagaggaagacgaaggaaacgacggccgcgccatgccggtcgtccgccgtcggccgccgcccatgccacgcgacgacgacgaagataaccacgtcgtacccgacaatcagaacctggaggtaatccacgacgccttggcggacgatgaggagcagggagaggatgatgacgacagcggcgcagaacctatggaacccgaagaaaacaacgtggtacccaacgttgaaagaagaggaggggaagacgcggttgccgcgcgtatggccgccggccacgagagcgatgacgacgagtgggaagacctaggctttgaccttgaggaggacactgtctttgacctcaaggacgtagacgaatggtttgagcaacggcgtttggcagagaaagagcgttggcacctgggtcagcgtattgttaacgcctaccggacggaggccgaggtttcggaagccgaagtggaagctcgacgcatcaatctgaatacggatttgtctccggagtgggtcaagagtttcgattttcgggagcactttgtgtaggcggcgcgtcccaccccccgggccaccagccgcgattcgtctgacgctgctcctatattaagctttcgcgcagcgcgctttatccgactcgctgtcgagacggctccgccggcatgtccctactcaccaaagccgccgccgaagcctggggcacctatctccgacagcgcgacgagcgctgcgaagatgctatccgctgcgactacggcgtttttcaatttagaaacaccgtctttcaaaagacgttatcgatgctgcaaggcctctatctgcgccagtacgatcctccggcgctgagaacctacgtgcaacgccaccaaggaaccaccgtagcactgcgcaaccccgccaactggttcctagtgatgcgcgaacaggccgccatcccgcagatttacgcacgttctctggccgccgactatctctgctgcgatgacaccctggaagccgtcggtgtactagccgtgcgtccacccgacagcgatctaacacgaaacaccaagcaggcgcaggaactgccctgcgtgctcatgctaagtcattacggcaccgtctacgtctacgactgggagaccgacgggctctacgaggtggccagtgatatcaaagccttttccaagaacggcctactctggtgcgaatatgtgtatcggcacccacaaacgccgttcgccaccaccgaaccgcgctatcatgtgcaaaaattcctctgcaccgaccccactgacgctgcggccgtggccaagacggcccgcgaaatgagcggtctcaacctggtcatccgcacgccgggtcgcaccgaggtggagccgttgctcatgctgggctccatcgagggcctgcgcgcctgccggccttttgaccacatgccggccgcggactttcgcgatcttctgaactttattcgtcaacgcttgtgctgcgagtggtacgtcgtcggcctcgtgggctattacctggcctacgggccttttgtgcccagcggcctggtgctgctcgacaagtttggcgtggtctacctacacaagatcgaggactcggacctatatcgcattgccgataattttcacatgtttctcaagtgcggtctgcttaaactgcgtggtctctgccgcttcgaccgcggattgcgcggcgagtgtcggttggaggagctgcccgtctgtcaccacacgctgaaaagagacgtgctgcgctggcacggcgcactgggcaccatcacacgctcgcagctagagagcgctctggactggtttctgcgacctactcgcggcactgacaaggtacccaacaacagcagcgcatggggccgcacggacctactgcccacgggcgcgctgcaagacaaccagaactgggccttcccctctcacagcgtcgaaacgctgccggcgctacaggggggattatgggaggataacgatgaaaccacgcagaccgtggatggacaacgctgctttcgcatgcccaagttctttccgccgcccatgtgccgcgttccgtacaacgaatgcggcgtcgaattaccgggcggcgatagcagcgacgaggacgagagcggccgcccccggagaatcgccaaccgtataggcgatactccagaaaccccgtgtaatagcgaaaacgaggacgacacgacggtcgagggaacgagcggtgggcctgaagcgatggactcccaggctccctacccgtcggaagactcgccgaccacagagaaagaggcctggttacagcgcggccggcgagcaaaagccatgcacgcccgcggacacacgctgaaacaggtccccatccccgaacccgaccagatgggagacgacggaccagacccgggtccctaaaagcagattccctttccccgtttttattcatcataaacttatgattctgcacagataaatttttaataaaataataagccggcagctgctttctttttgcaaatcacgtgtgtgcgttttctagttcgcttcgtgtatttagacgaatctcggcgataaccgccggcgttgccgccatgtcgctccgcggtcaggtccagatagcccggtcggtcttcctgctgcgcatctacatccttatctgggtgcaatgcctcatccttatgagcgtctgcgccttttgctggctggtgttgccgcaccggttggagcagctcttttccagcgtgcgtctgacgctgtcttgcttaatgatctccatcgtgtgcctaggtctgttgcgttgggccgagcccaactttcccaaaaacgtatggatcttactgacgtacacgttgcttaccagcgtggctgtcacggcgtcaggcttccactttagtcatcgttcagtcatttatgccatggtggccacagtgacgctattttgtttcctcacgctcgctacgtatctgtttgcccgcgacgtggaattacagcgttccctattgacgggcgcatccacgctgattctcttactgttcgccgtattttctctttttcccgaggcggtaagtgagatcctggtgatgatagccggtttggccgtcatcgtgacctcggtggtgtgcgatacgcaggacatcctgcacgacatcgagtatgagagttatatcccgggcgcgctctgcttgtacatggacctcatgtacctctttgtctccgtgctctacttcatgccctccgagcccggcagcgcccacactgctcagacgacggtcgctgccacagcagcggcgtcgccccagttcgtctcctaatcgacgtgtccgcggcgtgaccacgtcaccgtgccccactcgctcgcttgtgtataagagaagggtaggtgcgccgcagcggctttgtgccgagaccgtcgccaccatgcaggcgcaggaggctaacgcgctgctgctctcccgcatggaggctctcgagtggttcaaaaagttcaccgtatggctgcgcgtgtacgccatcttcatctttcagctggctttcagcttcggcttgggaagcgttttttggttggggttcccacaaaaccgcaacttttgcgtcgagaactacagcttctttctcaccgtgctcgtgcccatcgtctgcatgttcatcacgtacacgttgggcaacgaacaccctagtaacgccacggtgcttttcatctatctgttggccaacagcctgacggcggccatcttccaaatgtgctctgaaagccgcgtactagtaggttcctacgtgatgaccctggcgttgtttatctcctttacggggctggcgtttctaggtggccgtgaccgacgtcgctggaaatgcatcagctgcgtctacgtggtaatgctgctttcgttcctcacgctcgctctgctaagcgacgccgattggctgcagaagatagtggtgacgttgtgcgccttctctatcagcttctttttgggtattctggcctacgacagtcttatggtcatctttttctgcccacctaaccaatgcatccgtcacgccgtctgtctctacctggacagcatggccatctttctcacgttgttgctcatgctctcgggtccccgttggattagtctttcggacggcgcgcctttggacaacgggactttgacagccgccagtacgacggggaagtcctaatgcctataaaaccgtgcccgttttcacagcagccgcgcttgtcgccatgcttcatgtcgtcccgctagaatggaccgtcgaggaggtagtcccctacctagagaggctggcggtatggctgcgcgcctccgtcctcgtcgccttccagcttaccgccaccgtcgccctcagcgtgctcagctggtggctcatgccgccaccggtggccgagctatgcgagcggggacgggacgacgacccaccgccgctttctcatctcagcctcgtcgtgcccgtcggctgcctgttcctgctgctacgcggtccgtcgatcgaccgttgtccccgcaaactcccactcctgttggcttactgcctgccgcacgcgctagcctttctgaccttgctgatgtgccagccgtcgccgcaggcctttgtcggcgcggctcttctcgccctggcggtagatctcagctgcctgggggcctcgcttttgggttgcgatcctggcgcgtctctccggcggctgtggctaccgtcggtcctgtctctgctctgcgctacggcgctgggactttggctgctgcgggccgcggccccgttctttctcggtttacacgcgacgacgctgttgacggtgacgctgatgctaattcacgatctgtccctgatcacctgtcagagttctttcccggagagttttcagccctcgctacgcctctatgtcgaaaatgtggctttattcatcggcatgtaccatcttctgaggctctggttgtggagcccatgacgacgggtcggatacagggtgccgccacggtttgaccacactcgtgacgtcaatcaaatccgcggtaaccgggtgctgataagacggactgtttcatcgacgcctaccttagaccgacagcggtcgtaagcggcagcatgggcgacaccgcctcggtttccgaacaccatgagtcgccgacggtcaccatcgtgccgctccatcgcagccacgcgctggtggccgaacagcagctcttccaatggttgaaacgctttaagctgctcatggaggtctatcacgggctcgtgtggcagctggcttgtaccctcacggtctgcttgctggcttggctcgccttccccgatgtgcagggacagtgcgccaacggcatagtgccagccctatcctccatcgtacccgtgtccacgctggctatgctacgcggtttcgccgagtttcgcccacacaccaccaattttgctcatctcacggtggcgtgcttgctgatcaacaccggcatcaccgtgtgcacgggcttttgcggagaaaggcgcgtcatcggtctgtcgtttgccctggtgatggtctttttcgttctctgcagcggtctcacctacctggccggcaacaatcccacgcgctggaaagtcatcgggattggctacggctggtccgtcatcgtcttttacctattgctttacttttcgcccgtgctgtgggtcagcaagatctacagcggactctacgtcctggtggtgaccgccgcttcggccgtgcttatttacgagaccctggatctcatctaccagcgtggaacgttgtctaaaaacagcgtctgtgtcagcgtcgtgttgtacaccatcgtcatgagtctcctaaacatgagcgtcgccatatttagcggccacgtctgggtgcagcagtacgccgagaaacacggcggacgcatcgacggcgtgagtctcctcagcttgttgtaaaaagatgggggagatgacacgctcccgctcgcttagacattccccaccttccctctagagacagacgatgaaccttccccacccagtagacagacaggacaccgcaactcggtgttgtactcgtgttttttattcaacaataaagctttttcacgcttactcgagtgttacgtgactttatgggggaacgccgtgtgggaatgacggtgattctattacactctataaacggtttctcatacgcgccttttgatcgccaccgccgtcatgtctccgaactcagaggccaccgggacggcctgggcgcccccacccccgcgaccctcgcgcggagtcattatgatttcctccgtgtcgacgaacgacgtacgtcgctttttactttgtatgcgggtctacagcaccgtggccgtgcagggcacctgcaccttcttgctctgtctgggcctggtgctggcttttccgcatcttaaaggcaccgtctttctctgttgcaccggctttatgccgcccttaagtttgatggtgcccaccatctgtttggccctgctgcacggcaaacgcgatgaaggatcgttcacgtcgccaccgagccctggcctgctcaccatttatagcgtgctcacgacgctttcggtgatcgtggccagcgcctgctcctcctctacgctagtgaccttctcgggcctcttggcttgcgtgctttttagcctctgcagctgcgtcacgggtctagccggccataatcaccgtcgatggcaggtcatcgtcacgctgtttgtgatcggcgttatcgcgttcttgatcgcactttacctgcagcccgtaccgttggggcacaaactttttttgggctattacgccatggcgctcagcttcatgctggtcgtcacggtctttgacaccacgcgcctgtttgagatcgcgtggtccgaggctgacctgctcaccttgtgtctctatgagaacctggtgtacctgtacctgctcattctcatcctcttcaccaccgaggactcattagacaaactcatcgcttggatgacctggttatcgtcacgcgccaccggggccaccaacgcggcctccatttcgggctgtgaccttttgcgggaggtacagagaaacctcacgcgaaccatggcgtaacggaaaaactcgtcgtttcccccacccgccgcgccggccgtctccaccaatcaagcctgttagaaccgcgggccgcccaaacatctaaaagtccccccacggatctcgcgtcttagacgcgcggtcatatagcctccggctgtcatgggtctgcgctttcccaccgcgacccagcgacagatcgtgtttcggcggctgttcgacagcggcaacaacgacgactatgatgaagcggccgtggtggccgtgctgggctgggtgcatcgcttcgaggttgtcgtccgaatcgccggcttgctcctcttccaaatctccgcggcggtggccgtcttgggtagcttctctctggtcttccctacagcgactctcaagtcgcgtccgggctttccttgtcacgttgtctgggcgcccgaggtgctcctcctggtgcctgtggcctccgcgctcttcgtgtatttccgctatgagcgaccggttctcgctcagcgaaaccggcacccgcgctgccgtcgtccgttccgacagctggtgctattactcgccggcctcctggcgcacatcccggcgctaggtgtcacgtgtgcctgccaggagccccgcgaggtgttgacgtcgtttgtgctcacgttggtcatcaccttgctctgcgcggaagtagtcttcatctgtcgcgacaactgcaccctgtccgatcaatttaccctcatcaacggcgtctgggtcgtggtctttctggtcaacgttctcatcgtcttcacgcggccctggacttggcccctgcggctgcttttgggcttctacagcacggtgggccttatcttcgccggtcacttttcgcagcaggtccttttcgtccgtcacgttcttatgccacgcgatgtggcgcatacgtcgctacagctctttattacgttcatttcccttttttttctgatcttgcgaatccgcaactgtcaggacctgctgagcgatctacgtctcttagaactaccgtcgtccgacgcgatgacgttaacgccgaacgacctgtcccatgcttcgtcgtcgacgccgttgtccaccctctcgccctagattttcgttcggaactggttttcggacagagcagccgtttccagagaacgcagcgcaccatgagaagagaaaaagggtttcaagtacccaccgatggcacggtcatctacgtgccccccgggatccaagagacccggctggcgacccgcagtctggcttgggtcgactgttgccgcgtggcgctgcacacctatggcgccgtgggttggcagctggccggcttgaccgcgttgttgagcgccttctgctacgcggcgcccgcgacgtggtttcaccattctcgtctgtgtctcacggagtcctcgcccagcctcgtctttgtcatacccgtcacgtcagtgatcttcattcactgttacgaaacatcgcatcccagcaatatcggcgttctgctcttttacacgctgcttcacgtgccgccgttgatcgtgatatgtctctgcctggacggtacgttggtcatctcggccgcgttgttcaccttactggcctttctcagctgcaccggcgtagcgttgttggctcccgaacgtaccgtccgccgtcagatcgtggtcgtccatgctttgatcacgttgaccttcacggcaatcgtggtggtcatcttgaggcgtggttggtcctggtgctttaagatcgtcttgtccttcagcgtgctcattacctgtctagccgtctcgcatttccacgaagcggccctggctgtacgctacgagacgccgctggaacgcgcgcttttggcggccgtcaaggtgtttctcagtctggttttcactctgctgatggtgctgagaatcatgaccctgcgcacctttttgcaaacctacttttcctctgacaagctgtagcttcgagaccttgcggatacgccgccgggcgctgcggtcccgacatggagacagtttccacgcagcgggaaaccgcgtcgtcggaaacggagcgtaccagggaagccgcgtccgcggaaacgacggacgctactttccgatccttggaagagggaagcacgatctcctcccggtattcggaaacagcgtccacagtttccgaagatgccgtgtgttggctacggcggaccgcgattgtcatgcgtgtctacggattgctgacgctggaaaccgctttcagcgtactcattagcgcgctggtttggctgggttacccctcgctgggctacaagtgcagcgacgatccctcgccgctattgcttagctgcacaccagtattggttctgggcgcgctggagctcaccgatcacagacaccccagcaacggcctggtgtttgcgctgtatgtggcgcttctctcgttcaccaccgccgggctcaacctgtgcgccacagcgcccatcggcatttctagcctcatcctaacgtggacgttgttcgtggcctgcaacggcgtggcttgggagcaccgtctcagctccgtgtggcgtgacgcgctttttacctccacacttttgacggtgatggtcagcgtcctggcttctacttacacctggttacataagactttgctgtgtctctacaccgtgttcgtgggctgcatcctggccgtccttttccaagacgtgcgctacatcgccaccaaaatgcccgtgagccacgtcatccgcagctcgctgatactttacgccaccgaaacactaatctatcacaccacactcctgatgctcacgcccgtggtgtggtcggcacgctgggaccaaatgttcagctacctggccaagctcggcacctatcatcattacctgattgacaacggcacgctcagcgtcatcctcaacaccaccactgcgacgttccagagcaaggctgcctgagctccgctggtttataagaagactccaccgagacgctcacccgttcactcgggcgcatcacccgcctcatggacccgccgctaccgtcgctacattcgccgcaatgggcttccctcctgcagctgcaccacggccttatgtggctgcgccgttttgctgtcctcgtccgggtctacgccctagtggtctttcacatcgccatcagtacggctttctgcggaatgatttggctgggtatccccgattcccacaacatatgtcaacatgaatcttcccctctgctgctggtttttgccccctcccttctctggtgtttggtcttgatacagggcgaaaggcaccccgacgacgtggtattgaccatgggctacgtaggcctcctctccgttaccacggttttctacacctggtgctccgacctgcccgccatcctcatcgactacacactggtcctcacgctgtggatagcttgcaccggcgctgtcatggttggggacagctttcgcgctaagcgttgggagctcatatgctcacgggtactcaccagcgtttttttcatcacgctctgggttatcggcgaccagaccgtgttccatcatcagcgtattctactctacggctacggcgccatcgtcttccttatgatgaccgtgactttctacggcacgcgttacatccgcgacgaactgccggctgctcagacgttacgcggctcgctgctgatctacgtaggactggtgaccatgtttaaaatcacgctgatcgtgctcagtcccaacctctggcgcctgccctggacgaccgtctttgccgccttcagatcctcgtattgcgaaggtggcggtggctcgtagccaccacccatcgtccccctttctctataaaacttgccgggtacctaaagcccccacgactgttcgtcgagcacccgtcatggtacagatccagtttcaccaaggcgagccactcggccataagaaagagaaacccccacccgtgtcgccgccgtcaccaccgccgatccgtcgagtcaccgtaatcaccaaagatgaagacaccctgcggagcgttcaacactttctctggatggtacgtctctacggcactgtcgtgttccagaccagcgccaccatagccactaccatccttttcatgctcataccgtggcgcgtgacggccccctacctgcgcgatacattgcccttctggagcacactgctaccctgcgctctgcgttgccacgcgtactggctggaacgtcggcgccgacccgggaccctgatgctggtcatggtatataccaccctcactacgatatccgtgtccaccatcgggctgtgtttcgatcgcaccgtggtaatccaggcctatgtcctgtcatccatgctctgcgtctggtgtacgggcctagcctggctcatggcctggaacatgcaacgacggttagccatcctctgtttgctaagcttcatgcttcccatactctggctcttcatcgccgtgcagtcctgggaaccataccaacgcatcattttagcactgactgtgagcttcatctacggcctcaagatcgtgcttatccgcgacacattaacggtgctttatcgctcaccgtcaaattgctacacggacggcgacctgctgcgcaccgctatgctgctatacatggaccaagtcattatgtttctgctcgtggtagtacccctgacggcccccatctggtatccaaactacgccggggccctaggccgcacggcacactggctttttcataaataaaaaaaaacgtttctatcacctaatctgtcgtactgtcctttgtcccccgcaccctaaaacaccgtgttctcccgacgtcactagatcaccaccctgttccccgtgacgtgcaagactacatgctataagacagccttacagcttttgagtctagacagggtaacagccttcccttgtaagacagaatgaaccttgtaatgcttattctagccctctgggccccggtcgcgggtagtatgcctgaattatccttgactcttttcgatgaacctccgcccttggtggagacggagccgttaccgcctctgtccgatgtttcggagtaccgagtagagtattccgaggcgcgctgcgtgctccgatcgggcggtcgactggaggctctgtggaccctgcgcgggaacctgtccgtgcccacgccgacaccccgggtgtactaccagacgctggagggctacgcggatcgagtgccgacgccggtggaggacgtctccgaaagcctcgtcgcaaaacgctactggctccgggactatcgtgttccccaacgcacaaaactcgtgttgttctacttttccccctgccaccaatgccaaacttattatgtagagtgcgaaccccggtgcctcgtgccttgggttcccctgtggagctcgttagaggacatcgaacgactattgttcgaagatcgccgtctaatggcgtactacgcgctcacgattaagtcggcgcagtatacgctgatgatggtggcagtgattcaagtgttttgggggctgtatgtgaaaggttggctgcaccgacattttccctggatgttttcggaccagtggtgatatatagactgaagcggagtgcatctcgagtcgctcggaaacgactcaccagactttttgctttaacccaaaaccatgctacgccggggaagcctccggaaccctctggcgatctgcctgttgtggtggctgggagtggtggcggcagccacggaggagacgagagaacctacctacttcacgtgcggctgtgttattcagaaccatgtactgaagggtgcggtgaaactctatggacaattcccctcgcctaagactttgcgggcctcggcttggctacacgacggggaaaatcacgaaaggcaccggcagcccatcctcgtggaaggcaccgcgacagctaccgaggcgctgtacattctgctgcccacggaactgtcgtcgccggaaggaaaccgaccccgaaactactctgctaccctaacactcgcctcccgggattgttatgaacgcttcgtgtgcccggtatacgattccgggacgccgatgggcgttttgatgaacttaacgtacctctggtatctaggcgactatggggcaatactaaaaatttatttcggactgttctgcggggcctgcgtcatcacccgatccctcctcctgatatgcggttattatccacctcgcgaataaaatgatttgttatgatgtcattgttgtttactgaaaaggaatgtgctttcccggcatgggcccgattccgagaaatggtatgatgaatcatgtggtcaggcgctgctctcaacgtccatataaacgtgggtttcggtgaccacaaccacgtcggggctgacgcggatcggacatcatactgacgtgaggcgctccgtcacctctcgggccgaaccccgtcagcaccccgcgtcacttacaaatcacgttcgtcgtgacgggggtttcccctgacacgtaatactcgcgtcacgtcgggacgatataaagaggcacggtgtttcggctcccgcacacagacgacgcgccgggcggcttcctgcggccggccgcggtgccggcggctatgatcctgtggtccccgtccacctgttccttcttctggcactggtgtctgatcgcagtaagtgtactctcgagccgctccaaggagtcgctccggttgtcgtggtccagcgacgagtcgtctgcgtcctcgtcgtctcgtatctgtccgttgtcaaatagcaagtccgtccgtctgccccagtaccctcgcgggtttggggacgtgtccggctaccgtgtctccagttccgtgtccgaatgttacgtccagcacggggtactcgtggccgcctggcttgtgcgtggcaacttctccgatacggccccgagagcctacggcacctggggtaacgagcggagcgcgacccatttcaaggtcggcgcaccccagctggaaaatgacggggctctacgttacgaaactgagctcccacaggtggacgcacgactctcttacgtgatgttaaccgtttacccctgcagtgcctgtaaccggagcgtgctccattgccggccggcgtccaggctgccctggttgccgctgcgggtaacgccctcagacttggaacggctgtttgcggagagacgctacctgacattcctctatgtggtactggtgcagtttgtgaaacacgtagccttgttcagcttcggtgtccaggtagcctgctgtgtgtacctgaggtggatacgtccctgggtccgaggtcggcaccgcgccaccggaaggacctcacgggaagaagaggctaaagacgattgactggcgaagccgccatgaggcggtggctgcgcctcctcgtcggcctgggctgctgttgggtaacgctggctcacgccggcaacccctatgaggacgacgactactattactatagggaggacgaaccgcgacaacacggtgaaccgaactatgtggctccgccggcacgtcagtttcgctttccgccgcttaacaacgtgtccagctatcaggccagctgcgtcgtcaaggacggcgtgttggacgctgtgtggcgtgtacagggtacgttctatcccgagaaagggatagtggctcgggtcggctggtcgggccgtcgcggacgaaagtggggccgtctgcacgccccggagtgcctcgtggagaccaccgaagccgtattccgtttgcgccagtgggtgcccacggacttggaccatctcactctgcatttggtgccgtgcaccaaatgcaaacccatgtggtgccagcctcggtaccatatacgttatttcagttacgggaattcagtggataacctgcggcgactacactatgaatacagacacttagagctcggggtcgtgatcgccatctgtatggcgatggtgctgctgttgggatacgtgctggccaggactgtgtaccgtgtatccagcgcttactatctgcggtggcacgcctgtgtaccccaaaagtgtgaaaagtccttatgttgatccgtgtgtctcttttctatgtaaatgtttttatataatacacgtggtttatttttataaaaaaaaaggtcgtattcgtcatttgtgtggggaacgggtgtacaaaacggacgggaaaggctaactcgcgtttatatacttatatccgccaggaacgataaccgtgtccgctcaactttctaattgacatacggtaatgccatgcggatccagctgcttctggtagctaccttggtggcgtctatcgtcgccacacgtgtggaagacatggcgactttccgcacggaaaagcagtggcagcaggacctgcaatacagaagggaatttgtaaaaaggcaattagcccccaaacctaagtccaacatcgtggtatctcacaccgtcagctgcgtaattgacggtggaaacatgaccagcgtttggcggtttgagggacaatttaatcctcacatcgcatcagaggtcatccttcatgataccagtggcttgtataacgtgcctcatgaaatacaaaacgacggtcaagttctcaccgtcacggtgaaacgtagcgcccccgccgacatcgctaaagtactcatctcactgaaacccgtgcaattgtcttctggacagtacgaatgtcgcccccaattacaactaccctgggttcctcgaccgtcctcattcatgtacgacagctacaggctgtggtatgaaaaacgatggcttaccataattttgtacgtgttcatgtggacctacttggttacgctgctacagtactgcattgtccgttttataggtaccaggctgttctatttcctgcagagaaatatcacaattcggtttaccggaaaacctacatataatcttttgacctatcctgtcaagggctaataaactgttaggttcgttataagcgtggatggtcatatataaaccgtatgcacaaaaggtatgtgtgaatggaaatacatgatgaatgtcatcatcacgcaaagcagccgtgggaatggtaaagacatcgtcacacctatcataaagaatgcaacgctttcaggataggtgtggcgaaagcctcctccgttccgtattctatcgtaacaaatatatggagtttgtgtaatgcgtacttcatgccccgatgaacgctctcgtcaggcttgtcatggtctgtaaaagctgcatgaaaaacacgacgaaagcgttcagtgttggatcagactcacgtcacacgttacatcatacaacgtagggcggtattgttgagaacatatataatcgccgtttcgtaagcacgtcgatatcactccttcactatggatctcttgattcgtctcggttttctgttgatgtgtgcgttgccgacccccggtgagcggtcttcgcgtgacccgaaaacccttctctctctgtctccgcgacaacaagcttgtgttccgagaacgaagtcgcacagacccgtttgttacaacgatacaggggactgcacagatgcagatgatagctggaaacagctgggtgaggactttgcgcaccaatgcttgcaggcggcgaaaaagaggcctaaaacgcacaaatcccgtccgaacgataggaaccttgagggtaggctgacctgtcaacgagtccgtcggctactgccctgtgatttggatattcatcctagccaccggttgttaacgcttatgaataactgcgtctgtgacggggccgtttggaacgcgtttcgcttgatagaacgacacggattcttcgctgtgactttgtatttatgttgcgggattaccctgctggttgttattctagcattgctgtgcagcataacatacgaatcgactggacgtgggattcgacgttgtggctcctgatgctgttttatcgtctcaataaaagcgcgttccttcaacacggcattctctacgaacggtattttttctgtcgcgatagtcgacgatatgtcgcgatagacaactccggtcgctaactgataacgatatgtcgcgacaatcgccgacaagccggcccgttgtgtatgcatgtcgcgacagagaggtgtagcgggctgtcacatcaactctatcgcgacagacatccccctgcacgtccatgtcgcgacacgaccactaatccgcacctgtcgtcgacatgtcgcgacacccgggtcccctcatgccctatcgggatatcgccgtgtaatgggggtgggcgactgacgtgactcttgacgtttataaaccgcatgggaaagtacggtgtcgccaccgttgacgtgggcggcgatgagaacgtcagcggtggcgaaaccgccgtgcggaaagtcccggtgccgaaatcaccgtgtgaaaagtcccggtgttgaaaccgccgtgtggaaagtcccggtttggaaatcccagtacggaaagtaccgtaacgcctcttttggcacgtagttgcctactacgtaggggaaacaacgtcaccaagaaacgctatatattcaaaaacaccgttcagtccacacgctgcttctcagcgaagcactgctgcagccagaccggagcggtgagcggagccgagcagcggaccttcggagccatgaagccggtgttggtgctcgcgatcctggccgtcttgttcctgagactcgcggactcggtgccccggcccctggatgtggtggtatcggagatcagatcggcccactttcgagtggaggagaaccaatgctggttccatatgggcatgctgtacttcaaggggaggatgtcgggcaacttcaccgagaaacactttgtgaacgtgggtatcgtctctcaatcttacatggacagactgcaggtgtccggtgagcagtaccaccatgatgagcgcggagcctatttcgagtggaacatcggtgggcacccggtgacgcacaccgtggatatggtggacatcacgttgtctacgaggtggggagaccccaagaaatatgccgcgtgtgttcctcaggtgaggatggactatagctctcagaccatcaactggtaccttcagcgaagcatgagagacgacaattggggtctgctgttcagaaccctgctcgtatatctgttctctctggttgttcttgtgctcctgaccgtaggggtgagcgcccgtctgcgatttatttaacaggtacgaaccagctggtacctgaaacctacctgggctgcaaggtacggactctaacacccaggccgcggggtacggactcgaaggcgcccggtaggtcagcgtgtctgataccgggcgccgggactctggtgctatggctgctcaatgccaccatgaactgacgacggcgtggtatccacgctcgttcaataatctcctgagacacttgaataaataaaccggtttattcgtaactctatctactgtctccgtgtatttttatcgggaatgggctaggataatcataagtttacgggaggaattggcaggaaagacaaccaaaacgtcaggaatctgggaggtggctgggctcacgtcactactctgggatataaattgggaaagagcgtacagtccacacgctgtttcaccatgaacaatctctggaaagcctgggtgggtctttggacctccatgggtcccttgatccgcctgcccgatggaatcactaaagccggggaagacgcgctccggccctggaagtccacggccaagcatccctggtttcaaatcgaggacaaccggtgctacattgacaacggcaagttgtttgctcgggggagcatcgtgggcaacatgagtcggttcgtcttcgatccgaaggccgattatggcggcgtgggagagaacctgtacgtacacgccgacgacgtggagttcgttcccggggagtcgttaaagtggaacgtgcggaacttagatgtgatgccgatcttcgagacgctagccctgcgtctggtactgcaaggggatgtgatctggctgcgttgcgtccccgaactgcgagtggattacacgtctagcgcgtacatgtggaacatgcagtacgggatggtgcggaagtcatacacgcatgtggcctggacaatagtgttttactccataaacattaccctgttggtattgtttatcgtgtatgtgactgtggactgtaacttgtctatgatgtggatgcggtttttcgtgtgctgagacgcccgggatcgcggtttatttcaataaatctagccacgagtacccattacgtgtgtcatgtcggtttcgtttattggaaaaaggttgggagatgcggggtggtgctcgagcgagagcactgacaggggtggcaaaacgcagttgagcggggtatgcgtgttcagttgggcggcaggggcatgcggccttagcggctcgggctggcgtgctgttttccgtgttgccgacggcggcgcggtccgtcgagaccggcggaccgcggagcggaggaggtgacctggctgcttaatgacagcgacggagaggaagaagagatggcgtccgggctcggtgacctctcggtcggcgtgtccagccttcccatgcgggaactggcctggcggcgggtagccgacgactcgcacgacctatggtgttgctgtatggactggaaggcgcacgttgagtacgcgcatcctgcgtcggagctcagaccgggctccggcgggtggcctgagcacgccgaggcccagtggcggcagcaggtgcacgctgctcacgacgtgtggtgtaactgcggagactggcagggacacgcgctacgtagccggtcgcggaccgcggagtcggggagaagctcctcgtcatcctccgtgtcggtccttagtgacggcgatcagcagccgtggtggaggaggctacgcgtgaaaagacccaaattcccatcttgggcgcgacgctggacgcagcgacacgactcggaagaacgggcttcgcagcaagcggagaacgacagcacgtcctgacaacatatggactggagagactttcaatgatgaacgtggtgaggggcgtgtgtttgacattttttcggccgcggaggtgctggcggccgtggcctgtggcccgaagatgtacacatatcgaggtacatgtcccgcatattttgcgagagatgggccgcggttctatccccgaatttgggcggtggcggccttggcggtcgggtctgtcttttatgatgctccgactgtcggggcgcagaaacttttccgtcggtggaaccgtgccgttgctttggcggcagcggaggtgggccggggcccgttttgcataagcgcggaggtttgtctggcggcttatgtttctggggtgggcgcgacggcaattcgtcgtaggtaggatcttcgtcgtcatcctcgggttcggacgcgcacaacgggatgacctggtggccttcggtagtgaagcgttggtcgtaacattcttcaggcacgacaggcatgggtctgtcgatttcggcgcctcgtcgttgagtggccttcagcagtctgcgttgttttatatcgtcgggtcggctgtccccgaggacccaatgtgattcgtcgagatccaaccaggctttgtggtcgtcaactgtgctgagcgggcgccaggactcgtcatcgtatcggagcgcgtagctgacgcttgcctgagcactgagcggtgggggcatcgttgcagcgtccggtttggtttggcgagatgggggtggaggttgttccatgagccaaggaggtttcctaatctgatagaaaccgatatacttttcgggcaattgactttgacgctctgtcatgacggtggtgaggtcgagaccgagagttcgagcgtccgaaagacgaaatgcgaggggatcatttatggggtcaccgcgttgttcgcgaaacatgaactcccactgcccgtgcggctcgcgcgcccacagcgcggcgcgcgggtgcaggtgcagcgcgtcccagcgcggccgctcccactgctcgcggtccagctcgggcagcagccgccgcgcggcctcggcggcgggcgccgactcgcgtcccagcgccagcgcgcccagcacgcccgcgcgcagaaagtgcgacagctccgccgccagcgggtacacgtgcccgtccagcgggcagtacccgaacacggcgcccagctcgtccagcagcaccaccagcatggcgcgcggcacggtccccgacgccgccggacccgccatcgctgtcgaacccaccatcaccgtcggcgccgctgctgctgccgcgtccgccccgaccaccgcgtgcgcgtccgcgttaggcacgcaaatcgcgcccccgccggcggcgccgtacggctgcggaggcacaggtacagcggaccccacggctcccgctatcgcgcacggcgcgtccccgccggcggcctccgtctccgtgccgctcgccgctggcggcgacgtcgtccccgccgccgtccccgtcgccggccccgccgcgcagcccagccaccgcgcgggcagcaccgcgcccagcgccagccagccgcagcacagacgctggttcaggtgccgacgcacggccgtcagcagcgacgcggggtgcggcgccgacgcgaacggctcgtactgcgccagctcctgccacgcgcccagcagtaccatcggctgcagtcgcctgcccggcgtctgcagcgccaccgtcgtgccggcccaccgccggcgcagctcccgtccgagcgccgtcgcctcctcggcgcgcagcaacgtctgtcggagcgccggctgaggcagcagcgtcgcgcgcggggtgcccacgcccagccggttgcagcggtacagccgcaccacctcgcccgcgccgtgccgaaaccactcgtccgcgtcgcgcgccgctaggatcagcgtgttgtttgccaggtcgtacacgaacacgcggaacccggcgcccagcgccaggtacagtccgtcctgcgcgcacagaccctcgggatggccggccttgtcgcccaccgtcgggtcggctgcggggtccacctcgtgcaccacggtagccaccggtacgatccacgcgtcccgcggcgacagttgacgcaggtccgtcgcgcccacgccgttcatctggctgcgcggcgtcacccgcgcgtagaatccgtacggccgtccgagcggcagcagcgtgcccgcgtcgcgctgcgaccacttgcgcatggcgcggcccgtgctgttggccaaaaacgccgcgcgccacacggcgcccatggcctggtattccagctccgtcagcgcctggcgctccaccggaatctgagacagcaacaggcgctccgggccgtgccaaaagttgccattgttgccgctactcggaggggcgcccggcggcccgcggggttctacccggtggacgccgtggcccggcgtcgtcgtagccgcagcactcgcaccagtgcccgctgtggacggcgctcccatcggcacacaagaagaaggaggagaggaaccaacccccgaaggccctccggccccgcggccgcgaccgaggggcggggggcgcggcgacatgccgttgcgctgggccatgggcgccggacacctccgacgtccactatataggaagcagacccgcgtcagcgagcacgcggtttagacacgcggacgccttcgtcgcccgtgtgccgcgggcgacacgcagctggcttttataggcagcgacgtgcacggcgcgtgctggcgccgccttggcgccacgcagtctggaaggccgtggactgggaaaggcagctacccgaaggaagacgcgcggcaggcgcgtaccactggagcgcacagccgcctcccgggcgcgcacccatctaggtggacgcccgacatccattccgggccgcgtggtgggtcctcgaggggcgggggggtgtttttagcgggggggtgaaacttggagttgcgtgtgtggacggcgactagttgcgtgtggtgcggaggacggcgacggcgaataaaagcgacgtgcggcgcgcacggcgaaaagaagacgcgtgtgtgtgtctgtgtgattccccggggaaaagaggaagttcccgggggacggcagcatgggtccctggggacacacgaaaagcaacgcccgggggcgagggacgacggccccggggaccgcgggggaaataacggccgcgaggccacacactcgttcccgcgaagccgcacaccccgaggccgcgcacaccgccgacacaccccgccaccacaccccgccggcacacccgccacacgcccgcgacacacccggcacgacacacccggcacacgcccgcgacacaccctgacacaccctgccaacacacccccgacacacccaacacacgcccgcgacacacccggcacacacccacccggccgcgccccgacacacccaaaacaccgccggtccattccgggccgcccattccgggccgcgtggtgggtccattccgggccgcgtggtgggtccattccgggccgcgtggtgggtcctcgagggagtgttgagggccgtaagcgtgttgtgtccgacgctgcctgcgcactgccggtgcgtgtcgtcccacggtatttgttgtcggcaccgggcttcgggacggtgtttcggcgcgctgccggtgcgttccacggtccttgcctgtgtcgtttccggccgcgccccgacacacccaaaacaccgacgtgcggggccgcgtggtgggtcctcgagggagtgttgagggccgtaagcgtgctgtgtccgacgctgcctgcgcactgccggtgcgtgtcgtcccacggtatttgttgtcggcaccgggcttcgggacggtgtttcggcgcgctgccggtgcgttccacggtccttgcctgtgtcgtttccggccgcgtggtgggtccattccgggccgcgtggtgggtcctcgagggagtgttgagggccgtaagcgtgttgtgtccgacgctgcctgcgcactgccggtgcgtgtcgtcccacggtatttgttgtcggcaccgggcttcgggacggtgtttcggcgcgctgccggtgcgttccacggtccttgcctgtgtcgtttcggcgctgcgcttgtcgggggttttcgagcgttctggccgccggcgatgccggggtgttgcggagacggggggtgtgcgggacggtgtcggggccggggacgggggttgcgctgggtccggggctgttcgcgccgcgtaggggaggttacgttgggtacggggacagtttgcggcgcggaccagggaacccacctcacctatttaacctccacccactacaacacacacatgccgcacaatcatgccagccacagacacaaacagcacccacaccacgccgcttcacccagacgcccaacacacgtcacccttacaccacagcaacagacaaccgcatgtccgaacctcggacaaacacgccgacgaagaacaccgcacacagatggagctcgacgccgcagactacgctgctcgcgcacaggcccgccaacacctctacgatcaaacacaacccctactactcgcataccccaacaccaacccacaggacagcgctcattttcccacagagaatcaacatcaactcacgcatccacttcacaacattggcgagggcgcagcactcggctaccccgtcccccgcgcggaaatccgccgcggcggtggcgactgggccgacagcgcaagcgactttgacgccgactgctggcgcatgtggggacgcttcggaaccatgggccgccaacctgtcgtcaccttactgttggcgcgccaacgcgacggcctcgctgactggaacgtcgtacgctgccgcggcacaggctttcgcgcacacgattccgaggacggcgtctctgtctggcgtcagcacctggtttttttactcggaggccacggccgccgtgtacagttagaacgtccatccgcgggagaagcccaagctcgaggcctcttgccacgcatccggatcacccccatgtccacatctccacgtcggaaaccgccgcaccccgccacatccaccgcatcgcaccacccacatgcttcgcctcggtgagatcacacgctttttcctgtcccatctacaccctcagccacggttcacaatccccgaaactacgccgtccaacttcacgccgaaacgacccgcacatggcgctgggcacaacgcggtgaacgtggcgcgtggatgccggccgagacatttacgtgtccaaaggataaacgtccccggtagacggggtagggggatctaccagcccagggatcgcgtctttcgccgccacgctgcttcaccgatatccaataaacccatcccctcgccacgacgtctccgcgtatctttgtagcctcaagaatccgtccccacgtccacccatcccgagcactccacacgccataacaaaccacggacacgacaaatgcatgcaaacttctcatttattgtgtctactactctgtgttgctacagggagtgaagagggtgaaggcaaagaaaaaaaaaaggaacaaaataatagattagcagaaggaataatccgtgcgaccgagcttgtgcttcttttcttataaggaggcaaatatactagggaaaacataagaataggaagaaaccgaggtttgggagaaaagctgagataaaacagcgcattttccatacagaggttgttgtttttgtggatcctaagaggtttcaagtgcgaatctcaaagttctcacgagaatattgtcttcaagtatcgacaactgtggtccaagatttttttttggtctttttaggttctgcgagggacatcacgatggatcgttgcgatgaagtcacgcgtacgcctctggtgtggcgcggtgtcgtgacaggagagtgtgttttcagtgcagagctgtcttgattcctatatccgagtatctgttttctcgtaaggacggtaatcttctttggtgtaagtacatctaaaagctgcaaactatattttaagggctgtctctaggtgtactttgatgctggagtttttcgctgtgttgatgtgaataaatctactactactattatatgcagaaagagtgattatgccgagacaagattgcatcggctgaactgtttcaaaaacgcctacactctacttatccgtaaacctaaggtaatactatgtgtaagttgtttttttttctttttgtagtaaaatggtgatacgtgcaattaaaaccgtattccatgtttccatcctttcatttcaactttaaaggcggctttgagagcgaagaagtgcgaggataaaaatggatgactccttcgtgtccagggagtcgactactgcaacgctgattgattaaaagatggtctccgatgatgatgttgttattgatcgaatcatggtgcagaacggcgacggagaggagcgtgtccgccgccgggaaggtggtctctttctcttttcttttttcaagaaatcttccatgtgtttatcgtagtgatcgaaatcgactgatctcgggttctttttgttggtttcttttcggttaatcatgtattgttttctttttttacagaaagatactttttttcatgagcaattcctcgcccggcgccggcatgccgaggtggggccactgcgatcagcggcatgccgacgccgacccggggatgttggattcaccgttttctctcttctctctctacatacagaccgggtggcaggagcggtaaggaatcatcgtcgtctttcattcttcgatgattatggtaatactaaatcttatctaggagcatatacatctaagattggagtactagtagtcgtttgtggtttctatttttttttatatttatctatgacagtttttctgtttttcgttttgataataatataataaaaactcatggacgtgaaatctggcttggttgtggtgatttcattctcattattgttgttttctttccgtcttgcggatgaagatgttgcgatgcggttgttgttggtgttgctatacaccgagagagatgatctttttgttcttctggttcatttcctatgattgtttggctgctgaccgacgcgtcaggatgtgcagggcatgcggggaatcaggaccggacacgggataatttcatctacctatacggagatcgcggtcctcgccatgaggatcgcgacaggcgcgtcgagggggcaggaacacccttgcggattgacattcttggtggtgtttcgttgttgtcggtagttgttgttgacgatgaggataaataaaaatgaccttgtttttgttctgttttctcttgttgggaatcgtcgactttgaattcttcgagttatcggaaagctgaggtacccaaatgtctgtagcttttttctttttaccctcttgtttatcatctgcgattcgtggtaggtaggagagggaaatgataatccgagattaaggaaaggagaagataaaaaataaaaaaaaataataaaacagaagccgaccggccgccgacccgttccccaggaccagcctacgaggaacggataacgcggtggcgacggcagcggtggtggcgctgggggtggcggcagtggtactgctgatggtagtcgggacggaggagaggcgatgcatacatacacgcgtgcatgctgcatgggtggatggtacggccgggagacgcggaagagaaactcacataaaaaggtgacaaaaagagcggttgaaaaaagaaaacaagattcgaccagacagaagagaaggaccggggcttggcgacccttccacgactgctgttgtcatctcggctcctccgtcttctcccggccacgggcggctaagtcaccgccgttctccccatccgtccgagcgccgaccgaccagccggccgattcgcccgccggggcttctggagaacgccggggcagcagcgatctggggaagctgctaaacccctgcgtttttatatggtagctctgccgagcgcgggctgacgcgttgggtaagcggaaagacgtgtgtgacgaaaaggggtcccatggtatttcacgtgacgatgaggagatacggtttggagcacatacggtttagaaaaagggagttgtcgtgacaagggctgagggacctctgtctccatgtgtgtataaaaagcaaggcacgttcataatgtaaaaaagaacacgttgtaaacaagctattgctgtatcattcggctgactatgcttcattcggactgattttcttttcctaacggcgtaacttaaagtgattaacgtatgatatttgttccccagagttatactatagtcatcatcctaaaattcagatataaatgaacacatgtcgtatgggattattaagaaaccgaaactctccacagttcaccatcttcttcgtcattcaaccgatgacccactccgtacaacgaatcagtctgctgcgtcatattgcaaagcacaagcgacgtatgcgaacaacttgaaacacaggctgttgtattgacgaccgttgtaccattattagtcaccaccgttatcccatgtttcccacccgatggaaaaccgtcttctatcatcaactgtggtaagatttcgaccctgcgaggtattcagtttcctcatatccataacctggattttatcattaaaccccaatattaaacacttttttagtaccccccacccaccaaaaaatgtgactggaccggttcctagcagctctgggagccatgttcaggttgaaccacagctacagcgaaaccgagtccagtgaccggtaaccacgtccagcccctgcgtatgtaccagtccaagcacgtccggtcattgttctacacaggaaatctaactaggtcaacgcaattttattccaccgttacgcagaatactaacaaaaaaacacacaaatttaacgaattacacgtagtttattacatgaaaactgtgagaacaccaattcactaagcgatacaacatttagctgacttccaagtgccacacatcaccactgtattcatccatgttttcaccgaaccaacgagacagatcgaagaagccagaatctcccgactttaaattacataaatccaacgtattatgaccacagctcgacacacaaatagttgcgttactattcacagtagcattacctatacccgtaacgttgcacaaccactgatcaccattgttaccaaaaacggttttccacttagttgtcaacggatctttcatatgcgtaatggtaaaattactaccagtcgtcgcttttagctcattacgagtattatccgcatccacatatatcaacgtcatagctaggcacgctataagtaccccccccccacaatggaatggtgccaaaccgggttctttcccgttatagccatagcggtcccaggcaaaagcaaacgccaaacctaatgcagtgaaaagcgcttgcagccagaaccagcttatgtaccagccacaatcacatccggttattgtttccacaggaaatcctaccaggcaaagccccgcttgttttgttcctatcttgtttagcaattcgtaaactgtcagcctagcgacgtccgtttagatcaaaagtcacgtatatagcgacgctgtttccatccgtttccccgtcccgccgtttccgaacaacccacccgggttcagacaaccgaccaccaacagaaatatacacacagaccactgggagttcagttaaagatttcatcaggtttattttggctgctgctagtcttttgcttcttagaaaaaaaatacccatatagagaaataatgatagtttgacaacacatatggcagggatttcttcttcatcaataagatatgcaattcccccagggagagactttcaacaattgaatttacaaaaacaaaattacatcaggagaaagagaggatacattaataaatatattatatctggtgtatatactgaatgctgctggttcataaggtaacgatgctactttttttaattccaagatggtttttctttgttagtcttttgttgacttgctggttcctaaaagttcgcaaaaacgattgtgtgaagattttatgacgttggttgactagttcatgagattctgctgtacgtgtgatggttattcgctggttcgttctaagatgagtatcgtactgtgtctgcgatggtcgtctcttactggcattctctcggctgcctcttgctttcatgattgaaaaggaaaaaaggactccgagggcgcggtcatcttttacttttcggttttctcgttggcgggtcagaggtagtcagatcatgagactgtcgtggtcgatgaaactgtgtctgctcaagtgacgtccatttcttgtacggagaaaaaagtcatcgggataaataaggctatacaaggcgttgtcaagcgtgcggctctaaacaaattaagcgatacaaaattacagtaatacgaataataaattacccccctccccctgtggtcccccgagacgagagccacccatcgtgtactctcgcaccacccacgaccacagagggagacgggacgaagagacgacgcacagcgccatctcctcctggaggccggcgacgttaactgctacagctgcggcggcgaagacagctgcgatttgtcggccgacatgccgatggtatgggcggcggcggcaatggccgcggcagcggggaggagaggagagagaagaggagcggggcgtccgaaggcgaggatggcatggtctcgccggagcgcccggcttttatggaacactcgcgtccggttgggtatcacccacaggaagatgagtcacaacttccaaaccatcttgagacccgagtaacggtttacaggtcgcacgccagtcagctaaaaacagcggacagtcccacgctgtttctgttgtggctctctccagtttcctcatcaccgtcccggtctccgtcgtcatcggaagaataccacccgctctcatgcggcagtcgatcggcctcgacgaacgagacgcggcgacgcctctccacggccgactggttgtggtggtgaaagaagagcaccagcaatcccaggaggagcaacaagccctcacatgtccaggaggtcggggagagggcctgtcggagatggccgtgaggcatcacgtacggcagctgaggagaaacggagaagaaaggaaaattaccgtcaggggccggggttcttattagagaaacagcacgtaggtcaggatccagatgctaatggcaatcatgatgacgatgatcatgcaggccaagacgcggcgcaccaatgccgaatccaatagccgccgtgcctccggttggtggccggcggcatctagagacatgatttgggggggaccggcggcgcaaaaagacagggagatggacagtgtcacggtgttttgttataattaggacatggggaccggaagccgagacagagtactacagggtgttgaagggtaacgtgagggagatcatgtcatgggcgggctgaagaccgtgcggggaggattgacgtgtgcggtgcttgtggaacacggtgttttaatatgtatccgcgtgtaatgcacgcggtgtgctttctggcactcagcttggtaagctatgtggccgtctgcgccgaaaccaaagtcgccaccaactgtctcgtgaaatcagaagatacccatttgacgtgcaagtgcagtccgaataacacatcatctaataccggcaatggcagcaagtgccacgcgatgtgcaaatgccggatcacagaacccattaccatgctaggcgcatactcggcctggggcgcgggctcgttcgtggctacgctgatagtcctgctggtggtcttctttgtaatttacgcgcgcgaggaggagaaaaacaacacgggcaccgaggtagatcaatgtctggcctatcggagcctgacacgcaaaaagctggaacaacacgcggctaaaaagcagaacatctacgaacggattccataccgaccctccagacagaaagataactccccgttgatcgaaccgacgggcacagacgacgaagaggacgaggacgacaacgtctgataaggaaggcgagaacgtgttttgcaccatgcagacctacagcacccccctcacgcttgtcatagtcacgtcgctgtttttgttcacaactcagggaagttcatcgaacgccgtcgaaccaaccaaaaaacccctaaagctcgccaactaccgtgccacctgcgaggaccgtacacgcacgctggttaccaggcttaacactagccatcacagcgtagtctggcagcgttatgatatctacagcagatacatgcgtcgtatgccgccactttgtatcattacagacgcctataaagaaaccacgcgtcagggcggtgcggcgttcgcgtgcacgcgccaaaatctgacgctgtacaatctcacggttaaagatacgggagtctacctcctgcaggatcagtataccggcgatgtcgaggctttctacctcatcatccacccacgtagcttctgccgagccttggaaacgcgtcgatgcttttatccgggaccagggagagttgtggttacggattcccaagaggcagaccgggcaattatctcggatttaaaacgccagtggtccggcctctcactccattgcgcctgggtttcgggaatgatgatctttgttggcgcgctggtcatctgcttcctgcgatcgcaacgaatcggggaacaggacgctgaacatctgcggacggacctagatacggaacctttgttgttgacggtggacggggatttacagtaaaagatgcgtgtcgcctgccgaagacctcaccatctcacgtacaggcatacggcgtatacaatcataatattctatattctgcatagagttacatgcaacagtactactaccaatactgcatccatcacatcacccaacactgcttctaccacctttgtgaccagcgtattttctactccgaataacaacacatcaacgacgccacacacatctgtcacctcacaagcgtcaaccattggcaacatcaccaacgttacctccgacttgagtactttcacaaccgtatattctacattcaatacatcatatgctaatatatccaatacggctgccactacagaattgatttcaacaaataccaacactatattatcttttaccaacgtaacagcaaacgctacatcatcttataacacaacaatcaccgtaactatcacgtcagatgaaacttcgcacaacgtatccactaatactgcacttataagcacgccatggcttacaaattgcagcgccacaacgtacaccacgtacaaccgtactaactcttccaacgcttgtcacacagagacaacaatcatacgtttcaaagaaactaatacaacaggaatagaagggagtaatgtcaccataaaaggtaattctacgtgggattgtctttcagtcgcctggatacgacattacaatcgatccacacacggacatcatctaggtcatcgtaagaacgcacatacccaatcttggtattggttacgcatccttacctctcatactgtatgtcattctcaacatgaaagaccttcactgtaccatgacttatgtcgttcgtgcaacaacacagaactacatctgtacgatctaaatatcaccaattccggcaggtacagcagacgttgttttaaagaaaattacttcacaggacatcacgaagatgaaaatttctacctattagtaacaccaaaaaatcatactgaagctattaatgctactttcgtttgccctagatacaacaccgatatcgaaaatgaagatagagagaaaggaagtcaacatactaacaatacacatcaccacaaacgtaatctctatcatagctcgcaaagaagccgcaccgtatggaccatcgtgttggtttgtatggcctgcatagttctgttttttgcacgacgagcctttaacaaaaagtaccatatgttgcaagacaccgtcagtgaatcagaattcattgttcgatatcacacagaacatgaagattgagctacgtttccgggcagacatcttatgaagctgaacaataaactaaaacattctgtaaggctcagcgttcaaaggaatattaatgcccattgagcgagaactaatattgcaatggactggcgatttacggttatgtggacgatactaatatccgcgttatcagaaagctgcaatcaaacctgttcctgtcaatgtccctgtagtactaccgttaactattccactagtactgagacagccacatcaacatacagtacaacagttatcagcaataaaagcacttcagaatctataaattgctctactgcaactgcaccagcaaccaccgtttctacaaaaccgtcgaaaacaaccacacagatatccacaacgacaaatacaaacgttgagactaccacatgtaccaacaccaccacgaccgttacttgtgatggtttcaattatacagtccataaaagatgcgaccgcagttacgaggtaatcaacgtaacaggatacgttggtggcaacataactctaaaaaatgcaatcagactgagaaatggcacaatgtagactggattagtaagcagcctcttcgtggccggacacggcgagaccgacttttacatgaactggacgctgcgtcgcagtcagacccactacctggaggagatggccttacaggtggagattctaaagccacgcggcgtacgtcaccgcgctattatccaccatccgaagctacagccgggcgttggcctgtggatagatttctgcgtgtaccgctacaacgcgcgcctgacccgcggctacgtacgatacaccctgtcaccgaaagcgcgcttgcccgcaaaagcagagggttggctggtgtcactagacagattcatcgtgcagtacctcaacacattgctgattacaatgatggcggcgatatgggctcgcgttttgataacctacctggtgtcgcggcgtcggtagaggcttgcggaaaccacgtcctcgttacacgtcgttcgcggacataacaagaaatccacgtcgccacgtctcaagaatgccggccccgcggggtctccttcgcgcaacattcctggtcctggtcgcgttcgggttgctgcttcacatcgacttcagcgacgctacaaatatgaccagcagcacaaacgtccctactagcaccagcagcagaaataccgtcgagagcaccacgagtagcgaacctacaaccgaaaccaacatgaccactgcccgcgaatcttccgttcacgacgcgcgcaatgacgaaatcatgaaagtgctggctatcctcttctacatcgtgacaggcacctccattttcagcttcatagcggtactgatcgcggtagtttactcctcgtgttgcaagcacccgggccgctttcgtttcgccgacgaagaggccgtcaacctgttggacgacacggacgacagtggcggcagcagcccgtttggcagcggttcccgacgaggttctcagatccccgccggattttgttcctcgagcccttatcagcggttggaaactcgggactgggacgaggaggaggaggcgtccgcggcccgcgagcgcatgaaacatgatcctgagaacgtcatctatttcagaaaggatggcaacttggacacgtcgttcgtgaatcccaattatgggagaggctcgcctttgaccatcgaatctcacctctcggacaatgaggaggaccccatcaggtactacgtttcggtgtacgatgaactgaccgcctcggaaatggaagaaccttcgaacagcaccagctggcagattcccaaactaatgaaagttgccatgcaacccgtctcgctcagagatcccgagtacgactaggcttttttttttgtctttcggttccaactctttccccgccccatcacctcgcctatactatgtgtatgatgtctcataataaagctttctttctcagtctgcaacatgcggctgtgtcgggtgtggctgtctgtttgtctgtgcgccgtggtgctgggtcagtgccagcgggaaaccgcggaaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagaggtgagggtacgcgctaaaggtgcatgacaacgggaaggtaagggcgaacgggtaacggctaagtaaccgcatggggtatgaaatgacgtttggaacctgtgcttgcagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactagcctgcgtcacgggaaataatatgctgcggcttctgcttcgtcaccactttcactgcctgcttctgtgcgcggtttgggcaacgccctgtctggcgtctccgtggtcgacgctaacggcaaaccagaatccgtccccgccatggtctaaactgacgtattccaaaccgcatgacgcggcgacgttttactgtccttttctctatccctcgcccccacggtcccccttgcaattctcggggttccagcaggtatcaacgggtcccgagtgtcgcaacgagaccctgtatctgctgtacaaccgggaaggccagaccttggtggagagaagctccacctgggtgaaaaaggtgatctggtatctgagcggtcgcaaccagaccatcctccaacggatgccccaaacggcttcgaaaccgagcgacggaaacgtgcagatcagcgtggaagacgccaagatttttggagcgcacatggtgcccaagcagaccaagctgctacgcttcgtcgtcaacgatggcacgcgttatcagatgtgtgtgatgaagctggagagctgggcccacgtcttccgggactacagcgtgtcttttcaggtgcgattgacgttcaccgaggccaataaccagacttacaccttctgtacccatcccaatctcatcgtttgagcccgtcgcgcgcgcagggaattttgaaaaccgcgcgtcatgagtcccaaagacctgacgccgttcttgacgacgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgtacgtatttttatgattgtctgcgttctgtggtgcgtctggatttgtctctcgacgtttctgatagccatgttccatcgacgatcctcgggaatgccagagtagattttcatgaatccacaggctgcggtgtccggacggcgaagtctgctacagtcccgagaaaacggctgagattcgcgggatcgtcaccaccatgacccattcattgacacgccaggtcgtacacaacaaactgacgagctgcaactacaatccgtaagtctcttcctcgagggccttacagcctatgggaaagtaagacagagggacaaaacatcattaaaaaaaaagtctaatttcacgttttgtacccccccttcccctccgtgttgtaggttatacctcgaagctgacgggcgaatacgctgcggcaaagtgaacgacaaggcgcagtacctgctgggcgccgctggcagcgttccctatcgatggatcaacctggaatacgacaagataacccggatcgtgggcctggatcagtacctggagagcgttaaaaaacacaaacggctggatgtgtgccgcgctaaaatgggctatatgctgcagtgaataataaaatgtgtgtttgtccgaaatacgcgttttgagatttctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagtttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgatggagtcctctgccaagagaaagatggaccctgataatcctgacgagggcccttcctccaaggtgccacggtacgtgtcggggtttgtgccccccctttttttttaataaaattgtattaatgttatatacatatctcctgtatgtgacccatgtgcttatgactctatttctcatgtgtttaggcccgagacacccgtgaccaaggccacgacgttcctgcagactatgttgaggaaggaggttaacagtcagctgagtctgggagacccgctgtttccagagttggccgaagaatccctcaaaacttttgaacaagtgaccgaggattgcaacgagaaccccgagaaagatgtcctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaaggttcgagtggacatggtgcggcatagaatcaaggagcacatgctgaaaaaatatacccagacggaagagaaattcactggcgcctttaatatgatgggaggatgtttgcagaatgccttagatatcttagataaggttcatgagcctttcgaggagatgaagtgtattgggctaactatgcagagcatgtatgagaactacattgtacctgaggataagcgggagatgtggatggcttgtattaaggagctgcatgatgtgagcaagggcgccgctaacaagttggggggtgcactgcaggctaaggcccgtgctaaaaaggatgaacttaggagaaagatgatgtatatgtgctacaggaatatagagttctttaccaagaactcagccttccctaagaccaccaatggctgcagtcaggccatggcggcactgcagaacttgcctcagtgctcccctgatgagattatggcttatgcccagaaaatatttaagattttggatgaggagagagacaaggtgctcacgcacattgatcacatatttatggatatcctcactacatgtgtggaaacaatgtgtaatgagtacaaggtcactagtgacgcttgtatgatgaccatgtacgggggcatctctctcttaagtgagttctgtcgggtgctgtgctgctatgtcttagaggagactagtgtgatgctggccaagcggcctctgataaccaagcctgaggttatcagtgtaatgaagcgccgcattgaggagatctgcatgaaggtctttgcccagtacattctgggggccgatcctctgagagtctgctctcctagtgtggatgacctacgggccatcgccgaggagtcagatgaggaagaggctattgtagcctacactttggccaccgctggtgtcagctcctctgattctctggtgtcacccccagagtcccctgtacccgcgactatccctctgtcctcagtaattgtggctgagaacagtgatcaggaagaaagtgagcagagtgatgaggaagaggaggagggtgctcaggaggagcgggaggacactgtgtctgtcaagtctgagccagtgtctgagatagaggaagttgccccagaggaagaggaggatggtgctgaggaacccaccgcctctggaggcaagagcacccaccctatggtgactagaagcaaggctgaccagtaaactattgtatatatatatcagttactgttatggatcccacgtcactattgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcagcccgcgtaagaaaccgcgcaaaaccacgcgtcctttcaaggtgattattaaaccgcccgtgcctcccgcgcctatcatgctgcccctcatcaaacaggaagacatcaagcccgagcccgactttaccatccagtaccgcaacaagattatcgataccgccggctgtatcgtgatctctgatagcgaggaagaacagggtgaagaagtcgaaacccgcggtgctaccgcgtcttccccttccaccggcagcggcacgccgcgagtgacctctcccacgcacccgctctcccagatgaaccaccctcctcttcccgatcccttgggccggcccgatgaagatagttcctcttcgtcttcctcctcctgcagttcggcttcggactcggagagtgagtccgaggagatgaaatgcagcagtggcggaggagcatccgtgacctcgagccaccatgggcgcggcggttttggtggcgcggcctcctcctctctgctgagctgcggccatcagagcagcggcggggcgagcaccggaccccgcaagaagaagagcaaacgcatctccgagttggacaacgagaaggtgcgcaatatcatgaaagataagaacacccccttctgcacacccaacgtgcagactcggcggggtcgcgtcaagattgacgaggtgagccgcatgttccgcaacaccaatcgctctcttgagtacaagaacctgcccttcacgattcccagtatgcaccaggtgttagatgaggccatcaaagcctgcaaaaccatgcaggtgaacaacaagggcatccagattatctacacccgcaatcatgaggtgaagagtgaggtggatgcggtgcggtgtcgcctgggcaccatgtgcaacctggccctctccactcccttcctcatggagcacaccatgcccgtgacacatccacccgaagtggcgcagcgcacagccgatgcttgtaacgaaggcgtcaaggccgcgtggagcctcaaagaattgcacacccaccaattatgcccccgttcctccgattaccgcaacatgatcatccacgctgccacccccgtggacctgttgggcgctctcaacctgtgcctgcccctgatgcaaaagtttcccaaacaggtcatggtgcgcatcttctccaccaaccagggtgggttcatgctgcctatctacgagacggccgcgaaggcctacgccgtggggcagtttgagcagcccaccgagacccctcccgaagacctggacaccctgagcctggccatcgaggcagccatccaggacctgaggaacaagtctcagtaagtgaaaaactggaaagagagacatggactcttgtacatagtgattccccgtgacagtattaacgtgtggtgagaatgctgtttaataaaagtagctttttttatacatctccgtctctggtctcgtgatgtgggggtgcgggtggtcccggataattgtccttctccccctcatgtgtatggccctgatggcgagaggcacatacgggacttacatctgctcccccaacccagggagacttagaatctcttgcgccctctcggtgttggaccaaagactgtggtgggagatccagtattcatcgggtcgtctcacccgagtcctggtctttcatgatgacggtgaggagggtggtgacttacatctcacggatacccgtcactgcacttcctgtacacatccctatgtgatttctttggttaccccgctgaccatcaatgccacgctacggctgctgatacaagatgggatgtacgggcggggggagaaagagttgtgcatcgcccatctacccaccctgcgagacatccgcacctgccgcgtcgacgccgacctaggacttttgtacgccgtctgtctgatcctgtcgttcagcatcgtcgcggcggccctgtggaaggtagattacgacagatccgttgcggttgggcccaaaagctataaatcatagccactgacgcaggcacgtcattgacagccggcgacgtcgagagggtaactatgtaccgtgcgggggtgacgctgttagtggtggcggtggtaagtctgggaagatgggacgtggtaacgatggcggccgcgattggaatcgggtggtatgagcctgaagtaagcatggcttacatttatcaatacaatgacactaacttgactattttttgtaacactacagcttgcaattcgccctttttggcctcagggatgatgataagtgccccgttgaaaacacgctttctcaccagcaaggtcaactacagcaatgacatggataacgacagaaaaaattatacccaccaactgaaatacatgctagcgggggcaccgggaacttatgtgaatagcagcgtcacctgctggggctctaacgggacttttggcgccaagactttcttagtcaaatccatggtcaacaacacggatagtaacaccaatacgtcaatcatccactttgttcagcaggatgaactggtggataatcccgcgtactttaggcgtagcaatcaccgagcctttatgattgtcatactgacgcaagtggtttttgtggtcttcattattaacgcctcttttatctggagctggacgtttaggcgtcacaagaggtgacgcgacctcctgccacatatagctcgtccacacgccgtctcgtcacacggcaacatgtgttccgtactggcgatcgcgctcgtagttgcgctcttgggcgacatgcacccgggggtgaaaagtagcaccacaagcgccgtcacttcccctagtaataccaccgtcacgtctactacgtcaataagtacctctaacaacgtcacttctgctgtcaccaccacggtacaaacctctacctcgtccgcctccacttccgtgatagccacgacgcagaaagaggggcacctgtatactgtgaattgcgaagccagctacagccacgaccaagtgtctctaaacgccacctgcaaagttatcctgttgaataacaccaaaaatccagacattttatcagttacttgttatgcacggacagactgcaagggtcccttcactcaggtggggtatcttagcgccttcccccccgataatgaaggtaagtagcacctacctttctgttcaaccccttttcctcccccgccaacctgccaacaaaataaacaacttatgaattttatccacaggaaaactacatctctcctacaacgctactgctcaagagctgcttatctcgggactcaggccgcaggagaccactgagtacacgtgctctttcttcagctggggccgccatcacaacgccacttgggaccttttcacctatcccatctacgccgtgtacgggactcgcctgaacgccaccacgatgcgggtccgcgtgctgcttcaggaacacgaacactgcttgctcaacggtagcagcctctatcaccccaacagcaccgtgcatctgcatcagggcaaccagctcattccgccgtggaatattagtaacgtgacgtataacggacaacggttacgcgagtttgtcttctacctcaacggcacgtatactgtcgtgcgtctccacgttcagattgcgggccgaagttttaccaccacctacgtgtttatcaagagcgacccgctgttcgaggaccggctgctggcctacggcgtgctggctttcctggtgttcatggtgattattcttttgtacgtgacctacatgctggcgcgccggcgggactggtcctataagagactggaggagcccgttgaggaaaagaaacacccggtgccctacttcaagcagtggtagggcccgagacgagaggagtggctgctgtgttgtctttatttcgctgacttctacggagttttccctcagcctctgtgttcccaacacgtccccccgctgagcgttggcggcgatggtcatgttctcccaggaccacgtccagatcgtctacggctccacacgcatctgcaagtccctggccccggccaacaagagaaagacccatcgcaccatcgtggtagcgccgcgacggggttttttgcgtattcccccggacgggcaggacgtcaaccacgtcaagatcgtacccaccacctcctcctccctcgcgccgccccgtgacgacgagcggcggccgaccccgccgttgcggccgccgctcacagtctatccctatggcacgtcgctgatccgcaggtcagctagggacgcaaaactccgctccaagctaatcgtcttccatataactcgccccgcactcggtcagcacccgcagaatcccgggatctcgggccctgcggccatggatcacagtgagttcctcaccagctttcgtcgcgaggtcgatcggcaaaccgtactgaccgctgagagcgcgcccgccactgcggaagtctgtctgggcgacgctctgcccggcggcgtcatgggtggcggaggactgccggcgggtgtgggctcggcaagtgccgccgtggccgccgcggccgccgctgtggccggagtgcccgtcgccgcaaaccccgtcatgcccgccaccgccacggtcaccacgccgcccatgatcgaccttaccagccaccaccggccgctgacgctgtttacgccggcctccgcggccgctgcgcccgccgtggccaccaacggcggtaacgccacctacattttgccggccgactgtcggtacgcgccactttttgccagcaaatacaagtacgtcttcgaagaggtatcacgtctcatgcggctgcacgactccacggccgtgcagctgcagatcagcgcctcgtgcggcaacgctttccaggccctcaagagtgccctgctcaagttgcacaacgtcaccgtgttagcgggccagcagctcatcacgcagacgatgccgcacacgccacaggccgtagccacgttcaaattctttcaccaggatcccaaccgcgttctggactgcatccgtccggtggtgccgcgctctacttcgtaccacgagacgggtgtataccagatgtgggtctcgggcgccaccaagaaagacctgtttgacgccgtaaccctgtgcgcttccatcgtagaaaagcagccagacgtatttaatatcaacgtcagcttgttgacgtacccttcgatcgcggcgccccacttgccgctgtacaacgaattcaccagctttcgcctgcccacctcatgaagcggcggcggcgatggcggggctggttgcttttcccggccctgtgcttttgcttactgtgtgaagcggtggaaaccaacgcgaccaccgttaccagtaccaccgctgccgccgccacgacaaacactaccgtcgccaccaccggtaccactactacctcccctaacgtcacttcaaccacgagtaacaccgtcaccactcccaccacggtttcctcggtcagcaatctgacgtccagcaccacgtcgattcccatctcaacgtcaacggtttctggaacaagaaacacagggaataataataccacaaccatcggtacgaacgctacttccccctccccttctgtatccatacttaccaccgtgacaccggccgcaacttctaccatctccgtcgacggtgtcgtcacggcgtcagactacactccgacttttgacgatctggaaaacattaccaccacccgcgctcccacgcgtcctcccgcccaggacctgtgtagccataacctgtcaatcatcctgtacgaagaggaatctcagagcagcgtagacattgcggtggatgaagaagagccagaactggaggacgacgacgagtacgacgaactgtggttccccctctacttcgaggctgagtgcaaccgaaattacacgctacacgtcaatcacagttgtgattacagcgtgcgccagtcgtctgtctcattccccccgtggcgcgacatcgactcagttaccttcgtacccaggaacctctccaactgtagcgcccacggtctggccgtcatcgtcgcgggtaaccaaacctggtacgtgaatccgtttagcctggctcacctgctggatgcaatatataacgttttagggatcgaagacctgagcgccaactttcggcgccaactggctccttaccgtcacactctcatcgtgccgcagacttgatgtgccgccgcccggattgcggcttctctttctcacctggaccggtggtactgctgtggtgttgccttctgctgcccattgtttcctcagtcgccgtcagcgtcgctcctaccgccgccgagaaagtccccgcggagtgccccgaactaacgcgtcgatgcctgttgggtgaggtgtttcagggtgacaagtatgaaagttggctgcgcccgttggtgaatgttaccagacgcgatggcccgctatcgcaacttattcgttaccgtcccgttacgccggaggccgccaactccgtgctgttggacgatgctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacactcttttacggcctgtacaacgcagtgaaggaattctgcctgcgtcaccagctggacccgccgctactacgccacctagataaatactacgccggactgccgcccgagctgaagcagacgcgcgtcaacctgccggctcactcgcgctatggccctcaagcagtggatgctcgctaacattgctgataataaaggctctctgttaacccccgacgagcaggctcgcgtgttttgtctgagcgccgactggatccgcttcctcagcttgcccgaccacgacacggtgctgctgcgcgacacggtggcggcggtggagggcgcgcggcaactcgagatggtgtacccggcacccgagcacgtacaccgctggagctatctgtgtccgcccgagcaggtgcgcgtggtgatcgtgggccaggacccgtactgcgacggcagcgccagcggcctggccttcggcacgctggcgggccgaccgccgccgccctccctcaacaacgtgtttcgcgaactggcgcgtacggtggacgggtttcagcgtccggcctcgggttgcctggacgcctgggcgcgacgcggcgtgctgctgctcaacaccgtgttcaccgtggtgcacggacagcctggatctcaccgtcacttaggctggcagacgctgagtaaccatgtgatccggaggctgtcagagcgccgggagcatctggtgttcatgctgtggggcgccgacgcgcacacctgcgagtacctgatcgaccgacggcggcacttggtactcaagtcctgccacccgtcgccgcgcaacaccacccgcgccttcgtgggcaacgaccattttatactggccaacgcgtatctggacacgcattaccgagagaccatggactggcgactctgtgggtgattgatgataatagacacaccggggagacaaggtggtgaactgtgatgtctatctctttattgtaaaaaaaatcagtgaccaatatatatagacacacaccaaaaggggtggaaacccaaatgtccaagcgcgtcctgtttcatattttttccggtctcggctcggttttttaatcgtcgaaaaacgccgcgatcgaggcggcggcgatcgcagcctcctcgctgggatcgataatttcgagtccgtcctcgaggaacgagggccctcgccggcggccgttgccggcaacttgcgacaaccggagcagagggtcgttgtcctcctcgtcctcgtggcggttgtttctccgtcgcgatctccgagaggaggaggacgacgacgatgcagcctgccgccggctgtttctaccaccgccaccaccgccgcctcctcgagtattgttccgggcccgaccccgacgtccgcccgacggtggtggcggcggcggcagtggagccgaagaagacgaggaagagttactggcagccgcggcggtggcgacaacggggtttaccacgtagggcttgatttcacacacgggccggggaggagcagctggtgtttcgattgcggcggcaacgggcgcgacaccggcgacggaacctgagggtacaacaccggtggtgacgagtggcggacatgcggctgctggggggccaacgccggctgcggagacagctgcggcggtcctcgcgacgctgctgtggttgacgacgacagtcccgcccgacgtctctggcaagagtctgctggaaaccagggggagatcgcacaatcttttctccttacaatcattgagcattttggtcaatgactgtataatgtcatcaaaacgcggactgcgaggaggctgaggcgccgcggattcctgcgaattcggaggaacacggcagttagagactggagtggtggaatcattctcctcctccgactgcggtggtgcctccgccgcctcagccggagccctcctcatcctcctcatcatcattaaccccgcagccgccgccgtcgccgccgcctcggactcctgcaccgtctcgcccgcgctgtgggcgctgctgggtcgagggagcgaaagaagtgacgacggcgacgtcgacgacggcgacgaaaccaccgctccgcgctcaatgggtagaagtaacgcaccgtcggtgccggcggccacgtccgtcacggcgttatggtggtgatgatggtggtggtggttgttggaggaagaagagaccgcggaggatgaggacgagtaattgagaaaggccaccgcttcagacgtgtccagcggcagcgacatgcggccgctgccgccgccaccaccaccgccagcaccaccggactgctgctccgtctcgttcttgccgccgccgccatggccttcgtgctgtgcggtggtcttttgtctcttcgcctcccggaggggaggagagcctacagacgggacgacacatagcgcacgaaaaagcacatggttatcatccacacaaccaccagcgcaccaacaccgctcgcctgctcgctcgtgcgctacgggaggctcacgagtccactcggaaagcaccgtgacgcgaggagggccgggactcaccgtcgttctcggaggagggaggcggccgccgctccttctgccggttcatcaaccggggatcccgcagcagtccgttggcggagtccgaggagtgctgaccgccgctcccgccgccgccaccgccaccaccagcgccgccgcctccaccaccaccggcagacgaggacgactttttgcgccgttcttcgtgacgctgttcctgccttcgccgttgctgttcctccgcagaagggccgtcgcgagtcccgccgctgccacccagcgaggacacgcagacggcggaagcggtagacgcggcgccgcaaccaccgcctccgctggaggattcgccgtggtttttcaggtaatgccgcacgtaagtcacttgcaaattaccgttctcggaaatcatggtgagcagcgcgctctcattgggtccgctggagcccaccaccgaggagacggatttgttgaagacgataccgccgcgtacaaagaggtgctcctgcagctccccgtcgcccgtaatgtcaatagacatgaagccctgctgcgtcttggcgccggccgaagcctcgccgtgctgcataatggtagcgcagagccagcccttgttgaggtgcagcaccttgccatcgccgtccacgcagttgaccagacgcgcggtatcgaagacgaactggcgcacgtcgaaagtctgattgacgctttgatgcaggatgcgattaggattcgcaaaagtccagtattttcgcacgacggtagtagggagatccatgacgcggcggcgcaaagcgcgagcgcaacgctcgtcggaggccgtggagcgagtgccgccgcagccggcagagcgccgaaccccgtcgcagactctatttatacatcatctttccagcccgcctagcaacacccacaaacaacgtcacgacgcaacgtggttaaacagtacgtttattaaagtaactgggtgaacgacaccggagcggactgcaaatcgcaacgctactttctcgagtgcagatactcttcgagacggctaaacaacgtgtccaactcgctgagacctttccgcgtgccgttatccgatttcctttccgcctcctgagacagccgactaatcacggacttatctccgcaacctaacagaggctgggagcccgacaaaagtaaaacagcgtgctatgaacacgttgttacctctgtgcggacagcgccgccacagagacacttacacattgccgcatgtctttgtagatggattctagcgtcgagcgcatactatgcaattccgtcttgagtccgggatagacgtggtcgcctgcgggaaacacgatctccagataccgcctcaacaaccagtccatgacgctgcatccccaacagcctttgaccaccgtaccgtcgagccacacggagtagtcgtcctcacgttgctacaagaggaaaactacgtcacccgacacgcggaaaagaaagaccgtcgcaataaaccgtacctacgtgacctaccaacgtaggttttactcgatgaaaggtgacgcggagatcttgcaatctggtcgcgtaatcctctggacgacactgcggctttgtattctttatcgtcgtcgtcgccggcttcgcctcctcggaagcgcctagaagaaagacgatcaggaccagagaggaagagaccatcaccgacagcatcgccgcagcatgccgtcccagtccgccgcccaactgcgcgtcccaggtaggtggtcctttatgttatgatgtttttgtcaattttttttttcaatttctttcttccgcggttagaatagtttctgtaggaaccaattatcaatctgacgggttatcgtcaccacttgatggcaaaacgaaattttttttttcattgccttgaagtctctcccgccaccaccaccaccgccgttgtctccggctggagatcaagacgaaattcctcctctctaaaaaaaaaggtggtgggcttaattgatcatggcaagaagaaaaactatactgaataaactgtgtgcaaaactactagtaacaacaaaaatagcgactagatacaccacggacaatctcagcagatactctctcaaaagaaaaaaaagacgccgtaacgtcggagaatctggtatctactgcctgacgaatttttttttcgtccatgtatgtgattacgagtagtagtggtatgtagaacaagaagaaaaatcgtagtccccaaaaggataataaaaataacactcatagagaatcacagattttctctagacaactctctatccaaataacgaatgtgaagcgtacaaagtaagatattcaaagaatagcaccttcatagattcatttcagctttctactccttgtaatttaaagttgcactaaacaaagctcttaaagaaggttcgagccgctctcgatcactcatcgatcacgcgagtcttattattccaccacaacgtaacattcttcactttgtagagacactttatcgtagagtaaccctcgatttcctagctgttgttttttgattattttgttcgctctaagagagatactcgaaatcctacttacaccaaggaccctacatcatcgcaggaagaataaacataccgtagaaatctcgacacgcaaacgcgaatgtacacgaaccaaaagccacagacccactatttctgtgccgtattcttttttgacaatctgtctgaatctgcggaaatagttacggagaagcaattctgttaaaaaattcagtacgttagcagcaaaagataatcatttcgtgtgatagcaagtaaatcacctcacttaggatcgatttcgtgcgaaaaaattattttttctcctaatcaacagataatatggttaccatttagagtagtgtcactttactttcacggaagatgcaacccccgagaaaaagaagaatcgatcatagataaaagaaatcaagccagacttgttaagaaaaaaaaaagatcaaaaaattactacctaaaaagaacgcctagccattgggagacgcgcacgtctgtgtggtctccgcgatcatgagaacgaaaaaaaaagacacgacaatacacaggctgacctttgaaaaccaagcctattgataataatctaccccatagaacaggatataatcaagcatccaaacaacaaacagcgccgccgtgcctcctccagaggacggtgacgacgtatgtctgtcgtctcccttctcgctctggcttctggggctctcctcctctccccatcatcttctccttcgtcccagacggacggctatcggttcgcgcgctcgtcttttcttcgatgtgcgcaggtttcgtcatcggagaagaagaccgcgaccgtatcataatgatgataataataatacattcaccgaccatctttatcctcttttgttgttccaaagagaaaagaaaaaaaaaacaagcagccactctaaccatcacactcacgagttaatatggggttaggggggaggaagagaaataccgccatgaaggcaagagcagcagcagcaacgacgtcactacgatgattgatgatgatacacgactaccactggaggagaggaaaacggagaaaactcatcgtgatgatggaaacaagaatgatgataataatgatgacgataaagccaccacacgatatatacagagaacaacaaaaccaccacgacgatgaaacaaaacgctcaaccaaacattgtgtaaccgctacgcatccgtggccgcggccggcggcctcttgttttcgttgtccccttcgcgggggacatcatcgccgccgacccgcgtgtgccctgcctcacggctggtccgtgatgaactcttgctcgtaaccgccaagcgataaacaagccaccgtgatagaagacaccttataggaccatatcctagttacatagtagtgcatatatatagtaatagtagaataagtgaactttagacacgatagatgaagccatagtctgaatagtcatgatgttaggaacactatacgactagtacatacatacatacacccccttaggaggaacgatgaatcaaagaataatacatcatgtagcataagtacattaagcctttaaacgaacaaattgttaaccaaaatcgatcaccaccatagacgtactatcatcattacaacgaaaaactagacggatggatagctgtaagtctcacctagctaactaacgatcacattttttctccacgatatagtcaccacaaccatgaatgatagccgcctatttgaagtttgatatctcgacgaatctctatagtcatagcccgttctttttttccaagtatcctttagtccataagcattattataaccgtattacccagaaatctttgttatgagtctcttcgctgtcaactgattagtagcaagttgctgtgattttttttccaatcccataggcatccttagttaaaacattaagaagtaagtaggttctggatagctaatcatctttttttttttacttcggtagattaaaacaaatgaaacacgtagctgttgttttttggtgaatatagtttggtaagtccttagcgggtaagttctaagaaacattagttactttttattgttctgtctcctctccccctaccttacgttgggaggtagcttcgtcatgtaggataataattaggtaagcaaacaacatagatagtgattttagtatagataactcgtgtaagtgttttagtgacttgtaactcgactcggtagacttctcagagtttcgcctcacacaggcgggtacactcgttaagaaacgcaaaatacctaaaagggtacgttacatagcagataagttgatagatgaccgatattatacttcattaactcacgaagatgactgtaagtaaggatattgttgttcatgatagtagccaggttataaggatcatatatatctcgtcagggaaatacaagttagaccataatgttgactactttagagataataagacaccataggattctgaatttaccatgatataagttaagaagattgatatctgtcctttttttgaaacgaagataggcctttttattttttcgaattcatgttcgaaaacacaagcttccataacaagaacccgtaccgaagaaaagttccatcgactaaaaagaaaaaagaaaacgaagcaagacctcgacgacaacaacacatcaaagaaagacgaccagctgattatgttcttaggaattccacacacccgcgagccgatccgcaaacgtcgtgcgaggcgcgctttctctggctcgacacaatgatcacaccgcacgctatagacacgtcgtcgtggacgacgatgacctcaggccacgaatgacaaccaacatgggcaaagtccaattagccaaaaagacgacgattctaagaattgatgaatcctcgatatacgcctatcgataggtttcaattgtgtcatatacatcaaatgaaaaacaggacgcacgataaaagcttccttacagcataactgtaacatacgatcatcgaacatctcctcacatacctttctcctctcacataggaaaacaaaactcttttttttctttcctgtcaaggaaaaaatcaatgtaccaccacatcactttctgctcggtcccggcgacggatgggcgcgcacgcggacaaagacccaccggccacttccacttattttttgttgttaatcgtcttctcccccgcacgcggagcaccaccaagcctagctgctcattcgctcaaccagtcacaccgcgcacgcgagaaggggccggggtccgcgggcaccgccgccggaggcgcggttccctctctctaattccctggaaaacaagtaatgacaaacaaaaagacgacaaaaggtctctattctgctacatgagagaaattatagctgttggcaatttttcaaaatacatgttataaggcatcctctctgccacacgcgcagtcacggataggatcagtgcgtattcattataaaaaaaaacacaaacaacccatatatgtgaagcagaatgatgaccgaccgcacggagcgacgccgtcgactgacccacgcggcatgtacgccgtccgcgaacaaccaaaggacgacccgtctccccccgcacccgggttttttctcttggtcgaacccggcttgcgacgacgggttgttcctttaccggacgacggtcagccgcggggttgatacccagcgacggcgtcgctcccacccgggtttcttctcttgcaggtaccacccgtcgactgtcagcctcgcgaggagacaccgcggaccggggaaacggataagtttacgaacagaaatctcaaaagacgctgacccgataagtaccgtcacggagacacggtggtttttattgaatttccagtgtatcgagccaccgtgatgcaggtacggtggttttatgtaaagtgccgctatctataggcgatgtgttccctgacggtgtgtgtttttttggggatagacaacgtggttcttgtacgtggtttttaccctgctcaataaagtcacgttttccttacacggtgttgtgtcaaaaaataagcgtggtgcgtttgtctttgagcgcgcgacagatatagggggtgatagcggtgttcttctcatagggcagtcgcaacgggttaacgttcatcatgaggtgttcggggtccgtgactcgcgacatggccacgtagatgtggctcatcttgaggttcttgggatggtccccaaagtccacggccaccttctcgagcgacaggccctgactcttggcgatggtcatggccgtgcgcgaagtgaggccgtagtccacggtggtgcacacgtgcagactcttgccctgcgccgactcgacgaagcgcgaaacgttaacgtcgagcacaaagaggaacccaagcgcatcgcgtagcaccagccgcgaaaggccgcgctgcaccacctcggggtggatgcggtggcggtcactgggcagactgagcacgttgtcgctggtgtagccctcgagcgtgtacgtctgcgccggcgacacatgcgaaagcatgcccacgaaggagccggtctgcgagctgatctgacagttggccttgaacaccacgttacggcgattgtaggtaacgagcggcaacgtggcgaagcgaccgcccgtgagacgctgcatgagctggtagcgcttgagaaaaatgtcgcggaaggtagtgtacatgtgcaccgtctcctcgaaagaaagcagcgccaggctgggtggcttgacgtatttgagaaaaaagggatccgcgtacagactggtgtgatccatgagttcggcgtccgtgatggcgtccgagtcgtcatggtggttggacaggcaggggatgtcgtgggtctcctcttggccatgttccatccgttgagataccggcacgctctggccgccctgagaagaatccgcgtcgacgtgattatttatcggattctctcccccgctccaagcgggagcggcggccgtggcggcggcagcggcgcagagcgaactcacgtcgggcagctcaacgcgcgccagctcacgcaacatctcctcggtcgtgtagggcgacacgtagaagtagtacatggccgagaagagcaggcccgaaactaacgagtaggcgtaggccgcctgctcgcagggcgtgcgttcgataaacgtgtccttttgcaagatgtccacgaaacgttcgaccgtgccctggtatccgataacacaggcccgcaccttagagttgactcccaccgaactgcccttgatgtaggtaatgcgcaaggtgagcagcgtctcacggctatcgggcgcagtggtggtatcatcgtcctggaaaaacgccgtctcgtcgttgccgccggtgctcccgattacagatcctccccctccgtgagcctggacggaggagttgttggtggcaacgacgtcggccgcggggcgcagcgcctccttggtgatctcgctggagaggttgtggtcgacaaactgcgagtagttaatgatgcgcgccaagttctggcggaaccagagctcgacgggctgcggcgagtcgcccagcgggtcggccagctcgcagagctcctggtacgcgcggttgttgaccacgcagtagacgggcagatcaaagagacggtggcgctcgctcaggcggatctgctcgtgcagccgcttgaagtaagcctgcacctcgacgtgtgagagaaaaagccgcgtcatctcggcggcgtacgaggggttgcggatggagctgggcggccgcacgaagcgatccacgtaggccacgtgctcctccttgagcgggataccgaactccatgtacttgagcaggtcgccaaagtccaggtcggtgcaacgcttgttgtgaataaacatgacccagttgtcggcgatgtcgcagtagttgatgagcacctcgttctgaatcagcgccgagagcacgtcaacgcccttgcgcacgctcttgttttgcgtgtagtggtcgtagcggctctccagcgcctcggtctgcgtgggcgaaccgacgcagatgatgcagggcacgcggcgttcgcggtaaagtcgcgtgtcgcccagggcgttgtaaaagtagtaaaaaaacaccaccacctgcagcatgtagcgcagcataaggccgcactcgtcgatgacgatgatattgctctcgcacagctccgagaggtcctcgcaggcggcggctgcggccgcggcggaggccgaagcggccttgcgctcccacatatttaagcatttgtccacgatgtcggcgatgaccggccagtaggcgagcagatcgttgatctgcaggcgctggatggtggtctcctcgtgcggctcgcacacgcggtagcgttccagcgtctcgtggctaacggcgctgtcagccagcggcacgtgcttgctgacgaagccgaagacgcggtagatggtcttgacctgcgccgagcgagtgcggttgaggatcgcgctgaggttctgcgcggcgatcaccgtggtaccggtgatcacgcaatctagattggccgccagcacctggatgctggaagtcttgccggcgcccgccgtgccggtgacgagcagcgcgcggaagggaaagaagggccaacggtcgacgcagggcacgcgcgtgccgccggcctcggacgaagcggcagcggcggcagaagaggaggcggaggagtgaacggtcgtcgttgccgcggcggtagttgcggcagaggggttgttatctgtcgttcgttcaacgcgactgatggagcgaaaccactggaacgaaaaatcctcgggcgcaaagcgctcgcgcgagagggacttgaccttgtcgacgatccgttcgatcttggcggccgacgagaggttgaggatcaaggcgtcgtcgtacttgggcgtgggccgcggcgtggatgacgaggccgtcatcgacattttccccacggggcagacgatgagcttcctgcggttgctgcacggctttctggggacgtgtcgcggccaaagcatgcaccaggtgctgcgcgacccgtgcgtgctgcgcaagcagctgctctacggagtgtgcaaaacgctctttgacaccatcacggtgcggcgcgtggccgaggagtggaagttgcacgcggcgctatttccctaccgcgcgctggacgaagaggacctggagcagtatctgttggtgtggagcgcctcgttgcgccagagcgtgcaaacgggcgtgctgggcgcgctccgcgacattttatatcagtacgccgataacgacgactatggtctctacgtggattggtgcgtaacggtgggactggtaccgctgctggacgtgaagaccaagccgagcgaggcggccgagcgggcgcaatttgtacgcgcggccgtgcagcgggccaccgagacacacccgctggcgcaggacctgctgcaggctaacctggcgctgctgctgcaggtggccgagcgcctgggcgccgtgcgcgtagccaacgcgcccgaggtacgcgtcttcaagaaggtgcgctcggagcggctggaggcgcagctgcgcggcaagcacatccgcttgtacgtggcggccgaaccgctggcttatgagcgcgacaagctgctgttcaccacgccggtggcacacctgcacgaggagattctgcgctacgacgggctctgccgccaccaaaagatctgccagttgctcaatacctttcctgtgaaagtggtgaccgccagccgccacgagctcaactgcaagaagctggtggagatgatggagcagcacgaccggggcagcgacgccaaaaagtccattatgaagtttttgcttaacgtctcggacagcaaatcgcgcatcggcatcgaggacagcgtcgagtcctttctgcaggacctgaccccctcgctggtggaccaaaaccgtctactacccgcgcgtggtccgggcggacccggcgtggtgggacccggcggcgccgtggtgggaggacccgcgggccacgtcgggctgctgccgccgccacccggcccggcggcgcccgagcgggacatccgcgacctgtttaagaagcaggttatcaagtgcctggaggagcagatccagtcgcaggtggacgagatccaggacctgcgcacgcttaaccagacctgggagaatcgcgtgcgcgaactgcgcgacctgctcacgcgctacgcctcgcggcgcgaggactccatgagcctgggcgcgcgcgacgccgaactctaccacctgcccgtgttggaggccgtgcgcaaggcgcgcgacgcggcgcccttccgtccgctggcggtggaagacaaccgcctggtggccaacagcttcttctcgcagttcgtgcccggcaccgagtcgctggaacgcttcctcacgcagttgtgggaaaacgagtatttccgtacctttcgcctacggcgtctggtcacgcatcaaggggccgaagaggccatcgtctactccaattacacggtagagcgcgtgaccctgccctatctgtgtcacatcctggcgctgggcacgctggaccccgtacccgaggcctacctgcagctctccttcggcgagatcgtggccgccgcctacgacgacagcaagttttgccgatacgtggagctgatttgcagccgcgagaaggcgcgtcggcgccaaatgagccgcgaagcggcgggcggagtgccagaaaggggaactgcctcgagcggcggcccaggaacacttgaaaggtccgcgccgcgccgcttgatcacggcagacgaggagcggcgcggcccagagcgtgtcggccgatttcgaaatggaggccctgatgatccgcggcgtgctggaggtccatacggatttcactagacagaatgtgatgatcatggagccgcaagtgctcgactttacggtgcgcggcgacaagctgtggctgcacacggagcacgggctgctggtctccatggccgagtaccgcagcgagttgctgtgcacctcggcctttctaggctactccgccgtgtttttgctcgagaccgaagacgccgtcacgcaggtgaggctctcggatctgcggctcaaacaccgctgcggcatcgtcaaagccgacaacctgctgcacttcgcgctctgtaccgttatttcgtgcgtggaaaattgcaacttaacgcgcaagtgcctgcacgacctgctccagtacctggacgcggtgaacgtgcgcgaaagcttcggccggctgctgcaccacagcgccaggcggctgatctgcagcgcgctctacctgctctttgaggaaaaagagccgcacattgtgcagtacgtgcccgctaccttcgtgctcttccagcagacgcggcatacctgcctgcagctggtagcacgcttctttttccgccttaccggtcaggacgaggcacactcgttcagcctcaagctgaccgagcgcaagaccgtggacggttggcccgtgggcctgggcctgctagacgtgctcaacgccaactaccccaatttgccctcaccccccaagctgccgccgcgctgggaacgaggagaggaagagtgagaagcgaactagacacgcatatcatagaaaaaaaaaaaacacgcaacacgtagtgagctttgacgtcccttttactagtatccacgtcacacgctaagagctttgacgcactttttttactagtatccacgtcacttacccacgtagttcccctacgtgactcgttaagcgttgagccggaaaaaccgcaggccctcggaagccacccgcttagcagcgtgttgcgcgtcaaccgccagcgagcgcacccactcgtcgcgctcctcgagccaagtcgccgacgaagaagaacaagacggaggagacaccgtcgccgtgcccgaagaggacgaagtgacggacggcaaggcggaggagagaacggaagaagaagaacaagcggtggtggaagcggtggaggacgacaataactctcgcgcccagacctccacgcaagccgtgagcatggcaaaggccttgtccacatagacgccgtagccgatatcggccgccaacgccgtatcgcgtgactgtacgatgatctggccctgctcggcccacacgccgtggaagggcgcgcagtcaatcaccccagcgtgcggccttacttcgttttcaccgggctggaagcgcagtaaccaaaagtccacgtcgttgcggcgagccacgaaacgaaagaggatctcgcggtacacggcttccagctcggacacgctcacgcgctcccgtaacagcgccggcagccggcccaggacatgacccacggccgagagccagtcgccaccggctgcgcagcaacagccacctaacgccgcgggcggcgtggagggagaaacccgatcactaccgccgttatgaccactcccggcagcggcatctagaccgccgccactcgcgtggtccgcgtcgcccacgccactaccaccgccgccgctagaatggcggtgagtgacgacgcagcccgcgcaacaagcgccaccgcaatgtcccgccgcgaaaccacccaccaccccgtggagcggactaccaccggcgccgccgttgccgtagaagaagttgaagggacccaccaaccgctcgtcgccccagaccaacagcacgccgggcgcgctctcttgaacacgacaggtgggacccggatcgtcgccgccaaaaagtttgcgccaataacagtcgaccacagtccgcacgcacacttcggccgagacgggtccgtgacccgaatagccgtcgtagacataaaactcgcggtggccgcgcgacagaacccacaaaaggccggccgaagcgcaggctgacgtaacgtgctcggagatgtagcccagcagactctggatctgccagaaagcgcgtcgcgagcgaaaacgcagattctcaataaacttttcacaaaccgcataagtgtggagtcgatgactataacgcacgtagggattgaagtcgcgcgcgcgtacacacttggccagcacgcgctcgaccaaatccacgatgagcactcgatgtagcgtggcgtcgcgaacgtgcacggtgaaagtggcgtcgtcgctcggcgggtgcgcaccgccggtgctgctgctgacttccacgacgttgttttcaccgtcgccgtcgtcacgtggcagcggcggcaacagccagcgacgatcgccgccggccggtcgctcgcgaaaagccgtggcattgagacgcacggcgccgccgccggcctcggtaccgaagacctgccactcatcctcgggcacgccgagcgagagcgcgcagggttccacctccagcttgccggccgagcccacgatgtcgggcaggccgcaccacgagagcacctcagccgccgcgtccaacgccgtctcgcgcattaacgtgtgcagaccgtggaccgcgtagacgggcacgggcgggaaaccgggaaaaaagaaagaacgggcggcgcccgtctcaaagaggtccggccccaggtagtcgcgtagcggcggctgcccagcgaaaccacggaaaagcacgtcgtaaaggtgagtccaggccgactgcagcaataaacaacactgctcgtcggtcactgccacggccacgaaaccgacaggcgtgaccagacgcagacaggtgcgcaaaaaacacacctcgcgcacctcaaagaggcgtgccaggacggcctcgtcgtcgcgctccagcacatacttgtgagtgccgacgcgaaacgacatggccaaatcgtaggcgtagtaaccgcgacgcaattttttgtgcgcgtgggtgccatactcttcggagacgcgttccgcggtatgcgtgaccacacgcggctcgtgcacttcgggatacgagccgatgaccactagcttggctacgtggaaaagactaagcgcgttcgacagcgctgcggtttccacgcccagtgccggtgcggcctccaaaatctccacgccactagcgtccgtctgaatctgcaccggcgtgaaggtgcgcgccaacacgcggattaacgcgctgccttctagcaacacgcgcgccaacacggcgctacgctgctctaggccgcgccgacgctcatcggcgtccgtagtcacggccgaggccagcgcagcgtagctggcgcgatgcacagcacgcacctcagccggcggtagacggtcaccgcgcaccacgaacgtgtgaagccgcggctcggcacggccgccacccagatccaaaaacagacattgtacgataggcaccgaggcctctagaaggccgtaccagctgagatgacagctggtcccgaacagggtgtacgggtggtggcggtggtgcagcggcggctgagcggtcatcctcggacagaagagagtcgcgaaggcccgcggggtcttttttcaccgaccgcccggacgtgctcaaaccgcgtcgtgagccgcggcggctcccatcgtagtatttaacgacccgcgagcctgtcgtcatcggcgcgcccccatcgcctcccgagcgagcgggccgccgctatcgccatggccccctcgcacgtggataaggtgaatacacggacatggagcgcttctatcgttttcatggtgctgacttttgtcaacgtcagcgtgcatctagtgctgagcaattttccgcacctgggctacccctgcgtctactatcacgtcgtggactttgaaaggctcaacatgtcggcctacaacgtaatgcacctgcacacgcctatgcttttcttagactcggtgcagttggtgtgctacgccgtgttcatgcagctcgtctttttagccgtgaccatctactacctggtatgctggatcaagatcagcatgcgcaaggacaaaggcatgagcctaaaccagtcgacacgcgacatttcgtacatgggcgacagcctcacagccttcctcttcattctcagcatggacacgttccaactattcacactgaccatgtcatttcggctgcccagcatgatcgccttcatggccgccgtgcactttttctgcctgaccattttcaacgtgagcatggtcacgcagtaccgcagctacaaacgctcactctttttcttctcgcgtctgcaccccaagctcaaaggtacggtgcagttccgcacgctcatcgtcaacctggtagaggtagcgcttggtttcaacaccaccgtggtagccatggccctgtgctacggcttcggaaacaactttttcgtgcgtacaggccacatggtgttagccgtcttcgtggtctacgctatcatctccatcatctactttttactgatcgaggccgtcttttttcaatacgtcaaggtgcaattcggctaccacctgggcgccttctttggactctgcggcctcatctaccccatcgtgcagtacgataccttcctcagcaacgaataccgcaccggcatcagctggtcgttcggcatgctctttttcatatgggccatgtttacgacgtgtcgcgccgtccgctactttcgcggacgcggtagcggcagtgtcaagtaccaggcgctggccacagcctccggcgaagaagtcgctgtgctcagtcaccacgacagcttggaaagccgtcgcctccgcgaagaagaggacgacgacgatgatgaagacttcgaggacgcttaaccccgccgccacccgcaccagacttggagacatggacataaaaaagagacacgcagaccgtgggtcgggagcacatacttttttttttattaaaggtttatctgttcttccaccagctactttacgtgtttcaaacagcacattagacacacgggggcgcaaacacacacaaaaaaaaaataatatacacacggagaaacacccacgggtgtcccattcccgactcgcgaatcgtacgcgagacctgaaagtttatgagttaagagggcaaggaggcggcgggcttttttgtcccgggggtgggtggacgttgtgaaatcttcttttggcgcggagtcctgggtgtgtcgggccgcggcagtcgcttagccaccacctggacgggggggaccgggggcggggacaggtaaattgaggtgtcctcttcgtctaggtcgtccgtctcctgcataatggagctttgctgatggtggtgatgttttgagggtttctttttcttttttgactgcttgctcggtttcggagccttgtcctcgcgaaacgtcgagcgcaccgcgtttttcttggagccgtcgtgggtggcctcgcggtggctgccgctactactgtcgtttcccccgcagccactaccgcagagccgcagcttctgttgccgctcctcgttatcgtcatcctccccgtcgtcatcgtcctccccttcgtccgaggaggaagtcggagggatgttgtcgtaggagcgtagagacacctggcgacccagagcatctttcaggggctcaccgggcgtggtaccgaactcacaacatattcgtttgcagagttcggcacccatatcggtaggttcgtcttgcgggacaggtcgcgactccaacggtctagcacggtagagacggcatggcgcgtaaactgagggtcaaagaccacgggcgtgacgatgagcaggagcgggatgtggtcgcagtggaaaacgcgaccgccggccagcaactcgcagcccagttcgctttcctcgcgctcgcggaagatggccgagaccaggtagacggtaggcaggtcgcggaaatcgatccgctccgggtccggatgcttctttatatagtattggctgagcacgtactgctgaatgagcatctgaaagtaatactggtgacgcggattgacaaaagccggcagtgaaaagcgcgctacctcgtacacgttgagccggcccagcagctcgggcgtgttttcgtcctcgaaaggtatcggcggcggcgaatcgcccgggctgccccgcaggtggtgatcagcgccgccgccagcggcgtcgcccgcggctaggccgagactcgcgttaatagtgatcgtggcgtccccgtcgctgttgtcgtcactcaggtgcttggcgtcaaacacgatcacttccgaacactcggccttattgagatacagcagatcggccaggtactcgcgcagcggttcgggcggcttgagcgggcgcgcgcgcttgagcgtggccctgaagagcgccgcgtcgtgcgaaagcagaaactcgcgtgccgacggggtctcgcgttcaccgcgaaactccacgcccggcaccgggtgtgactgcaacagcgaggccacggccgccgcgtcgtgcctccgcagcacgttctgcacaaaggggtcctcctttttgcgcaaatatttgtagcggcacttgatctcgtagacgcgcgcacacggttccaccagcaaggtgcgaccgctaccctgcttgagcacgccgaagcacaggtccatggaagcgcccagcagccccgacgtggggtcgatgagcagaccgaggccgtcgcgcaccggctcgcgtccgtgcatcacgtaacattccaccagcgttttgactaagccctcgtgtttgataccgaactggatgcccggcgagacgccggcgcgcgaacccgtgtagtgcgagccgccgccacccgaaccgtccgccgccgcggcgcccggcagacagccgctgacgaaggcctcgtagaacttggtggccgagaccgtgtccatacgcaacagatgccacaccgagttgcgcgactgtccgcgcgattccttttccagcaactggaagagctcgacctgccgatagttgggcgctaaatccagcaaccggctgagccacacgtagtcgtccgagccgccgtgccggtcgtcgcaccgctcggccacgcgctccagggcctcggcgatctcggcgcgcgaagcttcggcggcgtgccgctgacccaaaatgtcgcgcagaccctcgtcgcgagccagcgcggccacgcgcgtcataaagtcctcggctactggcgtaccgtgggcccgcagcatcttggcgaagatgcggtaggcgtaagacagacgcagcaccgtaaagggcagattacggaagccctcctggtgcagcaaaaaggtgttcatgagaaacagactgaggggctcatcgtcccaaaccgccagcagccgggtgagctcctcatcgtcgtcgtagtccaaactcgagacgccccacatgatgatggcggcgcctcggtattttccccgccggtgggtttgtaccttctctgttgcctttcccctcagcaaccgtcacgttccgcgtcccggttactcggggaacagttggcggcagtcaccgtcaaggtcctcctcgcagattatgctggtggtgcgccgaaaggcgttatataaatacagcccgtcgctcgtggccaacagacgctccacgttctttctgacgtattcgtgcagcatggtctgcgagcattcgtggtagaagcggcgaaaggcgcgtacgcgacacgaggacatcttggcctccacaaagcgcagcgtgtgcgacaccagcgcggcgccatgctcgcccaggagacaggcgccgtagctcatttgcgccgccagaatgagcagacaggcgtcggagcagtgcgtgagcttaccgttctccaacgcgcggcaggccgcgccggcgtgcttaaagagcaacgcctccgtgcccatgcgcacctcgtccagaccgcgccggtccaacagccgcatgaggcaaaagcccagcacgttacccagcgccgacagctccgacatgcaataacgccgtaggccggctacggggaaacgcgcgtgcgggtcgcagatgagcagcttctgcagcggcatgggtcggaaagcagggtggtaacattcgcgcagacggtgcgagcagttggggatgcggcgcgccgtacccgtctcctgaaagacggccacacagcgctcgttgtaatccggatagggctcgctgaggctgtaatcgcacagcgcggcgcgcacgatctcgctggggttgtgcgggttcacgtcgatgagcacgttcatgggtgtaatgtcaaagtggcatacacgacactggtgattgagaaatttgatagcgtcggccaacgtgcaaaaggcacgtcggtagctgtcgatgcacgccagcttccactggtcgtgatgaaacatgtctgtgtggaaacgtcgatgtaccgtgacgttgtgcagcagacagcagcccgtggccgtgagcagaccgcggtgcacgcccgtgcccaccagcgacggcggctgctgttgctcgccagcggcgcgcgtgcggatcaggcccgacatccagaccgtgagcaccgtctcgctgtgcttacgcgccaccttgaccacgcgatagcgatcgagcggccagacctcgccgaaggagccctggcccaggcggtagctctcgtcgctcatgtccacggcataacaaatcttgtggcaaaaatcgtcctctttgggcacgtagaccagcaggtaggagatagagagctcgcagagctcgggatgcgtaaggcgcaagaacatacgcgggtcgcacgtaaggccgcggatggacgtggtgatgatctggtcgttggaacaggtgcaatgcacgtcgtcgtgtgacgtggagtcggcctccaccgccgtggcggattcctccccggaactaccgctgagcggctgcggaatgcggcccgggcccgatgccacggcgctgtcctgactttccgcgcgcagctccacgtcgttttcttcgagcaccgcgtccacaccgcccacacgacgtcggcacagcggggtgcgggccagcgacaccaacggcggacgcaacgggcgtttgcgtccaccgcggacgccgctcacgctgtccgaggggtcgctgccgccggtgaagagagcgcggcgtacgctggtcacgtcgccgtcgcgatcgtactcgaacgaccacatggccgaagtttcgcggcagcgcaagccgtggtaaccgtcgccgctggcggcgctgccgcgagacgacgtggacggcactacgggccgacgcaggttctccttgtccgaagccgcgtcctctttttctccgtcacgcatcacgtcacttcgaacgcatgcggaaaaagtcgcgtgtccaagcacggtggttgtgctgacggaactcagggtggtcaaagtggtgacgccgccgccggcctcgtcggccatcagatccacgacctcgttttcatcaacgtgagcctgggcgacctgagcggcggcggcctgcgcggcctgcaccgcggcttgagcggcggcctgcgcagcttcgcgcatccactggcgccggcgcgccctgctgggacgacgcaatggcggcggatcccagccctgagtcgtcgttccgagcgaggccgagcgagcccgagaccgaagtgcggaggacatagtggcgacagtcttccctgttcctaaggctgcactagctaccacaccgacactgtcgttatgttgtgtttttttttaataaaatctgaacagaggcgtgacggagattgctatacctgttagacggcgtcgtcgacctccaggtccaaatcgcacgtcgccgaaaccgagtccaccaaggtggctctcacatcgtctaccgtgtccttcagctcggttaaagagtccagcgcgtcgtccacgttaccggattgcagctgtcgggcgcgttgcaactcttgctgcacggccgcccgttgctccaacaggtgtgcggccacgcactgcgtcgttcgctgactgtatcgggtctgttcccgagcggccacacgcatcaccgtcaaagcctgctgcgtggtgagccggtgctgcggtccgtaggtacgccgcagaaactgatgctgctgtcgctcaaggtcgacgcgcatcacgtcctttaagagctgtttgttgaccgacgtcatagattcaacgtgatgagacccgcgtcgttcagcgagagagcgtccagcaacttgccgacgtggtagacggggaaaagcgagacggtgctctggccgggcaagatgtggctcaaagtgacgtcggtgacagccgcggcgcagtcttggataacgatggggctataactcacggtccgcgcctcgtcacgcgcgagatctaaacagagacggttctgactgtagagcgcgcacaacaaacaggtgcgcgacgaggccggccaggcgggcacctcgcgccccgagaagcggccgcgcaccgcctgcaacacctctctgagacggtccagcgagacgggctttaaaggcaaatgcacctcgtcgccggcgtcatcgacccggcctgctgacgcgctcgtctcgaccgcacaagcgccggccccgccgccgccaccactaccaccaccaccacccgccgtcgtcgcctgcggcgtcggcgcagggaattcgtagccgcgataccaaacaaagacgtacagctcagccagattcatgtaggtcatatagtcccgcacgggttcgtaaaagagtttgggcaacaacgcggggaaaggacaaccgttcttttcgcgaccgaaacaagtgtcacgcgcgcaaaagctgcgcggtccacagtacagcagccacagcagggcctccacgtcgcacacgttgtgatgatctaacaagcccggcgtgtacacctgtcgcagcacggcttccacgtgttgcaccttgttgctggagagtgacagctccacgtgagccttgcgatacaacaggtaactgccgtagattaattcgccgtcgtaggtaacacggtcagcattgcgtaacgcataatcacgcacacaaagcgacggcaaaggcttagccgcggccgcgaaacgctccagcacgtcgtgtcgacgtagaaaagacggcgtggcggcgtcgtttttcggagcgcgtcgtctacgacggcgtttggcccgagacccaccgccgttcttttcccccgcggttttattcccgacgtttttctttttgtcctccggcccgctatcgccaccgctgctactgctatccaacaccggcacctcggccgattcgcgcggaattacgttggtgaccaacaagaaattctcgtcgggcgtttcaattaggcgaaagcgatcgtaaggtgacacggcctcgcaggccaccagcgccatatttacggcctcctcgaagcgccaagcctcggagaccgagaaatcggcggccggagactgcgccgacagctcgaccatccgttccaccgagcacagggacgttgaaaccccggcggaccccggagacctgacggcagttgagggggaggagacggggaaactgagaggagaggcggaggaagattcgtccgagcctgacgccgaggaagacgacaccactagggacgacgaagacgaacgagtgacggcgcccgtcccacgagccacgtccgcaacaacgtggttttcgggtggatcctccgtcgtcctcgcggccgccatctttttcctctcctctcgccgctgccgcctaacctccgctcgcaccaccgccgccgccatcatgttgcgcggagactcggccgccaagatccaggagcgctacgcggagctgcagaagcgcaagagccaccccacctcctgcatctccacggccttcaccaatgtggcgacgctgtgccgcaagcgctaccagatgatgcaccccgaactcgggctggcccactcgtgcaacgaggccttcctgccgctcatggccttctgcggccgccaccgcgactacaactcgcccgaggaaagccagcgcgagctgctgtttcacgagcgcctcaagagcgcgctcgataaactgacgtttcgcccgtgctccgaggagcagcgcgcctcctaccagaagctggacgcgttgaccgagctctaccgcgatccgcagtttcagcagatcaacaacttcatgaccgactttaaaaagtggctcgacggcggcttcagtaccgccgtcgagggcgacgcaaaagccatccgactcgaaccgtttcaaaagaatttattgatacacgtcatcttttttatagccgtgaccaagatccccgtgctggccaatcgcgtgctgcagtacctcatccacgccttccagatcgacttcctctcgcagacctccatcgacatctttaagcagaaagccaccgtgttcctggtgccgcgacgtcacggcaagacttggttcatcatccccattatctcgtttctgcttaagcacatgatcggcatcagcatcggctacgtggcgcaccaaaagcacgtgtcgcagtttgtgctcaaagaggtcgagttccgctgccgccacaccttcgcgcgcgactacgtggtcgagaacaaggacaacgtgatcagcatcgaccaccgcggcgccaagagcacggcgctttttgccagttgctacaacaccaacgtgagtagctccatgatgataacatacgccttgccacaaaccgtggcgagtccatgtcctccttttttttgttgtttcttgtttcttctccccgtgaactgtcagaccccgttagtgcactaggttcttaagcaccggacaggaacacactatcatacgtgacacaggttcctctaccttgaccaggtcccacacatcggtcttgacgggcagccatcggccctcagaatccttaacaccgatgtgataatccaggccgtctcccagtgtgacctgcgccgcggtcttagaacctacggcgcataggtacttggcgtcatcgctctcacagaaaaaagtcgcgggttcctcgttgtggatgagcgactgcgtcatgggcccacagggcacgtaacaaagacagcggcccatatcgggggtgcaacccacgtaattgccagtgggatctacgtgtccctcgtgatccgtgcaaaagctgcaacccgcctgcccgcaggccgtggccgccgccatgaggcgcgtcatggaagggatatcgcaccgattgccgcatgaggtaaacaggtcgtaacacagaatgtaaaagaaaagcgtgtagccttcgggacgcggcagcaaccaggcgccggcgccgcctagcgtcactgccttctgacaggtcaggtccatggcaccgtgacccttgaccaggatacgcttggcttcatcctggggcaccaacatgcagacctcgtaaatcacgtcgggcgtaataccatcgcacgtcatactgctggtcacctggctaaagcttggcaagaaatcgatgctggctggacccaaaggacctccgaagctcagttggtacaaggtaggtagatgacagatgcgtcgacgacgccgatgtacgtggttcacgccatagtggccttgataacggccgttgcagcaaaaacagatgatccattcgccgtcgcggtagagcaacagcaactggcataagatacacgagctgtcgtcctccggactaaagatcgtcgaacggcaagcgacggcccgatactcgcggtgtttccggctcttgccgaccagcttccacatgcattcctcttgcaagaactgcttcaaagttctggaatcggtctcgcaaagcccgctgcgccaagccatgaagagtgacgcgcgaagagacggcaaagccgcccggcagcacccagtaaaagtccaagtctggcgtgacgtacagcacgcacacctcgggctgcgagagccaacgtcgcaggcgtccgcggcgatcacggacgatccaaagcccggtgcgaggacaacgcgccgcgcgcacttccacgcccaaatccacttgcgcgcgaacgcagcgcaccacgtcagcgtaccaagtctgttcggcgggcggaccgctctcgttccgcggcccgaaaagcagctcctgcggtttgggcgccgagcgctcgcgctggcgacgagctcgctgagcggcagcggcggcaccccggctcagacgaggcgttagcgtcttaataatacagctacgcacgtccgcccaatccatccagagcgccaaggcatgacggcaaagttcccaaacaacgcgccaggacatgttccgtgacacgtggcaggcgaaacgctgtggcaacgcgccgccgtcccgtcgtagtacagcgtagatctcgtcgcgcacggcgcgaatcagcacgtactcgacggcgatgcgcgcccgataagcgtccaacgcccggtatagttcgacttcgtggtcatcgtagctcagctcgcgactgcgccaaaaggaattgacgtaccacagcacacggaggcgcacgcgatgctgcacatcccagacctcgcgaagacgcgagacaccggcacccttccactcgtccgtacgcgcgacctcgtcgcggtcgtgcggatcggtggcgtacatgaggtctggatttacgtccaggcgcagctgcaccaactcatgaccgcgtatcttggaaggcggctccaatggacccgcgtgatagatgaattcctcgtcgccgcgcaacaaacgcgctacccgctgctccaggttactgaatctgccgtcgccgttcgcggaggaggttcctgctccgttcggaatttcaaaaaatggagtactgacggccgtctccagagaagccacagccgcttcgggcaaacggcgatccgacccattgtctaagttattacgcagtccgccccgccgacggtgattcgtggtcgtggccaactggtgctgccggtcgcgcttattcgcttccatttcttctcgtaacaggtcacgcgctaaaaactcccagtcacgatagctgccgtcgggccagaccagtctcaggtgtagcgtctgcgcgcctgagagccgattatcggggcagcgcagacccaacgtagtgaagacggcatagaacatgcgcacgcgctgctctttctctaacgtcacagtgagaccgctttgacgtaggtaatcgagcaactccagtgggcgcggtagtacacgaaaacaggcccgctgccaagtccgccgctcgcggtcaaaagcgcgatcgccgcccacggcgtcctcggcgtcgtcggaggccggtgcgtcgtcctcatctccgcctggagcgcggcccgtggatcggccagcgctgtctacattacgatagtagacgtagcgcagcgtctcggcctcctcgttactcaacacctcctggtcgagcaccaagtgtagaggcaattgctcatcgtcagcgaaccgcgcttcaaacgccagatccgaatacaggtgcgtttccatattcggaacgcatctgtttcagaagcgcgtcctcgcgcttcttacgactaaccttgatgacacacgcgtcgtacttggtctgctttgagtagataccgatgataagctgaataaaaagttggctgatgacgggcaccgaaatacggttgacgttatgcatagaacggaaaaccttattaaaggtgaagtaaatactgtcctccacctgctttttgaggcggtcgcgctcgaccacctcctggatcacgtcggcgtaacggccggcgtgcgtcatgaggtagctgtacacgccgctgagcacggcgctgatgatgttgacgtcgtccagtgcggcctcctcgatgggttccaacaggtggctacgcgccaccggatagagagcctcgtataccaggcccgtcttgacgcagacggagccctcgagcgtggagacgagcgcgcagccgctgcccagatcacacaggtgcgtgcgaaagcagcgcgtgcacgcgtagagcgagtgtaactggatctcctcggtaaacgcgttctggacgtgcctcatgtcacaggcgcccgaggcgtcgcacatgacgtctgagcgccgctgacagttttgggggcggagggaacaggagaagggcagggacgacaggtgttgcttgtctccgcgacgttcacgtccgggtgactgcaggcgtccaggatgtcgttaacgcactccaccgtcaggtgctcgaacacggacgcgaccagttccaagcggcgcgggcctgactcctcggcctggaaaaggaaggaaaagtgttgaaagaggcggtcgacaaagataaaaacatcctccgtagtggcgtgcgcgacccctagtcggttgagttccgccagcaacgagttcatggcggctgtggcgggtcgcgacgacgacactttcgtttttatgggcgcgcgtcacgcggcgccggtgtcggcggattggttccggttttcaggtcgcagcccggttggcacacggcgatcccgcctcacctggcggctcacctggctcacctgtccggccccaccccgactctgtaggcttccagtcgagcgtgcgtaatcataagagtcccttttctgtctcctctctacacagagcatccgaggacaaaacttccacttgctgctggtggacgaggcgcacttcatcaagaaagaggccttcaacaccattctggggttcctggcccagaataccaccaagatcatcttcatatcgtccaccaacactaccagtgactccacgtgtttcttgacgcgccttaacaatgcgccctttgacatgctcaacgtggtctcttacgtgtgcgaagagcacctgcacagcttcacggagaagggcgacgccacggcgtgtccttgctaccgactgcacaagcccaccttcatcagcctcaactcgcaagtgcgcaagacggccaacatgtttatgccgggcgctttcatggacgagatcatcggcggtaccaataaaatctcgcagaacaccgtgctcatcacggaccagagccgcgaagagttcgatattttgcgttacagcacgctcaacaccaacgcctacgattatttcggcaagacgctttacgtgtatctggacccggccttcaccaccaaccgcaaggcctcgggcacgggcgtggcggccgtaggcgcctaccgacaccagtttctcatttacggcctagagcatttctttttgcgcgacctctccgagagttctgaggtagccatcgccgagtgcgcggcgcacatgatcatctcggtgctgagcctgcacccttacctggacgaactgcgcatcgccgtggagggcaacaccaaccaggcggcggccgtgcgcatcgcctgcctcatccgacagagcgtgcagagcagcacgctcatccgcgtgctcttctaccacacgcccgaccagaaccacatcgaacagcccttctacctcatgggccgcgacaaggcgctggccgtggaacagttcatctcgcgtttcaactcgggctacatcaaagcctcgcaagagctcgtctcctacaccatcaagctgagccacgaccccatcgagtatcttctggagcagattcagaacctgcaccgcgtcacgctggccgaaggcacgacggcgcgttactcggccaagcgccagaatcgtatctcggacgatcttatcatcgccgtcatcatggccacctacctgtgtgacgatatacacgccatccgtttcagggtcagctaggcacgcagcagagccaccaggtgccggcgactgacgccggcatcggcagaaacgagacgatcgtaacccaggcgcgtaaaactccccaagggcgaaaacgtttcggcgtagtcggctaacaaagcccgggccgccgccagcgtccgcgcctgcacgccgccgtgactgcgataataacggcgcagcaccacgttgacaaggtcgttctcctcgacgcgcggcggcggaggatccaaggcctccagcgcctcctggtgcaaatgcagcgaattgagcaacaaacacagacaggcggccagcttcatcgtcttgcgatgtagcagaaaaccgccgcttgcgcccgagacggcggcatcctcgggctttccggccaacatgcccagcatctcctcgcccatctcgtcctcgtccagctcgtaaagacagacttgacaaagaaaatagttctccagacgcggcacgtcgagcaagagcagcttcttagcacccgccagccccacgcagtgttccagcagacgggcggatgaacgcggaatattactcattcgcaaacggtgataagcgctggccaccacaccgtcaaacatgtccgaatcaccgcgcgtggcactctgcaacagcggcgctagacgctcctccatctcgggcggacaaagaaccagctcctcgtgcgagcgccgttccagcaaaaaaaaatattggcggaacgtgttcaccagggcgcgcgccgccgagattcgtcgctgcaccgtagtgatcacaacgtccggcgcccaaagcacgctggtacccggccaaataacgtgtctggggccggtgctgccgccgtcgttgacgcgaatcatataaatgcccggcacgtcgtacagctcgtccctgctgtcgtcgtctccccggcgctcctcaccactcgcatcaccgtcgcgccaccgtagcctactactccccaactgaccgcattccaccaccaacttggcgcaatgggtaatgcccgtaagcgcgtacaccagatcgctatgcttctgccaatagatggagaagacggacgacctgcggttaaaacgaccgctgcaataaaaacacagctcggaagcaaaaaccacgtcgtcttcggcgtcgggcggcggcggtaacacacggcgaatcagttgcgacagcggtccgttgcgaaacgcgtgctcgcgcaccgtaccgtcgtccattaacaacgccgcgtcgtgccaacccggcgtcggacgctcctccggacgaaacgccgcggcggcagcggccgcggcttccatcatcgtgatgcaaaccgcgctcgcggcgacgtgggttcagaactgccgtcaacgctgacggaggttgggacagaagggacggaggaagatgaggacacacacaatgggggaggggatgaacacaggcccgatgtggctgcggccgccgagcacaatcgaaacaacgtctggtggatcacttcgcgcgtgtgcggcgtaccgctgatactctgcaacgcgcccagcacctcgactaacactttgaggcgcgtgcgagggatcttgtgggcttccacgtgccgacacaccgtcagcacgttggcgttccggcccaggtgatccaatttgacttttttgttccgggccaggatcttgggcacgttgttggctagacgactgccgatgagcgcacaagtgtgcttgatcttggtgtgcgccgtgaggttcttgctgtagtcaaagagaccccgctgtgccgcctcaaatactaggcggtccaactgcagccgcttctctcgaccgtgcagcttgagcaggcaagcacgcagaaacagcactaactgcttggccaggaaggggatctggtacgaattgcgcagctctagttgcgtgaaaacacggtgcagaccgtaatcgatgcacacgtcgcgcatgttcttgatgcacgagagttctttgagcagaatggcttccaggtcggcgcccgagacgcgcggcacaatggccgtagccgctttgaaccagcccacgttgacgttgttagtatgcgagatcatgcacggaaagttggtggtccagtacaccttgctgcgctccgagcgaatcaccgcctggtcctccagcccatgcacgtccagcgaggagttgctgttgcacaccacggccggcagaaaaaagtgatcgatattaacgtgcagccggtacacgcccagcgagtacagaaactcggggtaggaaccgcgaatattgacgttgagcgagttgatgtagacggcgtcgttggaaacaaaagtgctgacggtgcaagcgggctccttaaaggtgtgcttgtacatcacaaaactgtgggtcatgttcttgggaagccgcggcgcgcgtacgccgagacccgacgcggcgatggacgagagcgcagccttcatattgataacgcggttggtgttgaaagcgttgacggcgatgcggtctagactcacgcccgtcacctcggcaaactccatcccgccgatgagcttacgacggcacggcgcgtaacgctgcacggctagatgtttacgacgtcggtgttcctgataggcccggcgcagctgctgccccgtaaagtcaaatggcggcgtggcgtcagtctcccccgattccagcgtctcttcctcctcctcttctcccgtctccgaccgccgttgacagtgtttacgccatctctccccgtaccgagcgtacatgagacgcgagataatgcatacgtaacgtcgaacgcgatctgcggccgggtcgcgcggcagtgacagcttgtgacccgcgctcgtcgtcgggagcgcggtggaagacagcgcgtgtccgttcgccgaaaccaccgtcgattctgacggtgacagtcgcgacgtcctcgaagcgcaagaaacaccgtaaccgcggcttacgggtcggtcctccgtcccatgggaccccagatcccgagctagttcgtaataaacgtagaaaaggtttctccacaccgtgtctgtgtcggcaaatgtgacgctaaggcgtcgataacacagtaggttgtggtgtccctgatttccaccgttcccccctcccccacttctgtcagcgtgaccagtccggcacttgccgtagctcacctgtagcttgaagtacagtacctgtcgcttgaagcgactgagaacgaaggtgctcaggtggcacaccgtctgctcgggcaagcgaagcgccatcatgacgcgggcgcggtcgcgatgcagctgagccagtacgcgaccgaaaaactccgacgtgacttcgtggtgatattcaacgcccagccaaagcttttgcagctccagcagaaaaaagtcgcgtgtagcgtccaacgcgcacggcgcttgcggacgcacgttgagtccaaagagcagcttgtagtgaacctggatgcgcggcgccgcggcctcgcccaggtagccggagacggcggttacgtagtcgtctacctcgctgacactgagtacgcgtccgatttccaccatcaggtaaggatagtcgtccaggtgcaggctgaggtcgcgcggcaggcaggccatagcgtagcgttcctcggttcccgaggcgccaccgccgccaggacagtcgcaaaagaggctcggcaattctcgattccattccgtcagcgagagcaatccgcgtagcacatgcgtggccacgtggttttcgagaacgtggtaggacagcgcgcgcccggcggtcacggatccgcaacaacaacgtcggtgcacgtagagcagcggcccgcgacaaaactgcgtcgtaggtaccagatgttcaccgtggccctccacttcaccgtcgcaaaaacagggtacggccacgggtcccagtaacagacgacccagtaccagcttgacacgctcgggctcggtcctcacgtgtatcggacaggcacggtagagagccgcaaaaacagcgcgcacccgttcgacgttaacgggtcgcggacgacaaaagcgggcgtcctcgcccgtcgatagctcttgggtgaggttgcaggcgcgaacgtgcacggggacgtgtaaaacccggcgcggcatagcggagccgccaacgactattagagcgtcacagccgaggcggcgcggcgcagcgccggccattctccgggtcgcgctgctttccccgagctccgacgcctcgcgctcacgccgccgccgcgatggagaactggtcggcgctcgagctcctgcctaaagtaggcattcccactgactttctgacgcacgtcaagaccagcgccggcgaggagatgtttgaggccttacgcatctactacggcgatgaccccgagcgttacaatattcacttcgaagccatcttcggcaccttctgcaatcgcctggaatgggtttattttttgaccagcggcttggccgcggcggcgcacgccatcaagttccacgacctcaataaactgactacgggcaaaatgctgttccacgtgcaggtgccgcgtgtggccagcggcgccggtttgcccactagtcgtcagaccaccattatggtcaccaaatacagtgaaaaatcccccatcaccatccccttcgagctcagcgcagcctgcctcacgtatctgcgcgagacattcgagggcaccatcttggacaagatcctcaacgtggaagccatgcacacggtgctgcgcgcgcttaaaaacacggccgacgccatggagcgcggcttgattcacagctttttacagacactgctacgcaaggcgccgccgtactttgtggtgcagacgctggtagaaaacgccacactggcgcgacaggcactgaaccgcatccagcgaagcaacatcttgcagagcttcaaggccaaaatgctggccacgctctttttgctgaatcgcacgcgcgatcgcgactatgtgctcaagttcctcacgcgtctggccgaagcggccaccgatagcatcctagacaaccccaccacgtacaccacgagctcgggggccaagatcagcggcgtgatggtaagcacggccaacgttatgcagatcatcatgtcgctgctctcaagccacatcaccaaagaaacggtctcggcgccggccacctacggcaattttgtactcagtcccgaaaatgccgtcactgccatatcctatcactcgatcctggccgatttcaactcgtacaaggctcatctgacttcgggccaaccgcatttgcccaacgactcgctttcgcaggccggggcgcacagcttaacgccgctgagcatggacgtgatccgactgggcgaaaaaacggtgattatggaaaacttgcggcgcgtctacaaaaacaccgataccaaagatccgctagaacgtaacgtggacctgacgtttttcttccccgtagggctgtatctgcccgaggatcgcggttacaccacggtggaaagcaaagttaagcttaacgacaccgttcgcaacgcgttgcccaccacggcctacctgctaaaccgggaccgtgccgtacaaaaaatagactttgtggacgcgctcaagacgctgtgccacccggtgctgcacgagcccgcgccctgtctacagaccttcacggaacgcggaccgccctcggaacccgccatgcaacgactgctcgagtgtcgttttcagcaggaacccatgggcggtgcggcgcgccgcataccgcatttttaccgcgtacgacgcgaggtcccgcgcacggtgaacgaaatgaagcaggactttgtggtcaccgacttctacaaggtgggcaacatcacgctctacaccgagctgcaccccttcttcgactttacgcactgccaggaaaacagcgaaacggtggcgctgtgtacaccgcgtatcgtcatcggtaatttgccagatggactggcaccgggccccttccacgaactgcgcacctgggagatcatggaacacatgcgactgcggccaccacccgactacgaagagacgttgcgacttttcaaaaccaccgtgacaagccccaattaccccgagctttgctacctggtcgacgtgctggtacacggcaacgtcgacgcttttttgctaatccgcactttcgtagcacgttgtatcgtcaacatgtttcacacacgtcagctgctggtttttgcgcacagctacgcgctggtgacgttgatcgccgaacacctggctgatggcgccctaccaccgcagttgctctttcactaccgcaatctggtcgccgtgctgcgtctggtaacgcgcatctcagcgctgccgggacttaacaacggtcaactggctgaggaaccgctatcggcttacgtgaacgcgctgcacgaccaccggctgtggccccccttcgttacgcacctgccgcgtaacatggaaggcgtacaggtagtggccgaccggcaaccgttgaacccggccaacatcgaggcgcgacaccacggcgtttcggacgtaccgcgtttgggcgccatggatgccgacgagccgctgtttgtggacgattaccgtgccaccgacgacgaatggacgttacaaaaggtcttttatctctgcctcatgcccgccatgaccaacaaccgggcctgcggcctgggactcaacctcaagacgctgctagtagacctcttttaccgaccggcgtttctcctgatgccggccgccaccgcggtctccacgtcaggtacgacgtcgaaagagagcacaagcggtgtcacccccgaagactcgatagcggcgcaacgtcaagccgtaggcgagatgctgaccgagctggtggaggacgtcgccaccgacgcacatacgccgctgctgcaggcctgtcgtgaactgtttttggccgtgcaattcgtgggcgagcacgtcaaggtgctcgaagtgcgcgcgcctctggaccacgcgcagcgtcagggcctgccggactttatctcacgtcagcacgtgctttacaacggctgctgcgtcgtgacggcgcctaagacgttgatcgagtacagcctacccgtacctttccaccgtttctactcaaaccccaccatctgcgcggcgttgagcgacgacattaaacgctacgtgaccgagttcccgcactatcaccgtcacgacggtggtttcccgctacccacagccttcgcgcacgagtaccacaactggctgcgctcgcccttttcgcgttactcggccacctgtcccaacgtgttgcactcagtcatgacgctggccgccatgttatacaaaatctcaccagtttcactggtgctgcagaccaaggcgcacatccacccgggattcgcactcacggccgtacgcaccgacaccttcgaggtggacatgctgctctacagcggcaaatcatgcacgtcagttatcatcaacaaccctatcgtgaccaaggaggaacgcgacatcagcactacgtaccacgtcacgcagaacattaacaccgtagacatgggtctgggttacacgtcaaatacctgcgtagcctacgtaaaccgcgtgcgaaccgacatgggcgtccgcgtgcaggacctctttcgcgtcttccctatgaacgtgtaccggcacgacgaggtggaccgctggatccggcacgcggccggcgtagaacggccgcaactgttagacacggagaccatctctatgctgacgttcggcagcatgtccgagcgcaatgccgccgccacggtgcacggacaaaaggccgcgtgcgaactaatccttacgccggtgacgatggacgttaattactttaagatccccaacaacccgcgcgggcgtgcctcctgcatgctggccgtcgatccgtacgacacggaggccgccaccaaggccatctacgaccatcgcgaagcggacgcacagactttcgcggccacacacaacccctgggcctcgcaagccggctgtctgagcgacgtactctacaacacccgacatcgcgaacgtctaggctacaactccaaattctacagcccttgcgcgcagtactttaacacagaagagattatcgcggccaacaaaacgctcttcaaaaccatcgacgagtacctgctacgcgccaaggactgcatccgcggcgacacggacacgcagtacgtctgcgtcgaaggcacggaacaactcatcgaaaacccgtgccgtctgacgcaggaagcgctaccgatcctcagcaccaccacgctggcgctgatggagaccaaactcaagggtggcgccggggcttttgctacgtccgaaacgcactttggtaactacgtcgtaggcgaaatcatcccgctgcagcaatccatgttatttaactcgtgaggccgtccggtgaggaggacggcgacgaccgcaggttagcggcgagtcacctagacgcaaacgcgggcccggacgcgccacgctcgctctgacgccgcgcccggtgcagacgttgttcgtctctgcctctcctccgtcgcggccaggatttcaccgccgctatggcggccatggaggccaacatcttctgcactttcgaccacaagctcagcatcgccgacgtaggcaaactgaccaagctagtagcggccgttgtgcccattccgcaacgtctacatctcatcaagcactaccagctgggcctacaccagttcgtagatcacacccgcggctacgtacgactgcgcggcctgctgcgcaatatgacgctgacgttgatgcggcgcgtagaaggcaaccagatcctcctacacgtacccacgcacggactgctctacaccgtcctcaacacgggacccgtgacttgggagaagggcgacgcgctatgcgtgctgccgccgctcttccacggaccgctggcgcgcgagaacctgctgacgctgggccagtgggagctggtgctgccctggatcgtacccatgccactggcgctggaaatcaaccagcgactactcatcatgggcctcttctcgctcgaccgttcgtacgaggaggtaaaggctgccgtgcagcagctgcagaccattacttttcgcgacgccaccttcaccatccccgatccggtcatcgaccagcacctgctgatcgacatgaagaccgcctgcctctccatgtccatggtggccaacctagcctcggagctgaccatgacctacgtgcgcaagttggcgctagaggacagctccatgctgctcgtcaagtgccaggagctgctgatgcggctggaccgcgagcgcagcgtcggcgagccgcgcacgcccgcgcggccgcagcacgtgtcgcccgacgacgagatcgcgcggctgtcggcgcttttcgtcatgctgcgacagctggatgacctcatccgcgaacaggtcgtcttcacggtgtgtgacgtttcacccgataacaaatccgcgacctgcatatttaaaggctgagccggccctctcgcgcccgcagacaccaagcatgccacgcgtcgaccccaaccttcggaatcgggcccgccggccacgagccagacgaggcggcggcggtggcgttggcagcaatagcagccgacacagcggaaaatgccgccgccaacgccgagctctgtcggcgccgccgctcactttcctcgccaccactaccaccacgaccatgatgggcgtcgccagtaccgacgacgacagtctcctcctgaaaacgccggacgagctggacaagtacagcggctcgccgcagaccatcctcacactgacggataaacacgacatccgtcagcctcgggtgcaccgcggcacctaccatctgatccagttgcacctcgacctccgacccgaagaattgcgggatcccttccagattctgctctctacgccgctgcaattgggggaagcgaacgacgagtctcaaaccgcccccgcgacgttgcaagaagaagaaacggcggcttcccacgagcccgagaaaaaaaaggaaaaacaagagaagaaagaagaggacgaggatgaccgcaacgacgatcgtgaacgcggcattctatgcgtggtctctaacgaggattctgacgtgcgcccggccttctctctctttcccgcacgcccaggctgccatatcctgcgctcggtaattgaccaacaactgacgcgcatggccatcgtgcgcctatcactcaatctcttcgcgctccgtatcatcacgccgctgttgaaacggctaccgctacgacgtaaagccgcgcatcacacggcgttacacgactgtctggcgctgcatctgccagaactcacgttcgagccgacgctggatataaacaacgtaacggagaacgcggcttccgtcgctgataccgcggaatcaacggacgcggatctgacgcccacgctgacggtgcgcgtacgacacgcgctgtgctggcatcgagtggaaggcggcatctcggggccgcgtggactcaccagccgtatctcggcgcgcctctcggaaaccacggccaagacattgggaccctccgtctttggacgattggagctagacccgaacgaatcaccgccggacctgacgctgtcgtcactcacgctataccaagacggcatattacgtttcaacgtgacctgcgaccgcaccgaggcgccagccgacccagtggcgtttcgcctgcggctgcgacgcgaaacggtgcgacgacccttcttttcggacgcgccactgccttactttgtaccgccacgctccggcgcggcggacgagggactggaggtgcgcgtcccttacgaattgacgctgaagaactcgcacacgttacgtatctaccgccgcttttacgggccttatctgggtgtttttgtaccacacaaccgtcagggactcaaaatgcccgttacggtctggctaccgcgctcctggttggaattaaccgtactggtgagcgacgagaacggcgccacgttcccacgggacgcgctcctggggcgcctctattttatctcgtcaaagcatacgctgaatcggggttgcctgtcagcaatgacgcaccaagtcaaatccacgctacactcgcggtccacatcccattcgccgtcgcaacagcagctctcggtgctgggcgcttccatcgcgctggaggacctgctgcccatgcgactggcgtccccggagacggaaccgcaagactgtaagcttacggaaaatacgacagagaagacgagtcctgtcactttagccatggtctgcggcgatctctaaacagaggaccctgataatgggaaacggacactaggcgtccgcgccatacgggattaaaacaaaaaaaaatcggtggtggtgtgtgatggggtgtggtgacggtggggcttcgcctcttttttttgtaataaaaaaagacactcaataatccgcggttgtctctgtgtagaacgtttttatttcgggttccgcgtttggtcgcctgcctatgtaaggcggcggccgcagagggcgcgccgctcagtcgcctacacccgtacgcgcaggcagcatggagtcgcgcggtcgccgttgtcccgaaatgatatccgtactgggtcccatttcggggcacgtgctgaaagccgtgtttagtcgcggcgatacgccggtgctgccgcacgagacgcgactcctgcagacgggtatccacgtacgcgtgagccagccctcgctgatcttggtatcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaggagcccatgtcgatctatgtgtacgcgctgccgctcaagatgctgaacatccccagcatcaacgtgcaccactacccgtcggcggccgagcgcaaacaccgacacctgcccgtagctgacgctgtgattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctgacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcagatcttcctggaggtacaagccatacgcgagaccgtggaactgcgtcagtacgatcccgtggctgcgctcttctttttcgatatcgacttgctgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgcaagacgccccgcgtcaccggcggcggcgccatggcgggcgcctccacttccgcgggccgcaaacgcaaatcagcatcctcggcgacggcgtgcacgtcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggaattcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggttgagccacccgccgcgcacgcgcttaggacgactctataaaaacccacgtccactcagacacgcaacttttggccgccacacctgtcaccgctgctatatttgcgacagttgccggaacccttcccgacctcccacgaagacccgttcacctttgcgcatcccctgaccctccccccatcccgccttcgcaatgtctcaggcatcgtcctcgcccggtgagggaccctcgtcggaagcggccgcgatcagcgaggccgaagccgccagcggaagctttggtcgcctgcactgccaggtgcttcggctcatcaccaacgtggaaggcggctcgctggaagccggtcgtctgcgactcctggacctgcgtaccaacatagaggtgagccggccctcggttctctgctgttttcaggagaacaaatctccgcacgacaccgtagacctgaccgacttaaacatcaagggccgctgcgtggtgggcgaacaggaccgactgctggtggacctcaacaactttggcccacgacgcctgacgccaggctcagaaaacaacacggtctcggtactggcctttgcgctgccgctggaccgcgtgcccgttagcggactgcacctctttcagagccagcggcgcggcggcgaagaaaatcggccgcgaatggaagcgcgcgccatcatccgccgcacggctcaccactgggccgtgcgactgaccgtaacgccgaactggcgccgcagaaccgacagcagtttggaggcagggcagatctttgtcagccagttcgcctttcgcgccggcgccatcccgctgacgctggtagacgccctggagcagctggcctgttcggaccctaacacgtacatccacaaaacggagacggacgaacgaggccaatggatcatgctgtttctgcatcacgactcaccgcacccgccgaccagcgtgtttctgcacttttcggtttacacgcatcgcgccgaggtggtggcgcgacacaatccgtacccgcacctacgacgcttgccggacaacggcttccagctgttgattcccaaaagttttacgctgacgcgcatacatcccgagtacatcgtgcagatccagaatgctttcgagaccaatcagactcacgacaccatctttttcccggaaaacatcccgggcgtctccatagaagccggcccgctacccgatcgtgtgcgaatcaccctccgcgtcacgctgaccggcgatcaggccgttcatttggaacaccgacagccgctaggccgcatccactttttccgccgtgggttttggactctcacacccggtaaaccggacaaaatcaagcgtccccaggtgcagctgcgcgccggtctctttccacggagcaacgtcatgcgcggcgccgtctccgagtttctcccgcagtcccccggattaccacccaccgaggaagaggaggaagaagaggaagaggacgacgaagatgacctctcctccacaccgacgccgacccccctgtccgaagccatgtttgccggcttcgaggaagccagcggcgacgaggactcggacacccaagccggactgtccccggcactgatcctgaccggacaaagacgtcgaagcggtaacaacggggctctcacgctcgtcatcccctcgtggcacgtctttgcgagccttgacgacttggtaccattaacggtgagcgtgcagcacgccgcactacgacctacctcttatctgcgcagcgacatggacggcgacgtgcgtaccgcggcagacatcagcagcacgttgcggtccgtgcccgcgccacgaccctcacccatcagcaccgcttccacttccagcaccccacgcagtcgaccccgcatctagagagagacttctttgtttttcccccgcgtgtttttcccattccctgtatttatttctaaataataaaaacacagagacgttgataataaccgcggtgtgctttattagggtatcacggtgtagaaaaaaaagagagggaagccctaaatatagcgtctctcttactcgagcttattgagcgcagccacaaaaatccgccgattcagatctaccatgtctttgggcgggctctgggaagctgcggcggcttgggcagcagcggcggctaacacgacactagccgggcaggaagaagaacctgccgtcgagggcccggccgttgccgcctcagaacccgacgcggtagcgaggcggcaactggcgttcaccacgccggcctgagcgcgctcagctaccttggcacctccggatagaagtgccgtgggtgtttctcctccgccactcgtcagctcgccggtgggagtacacacggtagtagtagttggggaggaagaggccgcagagggaagagccgccgaaagtaacgtagaactctgccgcgcagcaaacagatcgcgtttcagctcgtgaatggcatcccgcagttcatcgtaacgttgttgctgctgctgattggaacccgcgtgcccgccacttccaccgtcgctattgacgtgactttttagacgctttcgtgcccggccgtgctcggcctcgcctgggaaactcaagtcttcgtccgaggacgacgacgacgccgccgcggtttccttacggcgtttgttgtgtccgccgctgcccccgtgacggtgctgcttctgcgactgaccacggtgaccaccgtcgtaacgctcccatccggacggtggttcatccataccgcccggagagtcgcgccgacggtaataggccggtgatggtggcggcggcacgggataagacggatgcaaagacggcgcgggctcgtaacgccgaccccacccgggataatggggatccacgtagtccgcaaagtgacgtgccgccaactggtcgtaacccacgacgggggcgccgtaggacgcgggataagacggcaaaggcagcggtgctggcgaagcagaaggaggggccgctacggcgccgggatacatgacgggcactgccgagcgactggccccaagtagcgagaaaaaagcgtctttgggtaaataaactccgtcgtgaggccacgctagagacgacacagccggcgacgcacctgccacggtagcacctggaggagccgtagcggcgggaaccgcagcactcagagggtgcgacatggacgccgcctctgccggctccgagggagaaagcgacggcggtgattccgcgggaagaacggacggcgacgctggaagcgcaggcggctgtacaggagatggcggttcgactggaggcgacggggacgaagagggaacgcgcgccccagccgccggcgtggcggcctgactgcggctgtcgcccgaacgctcggcggacgccgctttaatatcgcacgccgcctcaggcgaaacgctcgccttgacgtatgactcgcgctccgtcacgccgactagttgcttgtcgtagcgcagcttgggcagtcgctcacggatgtagagcgcgtccacgctgttgcccaacaggccgtagctgtctgagcgaaagggatcgcccgacgcgtcgacagcagtgctgccgcagcgctgccactgtgcacgtagcccgtcacggtcggccgccgtgaggtctggaaaccgctgtgtgacccactcgggatcgcgcccgtacacggccaacgtaccgcgacgccgacccacgctgcacaaagccacgtgtttgaacggcgtggtttccgagcccgaaagcgacgtcgcggcctccacgtcgtcgcagcgccggctggagagcgagaggccggcgtagctgccgctgagaaactccaccaccttgtctggctgcagcggactgacgggcccgcgcgaaaccagctcggacttttccgaagcgcggcgtacaatctccagaaacctgggcgaagtgacgcagcccaggcaaaaaagaccgtcgcggacgctctgcatcgccgcaacgtgtcctacaacggccgtgtcgtcgtggttgatgttgagcgggagcgcgaccgacaacgaaggctgtccctggccctgcgcgtgcaaccagtgctccactacgtcccgcggcaacagcaattcggcctcgtccggagactggtcgtagcgggcgagaaagccgcccacgtagaccggcgccacagcctgcgactgctgctcgtccatcgtcattgtcgtcaccgtcgctacccgctcaccgagcgaacgatgatggcccgcgacgaagagaaccccgccgtcccgcgggtccgcacgggcaaattctcctttacttgcgccaatcatctaatattacagattagcgagaagatgtcgcgcggacagccgctgagctcgctgcgtttggaagaactcaagatcgtacgcctcatctgcgtcctcctctttcaccgcggtctcgaaacgctgctactgcgcgaaaccatgaacaacctgggtgtctcggaccacgccgtgcttagtcgcaagacgccgcaaccctactggcctcatctgtaccgcgaactgcgccaggccttcccggggctggactttgaggcggccgtgttcgatgaaacgcgcgccgcccgtctcagccagcgcctgtgtcacccgcgcttgagcggcggactgctgacgcgctttgtgcagcgccacaccggcctgccggtcgttttccccgaagacctggcgcgcaacggcaacatcctcttctccctaggcacgctctacggacaccgcttgtttcgtctggcggccttcttcacgcgccactggggtgccgaagcgtacgaacccttgattcgcatcatctgtcaaaaaatgtggtacttttatctcatcggcaccggcaagatgcgcattacccccgacgccttcgagatccagcggagtcgacacgagacgggcatttttacttttattatggaagattacagaacgttcgccggcacgctgtcccggcacccgcaccgtccgcacccacaacagcagcagcaccaccaccccggtcccccccatcctcctctttctcaccctgcctcgtcctgtctcagcccagaggccgtactggccgcccgcgcccttcatatgccgacgctggctaacgacgtgtgaacctgacgtgatttatctgccacttttctccccgctgccgtacagcgccgccgctcataatgccgtcaccgtcgcgtccgacgcgacggtgttttcgccgtcggtgcagaggacggaggaactttcggccgaaacatcgatcgtagtcccaggacacatttcggaagccatgccttccgcgtgctccaccaacgtggctttctccgacgtggttgtcgttaccacaacggccgccgacgtcgcgtcggcgtaacaacggctggaggactttttcaccgcctcggcgacgtctcggacggacgtagaaaagtaacacacggccagctccacgctatacatagcccgcttcaacgcctgcaccaaccgacgtacgaaatgaccgtggcagctttgctgacatctctcgaccagataatcaaaggagtcatccagatccttggtgggctcgcgggagaagaacgcaatgataaagagcggcagaatgccaagacgcatggtgagaagggtacgcgtagccaattccacgtaatccataatgccgaaaccggtgccggccgcgctagcgggctgcagtacaccgcgtaggactctgaagcagtagtagggcacaaacagcatgagacacgtcacgtagaaggtgcagacacgacccacgtaggaccagacgtggtcgcgccgatcgctgtaggccaactctaccacgttagccagtacggcgatcatgggcgcccccagcaaaaaccacatcttgatggtgaggtccaccgcggcatactgtatagggatctgacagcctagccaacggtagtccagtgaacccgtagcggcggtgggcacagcggctacgatgaaaagaacccaggcaaaggcgaccgcgtagagcgccacgccggcgttttcgcgcgtctcatgatgccagagatcacggccgtaagatatggccgacagacgatccagtatcagaaagaggaaaaacaacgccgtcgaatataggcccacgtcgtcgacaaagagcactaagcgacagaggctgagatttagagcgccacgcagcatgatacccttggacaacatggtggccaggatggaaaaaaactgactaagtaccagattccaagtaaaaatcatcacggacacgggcggccgcgtaacacgcaacacccagaggcaaccgatgatagtcagcaggttgaccaggctaacggagccgaacatgccgatgagtagatccgaggcggcgcgatcggccgacatagagtagccttcgaacgggcccatgtgtttgaaactcacaatagcgaacatgatggactcggtgactgaggtagtctcctccacagaaggggacatacccaccaccgccgcccgctctcgccgaacgaatataccctctccgaggacgttcgccctttatgcagcgagcgacacgtggtggaaattacaacaccgccacgctcggaagaaaccccaacactaaaaagtacaacagttcgtaaatatcgttgacgttaaagagggacgagcccagagtggacacacggtgacgcggcagggtcactgacaacagccgccctagcccgtgttcgtagtgaaagagcagggcatcgtgtacctctaagcgacgtaaatcgccgtactgtttggagctctgcgcgaacatgtagtcggccacggggttgctcttgctgagctgcatgagcacggcgccgccgccgtcgccacctccggcgctgtcctcgcgacgtgagggatcccagccgctgcgcacgctctcggtcacggccaacagagccaggccgggaaagagctgcgacagcgtgaccgcggggtcgcgcgcgtaccacggcccgatgtagtaccgtaccagaaactcaaagttacgtacccgcccgtgccgtcccccgtagccctcctcttcgccgcccgcgcgccccccgggcaacccgccgccggctacggcatccgaacccagcaggtcggccaacgtaaatttgcccgtgcgcggagcgaagacgctatccgcgttggtcaccttccacaacaacagcaggccagccaggcaggtcaggcccgaacgcagatattgctgttcgtgcacaaagacgggcacgtcgcgacccagcttgccgaccagcagacgtcgactccagagagaaagcacgtcgtcgcgcacctggcccgacagacgctcttgcaccagctcctccgttatcgtcccgtagcccggcaaatgctgaataacgccgcgtttgtggaaaagccgcaccagcacgtgacgatcaaaagtgcccgggtgatagtgacgaccaccgcttaggggcatgtagtagcgtagatcgggcgagtcgcgatacgcgtaatagttgttacccgcggcgacggggccttcccaagcggcaatctcacgactcacgtcgtcggccagacgcggcaacagctgagggagctcacccaacaccgtcgccacggagtccggcggatcgcggccctcccaaagcgcatgtccgtaggcggccagcagacaggcggcggcttccaaatcggagagtacacagtcgtacgtcggatacaccgtcacgttttccaaagcgttgaccacgccgagcagcagctcctgcgaaatggaaaagttgtccatctgcgccagatggtacactcgtttccaccgtggttgcgtgtacaacccccgcttgagccgatagtaccagataccaaaggagaaagtccaagtagaggcattctcgaacatggtgttgaccacctcgccgcgaaaatcggtgtgaaagcggataaagggatcgttctgcgtgattccaaagtagctaggtacgttcccgggcaacggccgctcggcgcactgcgccagccaggtagaagaagcaccggcggccgctgacgcggcgaccgcgtcagacggggcgaccacgtcagacggggcggcggcgggtcccgtgatggcatcgtgccgactataaagaccgtgtgggacggcagaagctcctgccacgccggtccctggggacgaagaacgcggacgacacggtggttgtagcagcgtccgcggcgacggtccttcgtcgagctcgcactgctggttcaacagcgcctccgcctcggacacgcgcccttcgagatcctcgcagtaagtctgcaccctgtgacccagatccctgagctcctgacgcagataccgtttgcgcacccggtccatgagcacgtcctcgcgccagcccccgccgcgcattgtcaccgccgcgtcctccagcaaccgccgaagcacgcgctcggggcagcgcagcacgttttcctcgtgcggttcgaagaagacggcgacgggtagccgccaaaaggtgtgcaacagactcatcctgacgccgtcccagatagtccaggacagaatcggtacacaagtcgaaacggcccgaacgaaaagcccggtaaaaagatgggcgatcggccttttgctgaaaaaaaaccagactgggcactacgctccagacttgaccgccaccgcgcggcagacgcagaaaatcaaagtccaccaaggcgcccttgagctggcgcaggccctcggcgtactgcaggctgtgggtggcgtgccaccgcacggactgatcgtcggcgtctgagtacgtagttttgaactcaatcacgtagcaatacacgatgccgcgcgacccagagtccggcggtaaaaacaccaacacgcagtcgggaatccgccgacttaatcgtacttcgatgaaaagacggcgacggtacttttgcagctcgggtgggaaaaggcctcccaacaggcggttgagggccacaaacgagggaaagacccgcaacaggcgacggtagatgtccaggtgcttacgcttaccgatccgcttacgcacgtgaggcaatctccgcagagcgttccccgtcgaatcagcgtcgtccccacgcccggacggcatggcttacccgcgtgtcccctcttcttccttcgcagcggccaatgacatcgtattaaatagacagagacgcgacttttgtaacccgtagcgccacacccgggtgccccttcctgggatcctttctctccttctctcgggtgtaacgccaaccaccacctggatcacgccgctgaacccagcggcgcagccgcgctatgcggcccggcctccccccctacctcactgtcttcaccgtctacctcctcagtcacctaccttcgcaacgatatggcgcggacgccgcatccgaagcgctggaccctcacgcatttcacctactactcaacacctacgggagacccatccgcttcctgcgtgaaaacaccacccagtgcacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctagaaagataccaacagagacttaacacctacgcattggtatccaaagacctggccagctaccgatctttttcgcagcagctgaaggcacaagacagcctgggtcagcagcccaccaccgtgccaccgcccattgatctgtcaatacctcacgtttggatgccaccccaaaccactccacacgactggaagggatcgcacaccacctcgggactacatcggccacactttaaccagacctgtatcctctttgatggacacgatctgcttttcagcaccgttacgccctgtctgcaccagggcttttacctcatggacgaactacgttacgttaaaatcacactgaccgaggacttcttcgtagttacggtatctatagacgacgacacacccatgctgcttatcttcggtcatcttccacgcgtactcttcaaagcgccctatcaacgcgacaactttatactacgacaaactgaaaaacacgagctcctggtactagttaagaaagctcaactaaaccgtcactcctatctcaaagactcggactttctcgacgccgcactcgacttcaactacctggacctcagcgcactgttacgtaacagctttcaccgttacgctgtagacgtactcaaaagcggtcgatgtcaaatgttggaccgccgcacggtagaaatggccttcgcctacgcattagcactgttcgcggcagcccgacaagaagaggccggcaccgaaatctccatcccacgagccctagaccgccaggccgcactcttacaaatacaagaatttatgatcacctgcctctcacaaacaccaccacgcaccacattgctgctatatcccacagccgtggacctggccaaacgagccctctggacgccggaccagatcaccgacatcaccagcctcgtacgcctggtctacatactttctaaacagaatcagcaacatctcattccccagtgggcactacgacagatcgccgactttgccctacaattacacaaaacgcacctggcctcttttctttcagccttcgcgcgccaagaactctacctcatgggcagcctcgtccactccatgttggtacatacgacggagagacgcgaaatcttcatcgtagaaacgggcctctgttcattggccgagctatcacactttacgcagttgctagctcatccgcaccacgaatacctcagcgacctgtacacaccctgttccagtagcgggcgacgcgatcactcgctcgaacgcctcacgcgtctcttccccgatgccaccgttcctgctaccgttcccgccgccctctccatcctatctaccatgcaaccaagcacgctggaaaccttccccgacctgttttgtctgccgctcggcgaatccttctccgcgctaaccgtctccgaacacgtcagttatgtcgtaacaaaccagtacctgatcaaaggtatctcctaccctgtctccaccaccgtcgtaggccagagcctcatcatcacccaaacggacagtcaaactaaatgcgaactaacgcgcaacatgcacaccacacacagcatcacagcggcgctcaacatttcactagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtcctagaagtaactgacgtcgtcgtggacgccaccgacagtcgtctcctcatgatgtccgtctacgcgctatcggccatcatcggcatctatctgctctaccgcatgctcaagacatgctgactgtagaacctgacagtttatgagaaaagggacagaaaagttaaagacattcacacaaaatcttctaaaacggtacgggccccaatacttaggggcactcttgctcgttgtaataaagtacacgccacacggtgtgatggtactatatgcgtgaggtctgtgcgtctttatttacgaggtactgttatgggtctggttacatatcgggccctggatacaagcttggtacacagccaaggtgcgggagactaggtcgtcttggaagccgatgcaacaacggtagatgagcagcaaaacgaccagaatcagcagtgagtacacgcaggcaagccaaaccacaaggcagacggacggtgcggggtctcctcctctgtcatggggagaaaagagatgatggtgagagacgtccctaagatggtgtttctaatatctatatctttcttgcttgtttctttcataaactgtaaagttatgtcaaaagcgctttataatcgtccttggaggggcttggtactgtctaagataggcaaatataaattagatcagcttaagttagaaattttgagacaactagaaacgactatttctacaaaatacaatgtaagtaaacaaccggttaaaaatctcactatgaacatgacagagtttccacaatactacattttagcgggccccattcagaattatagtataacctatctgtggtttgatttttatagtacccagcttagaaaacccgcaaaatacgtttactcacagtacaatcatacggctaaaacgataacattcagacccccaccttgtggtactgtgccttccatgacttgtctttccgaaatgctaaacgtttccaaacgtaatgatactggcgaacaaggttgcggtaatttcaccacgttcaaccccatgtttttcaatgtaccgcgttggaacaccaaattgtacgtgggtccgactaaggttaacgtagatagtcaaacgatttattttctaggtttaaccgccctgcttttacgttacgcacaacgcaactgtacacacagtttctacctggttaacgccatgagccggaatctatttcgcgtccccaagtatattaacggcaccaagttaaaaaacactatgcgaaaactaaaacgtaaacaagcgcccgttaaggaacaattcgaaaaaaaagctaagaaaactcagagtactactacgccatacttttcctatacaacgtctgccgctctcaacgtcactactaacgtgacttatagtattactaccgccgcaaggcgggtttccacgtctacaattgcttatcgtcctgatagcagctttatgaagtccattatggccacacagttaagggacctagcaacgtgggtgtataccactctacgttaccggcaaaatcctttttgtgaaccaagccgcaaccgaaccgccgtgtcagaatttatgaaaaacacgcacgtactaatccgtaacgaaacgccgtacactatttacggtactctcgacatgagctccttatattacaacgaaaccatgttcgtggaaaacaaaacagcttccgatagtaacaaaactacacctacgtcaccatcaatggggtttcagagaacatttatagatcccctgtgggactatctagactcgctgctgtttctagatgagattcgtaactttagcctccggtcacccacgtatgtaaaccttaccccgccggaacaccgccgggctgtaaatctgtccaccctcaatagcctttggtggtggttgcagtaaagttctggaagcagcaatgtcgtagtacaatacaaaaagctcccatgagaattagagcattaagcatagtccaccaggccgcaaagctggacagtgagagctcatacatatgcgatgtgcaatgcgccttgtaaaaatcatcgttcgcatgtcgtctcatcacattaggatcgtgggtggtagaactgagtttagtgctagttgtcgataaggtcgtagtcgtcgtagttgttgcagaagttgttgcaactgttgttagtttggtagttgatacgctagcagaagactttgatgtagttgcagaggttgacgtggatgaattgttaccagaactctctgccactaccgataaaactaaaagacctaatactagtgtgttccactccatcacaccaccgccacgatgcttacgatgttgaccgaccgaatcgactctcaactggtactgtcgcggctgccgcgctcccgttttcagcgattctgggagacccctacgttaataatgaaggaagagtccgcatcgtcatcaggctccatcatcctagccgagaaatccgtcaacatgcgttactgcgtgcgtttcgctagcgatagcgattttcaaaccacatttacgctgccccaatcgaccgaggagaaatacgacaaagagcagcatccgggagaggatgaagcgtcgtcgccattaccgtcaccgctcaaagttccttacaagtggatgccttccagtttcatcgtcaaacaatgccacacgcagctggccttttacaataaacacatcatttggctatcacgcgagcgcaaagtgcccacctcgctgggcgtcagcctctatatccccgaaggttttttcggcattaccttttacaaatgcctggacgcgcaattcgtttgcatgcccgagctgctggaatccaggctgcaagtcccgcagttggatgtcgtcaacctcaacgacacttttcagtccatctttccgggcaccatcgaaggcgatatcggcgttttcccctgttttgtaccagaaccctggcagctcatgaacttgccgccgcccaacgaacaccgtttcttttcgttacgtacccgtcagacgctggtgatcggtccgggtcacacgcaaaccgtctattttgacgcggcctacgtgcacgcgcccggtatctgcgccctcatagtgggcgtgcgccagtttagtcaatcggatctcatcatccgacccaccatctggctcccgggtaccgcggccggcgtgacggtggtcaacacttcgcacaccaccgtctgcatctccccacacaccaccgtagccaaagcggtttttaccacccaccgctttacctatctgccggtgggcagtcaccccctaggacagatgatcgtgccgcccacccccgacatcggtttcacccacacgcccgagcacgcgttgctgcaacggacaccctcgccggtagacgatgacgtcgacgagacagaagaagatgaaaagagctccgacgcagaaagccctgtcaacacgaatgacgttatttttgacgtcggcccgaaacctccccgtcatccctgacctaataaagtacgtctatgagaaaccccgtactcgtcgtgtccgtgatcacgtacgttttccaaaacgtgccaggctgttcacgcggaggacagcaaggccgccgccgtgggtttctttttcttcacgcccctgagttcacgcgcggaacccacaaagggtatctggggaggaggtatggtgaccatggtcggtgacatcaccgcctcccgaggcacgtcggggctgtgtcgcatgagatccaaaatctcgcgttcgtgattcgtaggcagcgtctcttgcggcgccgactccttgtagcgccgacggtgagacccgcgtccctggggctgctgctgcacgggctcgaccggcggctgctgttgcacgggctcgggtgacggcgacatcacggtcacttcatcctcctcgtcgccctcttccagcagccgctggtcgaacctcataacggtaggacaggagacggtgttaatgtgagccaaactcatcataggacgcgtgacccccgtttcctcggggatcagcgagtccgaaaccgagggacaggcaaaggccgacacggcggcaaccgtttccccgtcctcgcggacgccgctttccccctgaacgaccgccggtggcgtcagtggcgcaaccgtcgcagccgcgccggcctcgagcatgtacgcgcttttctcgcagtccatgtccaccaggcccataacgcgctgcacctccaccagcgaggcctgatccgtggagaacttgtccagcaacatctccaggctgtcggcctcggacatggcaaactcgcccaccaccagtttgaggatgagaatgtccagggcctctaggatacgctgcgatttcttgcactccacctcggccgccggccgcgtgtgaggcaaacagccctccgagagatagcccttgaggaacgcgcacttgctctggcattgcctatagagcggcagcagcttcagcaggtggttcaccacgtccgtgtcgcgagaaaaggttcgcaggtcggccggggtgatctccagctgcttaaagttctcgtccagaaacgcctgcagctcgcgcagctccacgtcctcgctaggctgcagcagcacgtaatcggccacaggcgcggctttgcgacggcacatcagcagctcgcacaggcgctgggccagctgcatcgtgccggcgcgacgatgacgctcgttctgttcgcaacagagtatgattctgctcatatagtcgccaacgtactctcgcagacaccgacggaccactgcgtcttccccctgctggtcaaacaccaggtctcgcgacgtgtttacttctgcctacagacgcaaaagtgctcggactcgcggcgggtggcgcccgtcttcgccgtgaacaacgaaacgctgcagctctcgcgctacctggccgcgcgccagcccatccccctctcggcgctcatcgccagtctggacgaggccgagacgcaaccgctctaccggcatcttttccgcacgcccgtgctctcgcccgaacacggcggcgaggtgcgcgaattcaagcacctggtgtactttcaccacgcggccgtgctacgtcatctcaaccaggtcttcctctgccccacctcgccctcgtggttcatcagcgtcttcgggcacaccgagggccaggtgctgctgaccatggcctactacctattcgagggccagtacagcaccatctccaccgtggaggagtacgtgcgcagcttctgcacgcgcgacctgggcaccatcatccccacgcacgcctccatgggcgagttcgcgcgtctgctactgggctcgcccttccgtcagcgcgtgtccgctttcgtggcgtacgccgtcgcgcgcaaccgccgcgactacaccgagctagagcaggtggacacgcagatcaacgcgttccgcgaacgtgcgcgtctgcccgacacggtctgcgtgcactacgtctacctggcctaccgcacggcgctggcacgcgcgcggttgctcgagtaccggcgcgtggtggcttacgacgctgacgcggcgcccgaagcgcagtgcacgcgcgaaccgggttttctgggccgccggctttccaccgagctgctggacgtcatgcaaaaatacttctcgctcgacaactttctacacgactacgtggagacgcacctactgcgtctcgacgaatccccccactcggcgaccagcccgcacggcttggggctggccggctacggcggccgcatcgacggcacgcacctggcgggcttcttcggcacctccacgcagctggcgcgccagctcgaacgcatcaacacgctttccgagtctgtcttctccccgctggaacgctccctgtccggcttgttacgtctatgcgcctcgctacgcacagcccagacttacaccaccggcacgctaacgcgttactcgcaacgtcgctacctgctacccgagcccgcgctggcaccgctgctggagcgaccgctgcccgtctaccgcgtacacctgcccaatgaccagcacgtcttctgcgccgtggcctccgaaacctggcatcgcagcctctttccgcgtgacctgctccgtcacgtacccgacagccgtttctcggacgaggccctgaccgagaccgtgtggctacacgacgacgacgtggccagcaccagccccgagacacagttctactacacgcgacacgaagtcttcaacgaacgtctgcccgtcttcaattttgtggccgactttgatttacggctgcgcgacggcgtctccggtctggcgcgacacaccgtctttgagctatgtcgcggactacgacgcgtctggatgaccgtatgggcgagcctctttggctacacgcaccccgaccggcacccggtctatttcttcaaaagcgcgtgcccacccaacagcgtgcccgtggacgcggccggcgcgcctttcgatgacgacgactatctcgattaccgggacgagcgcgacacagaggaagacgaagacgggaaagaggataaaaataacgtcccggataacggcgttttccaaaaaacaacgtcctccgttgacacgtcacccccttactgccgctgcaagggcaaactggggctgcgcatcatcacgccgttccccgcctgcaccgtcgccgtacaccccagcgttttacgcgccgtggcgcaggtgctcaatcacgccgtctgtctcgacgccgaactgcacacgctgctggaccccatctcgcatcccgagagcagcctagacacaggcatctaccaccatggacgctctgtacgtctgccctacatgtataaaatggaccaagacgacggctatttcatgcatcgccgtctgttgccgctgttcatcgtgcccgacgcctaccgcgaacacccgctaggctttgtgcgcgcccaactggatctgcgtaacctgcttcaccaccacccgccgcacgacctgcccgcgttgcccctgtcgccgccgccacgcgtcattctcagcgtacgcgacaaaatctgcccctcgaccgaagccaactttatcgagacgcgctcgcttaacgtgacgcgttatcgacgccgcggtctcaccgaggtgctcgcctatcacctgtacggtggcgacggcgccactgccgctgcgatttccgacacggacttgcagcggctcgtcgtcacccgcgtgtggccgccgctgctcgagcacctcacgcaacactacgaaccgcacgtcagcgagcagtttaccgcgccccacgtcctcctctttcagccccacggcgcctgctgcgtggccgtcaagcggcgcgacggcgcgcgcacgcgggattttcgctgtctcaactacacgcaccgcaacccgcaagagaccgtgcaggtgttcatcgacctgcgcaccgagcacagctacgcgctctgggccagcctctggagccgctgtttcaccaaaaagtgtcactccaacgccaaaaacgtccacatttccatcaaaatcagaccgcccgacgcgcccgtgccgccggcgaccgccgtctgagcctcactttccacggcgccggtgacccgccccccggcagcggtctcatctatatatacatcagcgtgcccgaacgtgaccttcctagcgacggcggccatggagctgcactcacgcggccgtcacgacgctccgtcgttatcttccctgagcgagcgcgaacgccgcgcccgtcgcgcacggcgcttctgtctggattacgaacccgtgccacggaagttccgacgcgagcgaagtccaacctcgccgtcgacacggaacggagcagccgccagcgaacaccatctcgcggaagataccgtcggcgccgcctcgcatcatcaccgaccctgcgtccccgcacgacgaccccgctacagcaaagacgatgataccgaaggcgatccggaccactatcctcctccccttccaccctcctcccgccacgcactcgggggcaccggcggacacatcatcatgggcaccgcgggcttccgtggcggacatagggcgtcctcctctttcaagcgacgcgtggccgcgtccgcctcggtgccccttaacccccactacggtaagtcttacgacaacgatgacggcgaaccgcaccatcacggcggcgattcgacgcatcttcgtcgccgagttcccagttgtcctacgactttcggttcttctcacccctcctcagccaataatcatcacggatcgtccgccggaccgcaacaacaacagatgctggcgcttattgacgacgaactggacgccatggacgaggacgaactacagcaactcagccgtttgatcgaaaagaaaaaaagagcgcgtctgcagcgcggcgccgcctcgtcgggtacctcaccgagttctacctcgcccgtttacgaccttcagcgctacacggccgagagtctacgtctggcaccctaccccgccgatctcaaggtccccaccgccttcccgcaagatcatcagccgcgcggtcgcatcctgctgtcacacgacgagctcatgcacaccgactacctgttgcacattcgtcaacagttcgattggctggaggaaccgttgctgcgcaagctggtggtggaaaagatcttcgccgtgtacaacgctcccaacttgcacacgttgctggccatcatcgacgaaacgctcagctacatgaagtaccaccacctgcacgggctacccgtcaacccgcacgatccctatctggagacggtgggcggcatgcgtcagctactcttcaacaaactcaacaacctggacctgggctgcatcctggaccaccaggacggctggggcgaccattgcagcacgctcaaacggctagtcaagaagcccggtcaaatgagcgcctggctacgcgacgacgtctgcgatctgcagaagcgtccgcccgagaccttctcgcaacccatgcaccgcgccatggcctatgtgtgctctttctcgcgcgtggccgtctcgctacgccgtcgcgcgttgcaagtcaccggtacgccccaattttttgaccagttcgatactaacaacgccatgggtacctaccgctgcggcgctgtctcggacctgatcctaggcgccctgcagtgccacgagtgtcagaacgagatgtgcgaactgcgcatccaacgcgcgttggcaccctatcgtttcatgatagcgtactgtcccttcgacgagcagtcgctattggatctcaccgtctttgccggtacgacaacgacaaccgccagcaaccacgccactgccggcggacaacagcggggaggagaccaaattcatcccaccgatgagcaatacgcaaatatggaaagcaggacggacccagcaacgctgacagcctacgataaaaaggacagagaagggagtcatcgacatccctctccaatgatcgccgccgctcctcccgcccagccaccgtcgcaaccacagcagcactactctgagggcgagctggaagaggacgaagacagtgacgacgctagcagtcaagatctggtacgagccacggatcgacacggggacaccgtcgtctacaagacgaccgcggtccctcccagtcccccggcgcccctcgccggtgtccggagtcaccgtggtgagcttaacttgatgacgccgtcgccttctcacggcggcagtccaccccaggttccccacaagcagcccatcatcccggtgcagtccgccaacggtaatcacagtacgacggcaacccagcagcagcagccgccgccgccaccaccaccaccaccggtaccgcaagaagacgactcggtggtaatgcgctgccagacgcccgattacgaggacatgctgtgttacagcgatgatatggatgactaaaaagagagtgaagggtgttgtgcgtgatgattgctgtcccttatcccgttacaaagaaaagaaaaaatggtgttacacactccttggtactactatgacccgtggtgagatatccgatgatgataataatgatgtacgcgtgcctgagcttggtgttttttctctctgtgagcttttttccccataagctgtgtactgttcgtgtccggaccccatacacggtttccgttaatgacggccccctccttttcccccaccgtaaaaaaaaaaacaaagcacaatacacatgtggttttttggttcgaatcgagcttggcgtttatttcttctcgagccccacgtcctctccctcccattctttttatatatacacatgcccaagattgggggggaacgtgtgtcgtttccaggtcgtggtgacgatgatgatgtggtttttatcggggtggtagtacaagggtttgctactgtagtcgaaaaggtgggccgagaacatagaggaactaactcctaagcgatggctcaaaggcggatgagcaaatcattaaaatccttgactgtctatggttatgcaaaaggatatataaagtataaatagcgtatataaaaacatatatctatgtacaagacgcatgggataaataacacgtatttacacatttttctgcacatgtacaacatttgaggacgaggagacgacgaccggccggtcgccgccgccgcggttgctactactttcttaagtgatgcgaattggtggctatggtgaggagtttggaggaaataatatacatcatatattctgatgacagtgtagtaaacatttcactggcttcggcccggtgcgacggagggccccgacgtcccctctcccggaggggggaagaggcacgacgagcgagggccccgtcgtacgaggaacaagaatctccttcattctttcacagtaaagcacatttctttatgtggggacgggaatcgatgtcatttgtgtatttgcattcggtagagagctacagtctccagtttcacgatcgttgtgcatcatacaacgacactttttatcctacaaatttcacacctatctatatacacacaatataaggttatagcatcatctagtttgttcatttcatacctgttgagaacgtttatgttctagcaattgatttcgcgtcatagggctgtgacggtgattcttcagagaatcagaaaaaaaaaagaggctcaacgagcaccaaaggctaagtcggaaaactcgcgcccgcttccccggacggtttcggcttagcctctggcctgcgatggtttttttattccaagttcgttccatgaatagagcgttatacgattgtgttttcgtgtcattcagacgtggttgatcatgttactacgtgtgtgttttttgctttggtcggtacacggtccctttcagcggacccagtgttccttggagagacgaaaagcgagcgtgtttcacgagatggctgatgccgagtgtcgtcgacataagtcattttctaaagaagcaacataaaaaaaagatgatgtggttcgtcgtactcacagtctcgtttagctactatagatattatagatccagagagcgtaccgcccgagagaacaccgtcttctccgggacgtcttgccgtcgtccgtcacccgggcgtcgagatgttcgtagagaacgatggaggacgaccaacaccgacaggtggtgctcatgagggtgtggtgtcgatggtgcgttttttttgcctcggcacgaccgtatttgcccgtcttaccgcacctccggaaagatggtgtttttacgcaggtgggtgaggcagtttttttttcagatgacaacgatggtaccgatagagcctgagatgatgatggctacgaaggacgggcggacgggcaaacgatggtgagaggtcgccaccgaggggtgcctttttttttctggtcagatggaacgtcgtcggtctcgagcgccccccgatgtagggccgctctcttacgtatcccgggtcgattcagactgacaaaaagagcgtccagagacgcggtctctttttcttctcgaacggaaagtccgaatcctacacatttctagtcgtgacggctagctttttggtggtcatggcggtggtggtcaacatatatctccagatacaggagatgaggaaaaaaaaggaggacaagtctaacggaataatatccgatcatatatatggagggatatcaggtcatcattgtgtatcaaaagatgatttgtacaacagggaaggatacggttttaaaggttagtgcagagaaactatataaagagcgtataacatggagttcattctgtcattaaaaaggttctaagtagagcatattaaaaatagacgagagctagagttttattcttggttcatcatatattttgtaaaaaaaaatagaaaaatataggtgccggacgccggctacgtcccagtccggggcttagagcacccaaacgcaggtttcccccgttttcaaacacctcaagatcttttgagaaacacatatttttgttatacacagtgaaaacgtggggggacagagttccaaacacgtgtctatcaagcaaaaattcagacgatataaatatggagagttttttcttcttatacaacagcgacagttcggtgtacatagcgtataatatatataggtcacatacagacttatgagctttttaccaaacagatgcaaatcgcctaccggaggcgggatcgggcgtgaggttctggctgcacccgcccgatccctcgtcggcttctccggcggctgtcctaaaatgactaggttcgtatatagagctataggtctttcatgatactgatgagaaatctatggtttgcgcgtcttatctgaatatatctagcacgatatagacgatacacgtcaagatcattgtatcacttcttttcgtctacgtggtaagagtcttggatactaaatatgtatataggcagcatttatagtttcaaaggatagaagatagtttttggacactgatagatatggcgttgttgagcggttgtgttggatgaacttgtcatcattctgtattttttcacataaggtgttcttttcttcgagcagtttataaaaggggtcaggcgcgatgactagagggcgcactttgggtgcggtcctccatcgcttgtcaacaaccggatgtgactcagcgagcacgagatggtttgacgtcagcgaccgttagccctcagggcgaaaacaggaagagtcgcctcgacagcgccctctaggtagcatcacggaacaggcggcgaccgcggactcgcctcggccagggggtaccgaggcggtgcccgcgactcgcccctcctccaagatggcgccgctcggccagactcgtcgagattttcagggctatcattttttcgctctgagcagaaaaaagctcttctaaaacgtctcaaaaaaaagcacagaaaagttatcgtgctatttttttacccgcctggagcaaaaacgctcctaggctctcgacgccattttctctcgtccgccatgtcggagctcagaacggcatgacgagcgagagaaccgtcgagaaggtcaccaagatggcgccggttggggtgcggtcaaacggtgttttacagtttcggggccatttgaacagagaaaggtggggaattttaagggacacggttttgtcggatgggggagaagatcgcgccctgccgtcatattgtcgtctcgatttttttcggccgtctgcacccgtatcggttcacgggttttccacggcaaaatcggagaagggaaaaaaaggtggggcctgttcccttcccgggtctcggacgagtcgacacgccgggtgggacggtcgtggtctcctcggcccgtgccgggaccctccccgtggattcacggtgttccggacccctccaggaaagggtggaaaacgcgtggagcccacggggacgtgcgttcgtgccggggaaaaaacccgactgggcctgaaccaacgttgggtgacctgccgggcccatcgtgtggggacggtgattgtggaggggcgtactgacgacaattgaggtgtcatggcggcccaccgtcgaccccgagcgcttccggccacacccaacctcgccgccgcatcggccagcacacacgccacagcctggtggggtccgaggcgccgaccccggctgggcggccgatggggggaggggagtgggggaccacgcccagggccagcaagccgcgacggttcgggcggagtttttttggggagcagcgggggaggggagcgtcacgggacaggccaacgcccaggataaggcggaccgagagccggcggctaggccgagggacccccggtcacgactggcggccggaccctcgagaggggggaggggagcccaaccggagccgccgagagggagccgccgcgagacccggaagccgtcgcggtcgaccccgctcccggagctcctgaccgggcccccagcccccaaccttccgggaccgattgccgtcgagccggggcgtcgcccgtccccaccaccgtccacccggcccacctaccgtcgtcgtcggccgaccgccgcgacccccagccggaaaaaaaaagcccgcaggggcccaaaagccagcaaggcgggccgggaaggggagctgggtgggggatccccggtcgcccaccgcggaacgagcctaggaaccggggtccgcgacccagccccccgtggggggaggggaagggcgcgacccggtcccgtccattccgcggcgggtggaccggaagccggcggaggtcgccgggagcagcgagggatcccgggccggagcccggggaggagcggggtgggggtgggaagcccccgctcgggtccccccgggccacggacgggaaccgggaccccggtgcgggggtcccagcccggccgggccgtcggatgggggggtcgagcggggggaggggagggacccccggccgaggtccggagcgggccgcgcccggtgcccggcccacggccccggatggtgctccagggcggtgggacgggcccgcggacggaccggcgccgggcctcggccgggggggtcgagcggggggaggggagggacccccgccgaggtccggagcgggccgcgcccggtgccccgcccacggccccggatggtgctccagggcggtgggacgggcccgcggacggaccggcgccgggcctcggccgggggggtcgagcggggggaggggagggaccccggccgaggtccggagcggccgcgcccggtgcccggcccacggccccggatggtgctccagggcggtgggacgggcccgcggacggaccggcgccgggcctcggccggggagggtggggggtagggcgggaggcaggcgggagcgggcgcagcgtgcggaccgcagcacggccggaaccctgccgcggactgcgccggggggcggcgggcacgccgggttttataggttttcagatgccccgcctaggtgggcggagcggtaattttccaccgccgcggcccatgcccggcacggggctcgcgctccctaggtgcggccgcccagtggaaaaataccggcgcatgcgcacggcgcacatctagtggaattttaccgacgcatgcgcactgaccgcctctagtggaaaaatactggcgcatgcgcacgacacacacagtggaattttaccggcgcatgcgcagggcgaccctcccgcgggccctggcccgcgcatgcgccccggggcccctggttcacccctccttatatataggttttccatgcggcatccccggcgcatgcgcactcgagtcaccatcccataatccgcgtggcaacgccctgacaaccaaaaactcgccccgactgcgcatgcgcacggaaacgccgtcccattggaaatcatggttgcccaaatttggtaaaaatttgccccccccggttccggaggagaagggggggggtgaggggggggggttacggtggttcccgttccgccagtccgttttcgtagaacgtttcgttagaagaattatgctatatagggtatgcatcctaggggtggaagctaggctccgcccctacggggcgtcgcctagcatccggtatacgtaaaacggactgatgacgtagctcgcttcgctcgctacgtcatcagagatgatttccgccggagatgacgcacgcatacgtgacgtagctcgctacgctcgctacgtcaccgtatgtccggaattccacaggatgacgtatatccggagtgggtgtggtcacgcgagtgtgacgtaggcttgtcaggggtcacgtgagaagcggcggcgttaagtttactaggccaaaacagaggaagggggcggataccctaggtaagggggcgtgcacgtagccctgtagacactcccccctagggtccagtagcttatgacgcgtatccgggagtagcgtctacgtcagcaggtgtatatttccggtagacggagaagcctgtacgtacaccgaggacggtggaaccctaacgggttccacctatctgaaatttccgtacaaggggtggagtctagggaggggtcattgtatatccgtttctgtgattggtagataaggtggcgtacctaggggtgtggctgtatacgtaagcggatatggctacacgtaatgggtgtggcttcactagggatcgctgtattctaccgcgcgcgtgcgtgcgcgcgcgtgacgtaacaaatcaccttgtgattatgacgttggcatctggcaccgcctcttgggcggttctacgggcctcgcttcctgcgctgatggtcacgtgaccaacaaaagtgctcaccgcctcgccggccacggggttgatgcctgttcttatgccgacaccagatggcgctcgttgaccaggaaagctgtctacgcgggttttacagtgtgtttttgcgtcattgtgacgtagagccggcgatcgccacattcgatggtgtacgctcgccgccagatgtcgtcagattgtacccaaaaccccgttatgattacacgctggcttccgcattcttgggcacggcggtttcaggttacattacatcaagacgcgacaacgccccgaataaaaacaccgggcaccgttatgtatacacgacgtcgatactgatcgccgtagtgacgtcagtcgacacacaacaccgttccccatcacggtgtttcatggcaatgggcgaaagttactttttacaagacgaaaaatgtgttttttggtaaaaagagggggatgggaaaataaaaacacacaattttaaagttcggatcttttcctgttttattgactcgtaaactgtaaggtcttcgagtacgtgtcgggggtctgtgccgcgtacgtgttcgggaaaccacgttacgcggtttgtgtcgtgttgtgacgttgagataacacacaggtttggcgcccgtaggcgcgcgggtttttggggtgtgtagcttgtacggcgttttgtcggcggagcgcagcgaaaatcggtggtgatagcggcgattgaggttgcgagaccagattcatcgcgcttgtaccaccgtggtgcggtgtttctgcttgtaaaccgtcaggcggttctttgtgatttaaaaacaccgtgttcgtgaaacgtgacttttcacggtttgttagctgatgtgattttggaggtcacaaacaccgtacggtgttttcggggatcgggattgggatttgcctgtgtatacgggtgacggtaggacagaaaacgccgttttctagggacggtgttttcacgtgccctgtgtggggtttttatgtgctgcttgtgcgactgagtgggaaaacggattgtgatcggacggtgtgctgaggataaacgacgtgctcgactaccgacgttagttggcggtgacgcaaagccgtcccgaacatcacgctattttcgcgggcgggtgcgtcggctagcggtctggctgcgagaggctacctgaccgtagcggttagcttttcttacgaattgctgggatcgttgcggttgtcgcctttggtggtccgcaaccgcagccagaccgcagtggtggccacggtggtgtctcagacgtcgtgcgtcaaacatgacgtgctgaacttttccttggtataaaattcactcagtggcggcgtagccattgtcttccgttcatccaccatgagccacgaggaactaaccgcgctagcgccggtggggcccgcggcttttctctacttcagcaggttgaacgcagaaacgcaggagattctggccactctctcgctatgcgaccgttcctcgagcgtggtgatcgctcctttgttggcggggctcacggtggaggcggatttcggcgtctctgtgcgcacgcctgtgctttgttacgacggcggggtgctcacgaaagtcacgtccttctgtccttttgcgctctactttcatcatacgcaaggcatcgtggcttttaccgaggatcacggagacgtgcatcggctgtgcgaggacgcccgccagaagtacgcgttggaggcttacatgcccgaggcggatcgcgtgcctaccgatctggcggcgttgtgcgcggcggtgggctgtcaggcgtccgagacgactgtgcacgtggtggtgggcaacggcttgaaggagtttctctttgccggtcagctgattccatgcgtggaggaggcgaccacggtgcgactgcacggcggcgaggcggtgcgcgtgccgttgtacccgcctacgctctttaattcgttgcagcttgacgccgaagccgacgaggtctcgctggatgcgcgcagcgcttttgtggaggcgcgagggctctacgtgccggccgtaagcgagacgcttttctactacgtgtacacgtcatggtgtcaatcgctgcgcttctcggagccgcgtgtgctgatcgaggcggcgttgcggcagtttgtgcacgacagtcagcagtcggtgaagctggcgccacataagcgctacttggggtacatgagccagcgactcagcagtctggaaaaggatcatctgatgctgagtgacgcggtggtttgcgagttggccttcagttttgcctcggtatttttcgattcggcttaccaacctgccgaatctatgctcttttccgagtggcctttagtgaccaacgcaaccgatcaccgcgatctgatccgcgcgctgaccgagctcaagttgcatctctcgacgcacgtggccgccttggtcttcagcgctaattcggtgctctaccagcacaggctggtgtatctccagtcgtcggcgcggcatcccagcgccggcggtacggccagtcaggagacgttgctcaaggctattcagttcaccaacgggttgtcggcggcctgcgaagacgtctacaacgacgcgcgcaaggtgctcaagtttcagggcgcgccgctcaaggacgaacgctatgggccgcagcatttggcgttggtgtgtggcacgtgtccgcagctagtttcgggcttcgtctggtatctgaatcgtgtctcggtgtacaacacgggcttgtcgggttcgtcgacgctcacgaatcacctggtgggctgcgccgcggggctgtgcgaggcctgtgggggtacttgttgccacacgtgttatcagacggccttcgtgcgggtgcgcacccgcttgcccgtggtgcccaagcagcccaagaaggagccctgcgtgatcaccgtgcagtcgcgttttctcaacgacgtggatattttgggcagcttcggtcggcgttacaacgtcgacgccaaggacgggggtttggacggcaaaggtgacgacggggttccgggcggcggtgctggcgggggtggtggacgagacgtgagcgggggcccgagcgacggtctgggtggcggtcgtggtggtgggggtggtggggattccgggggaatgatggggcgcggcggtcgcatgttgggcgctagcgtggaccgtacctatcggctcaatcgcatcttggattactgccgcaagatgcggctcatcgaccccgtgacgggcgaggatacctttagcgcgcacggcaaaagcgactttgtggccgtcttttcggcgctcaacaagtttgtggacgacgaggccctgggtttcgtttcggaggtgcgcctcaagagcagccgcgacgaggtggcgggcgccacgcaggccttcaacctggatctgaatccctacgccgtggccttccagccgctgctagcctacgcctatttcagatccgtcttttacgtgatccagaacgtggcgcttattaccgctacctcatacattgtggacaatccgttgaccaccaacttggtatccaaatggatgacgcagcattttcaatccattcacggcgcgttctccaccacgtcgtcgcgcaagggctttctcttcaccaagcagatcaagtcgtccaagaattcggatcacgaccgcctgctggactttaggctgtacgcgcagggcacgtacgccgtggtgcccatggagatcaagctctcgcggctgtcggtacccacgttgatcatggtgcgggtgaaaaaccgacccatctaccgcgcgggcaagggcaacgcgggtagcgtgttttttcgccgcgatcacgttccgcgtcgtaatccggctaagggctgcttgggatttctgctgtatcgacatcacgagcgactctttcctgaatgtggtctcccctgcttacagttttggcagaaggtctgttccaacgcgttgcccaagaatgtgcccataggtgacatgggcgagttcaatgctttcgtcaaatttctggtggctgtgacggctgactatcaggagcacgatctgctggatgtggcgccagactgtgtgctgagttacgtggaaagccgtttccataacaaattcctctgctattatggcttcaaagactacatcggctcgctgcacgggttgacgacgcgcttaacgacgcagaaccacgcgcagtttcctcacgtgttaggtgctagtccgcggttctcgtcgcccgccgaatttgcgttgcatgtcaagggcttgaagaccgcaggcgtgccggcgcccatggccgccactgtggcgcgtgaatcgttggtacggagcgtttttgagcatcgttccttggtgaccgtgcccgtgagcgtggaaaaatatgcgggtatcaacaacagcaaggagatctatcagtttgggcagatcggctacttttcgggcaacggtgtggaacgcagccttaacgtgagctctatgagcggccaagattatcgtttcatgcgccagcgctacctcttggctacgcgtctggccgacgtgctcatcaaacgctcgcgccgcgagaacgtgctttttgacgcggatcttataaaaaaccgcgtcatgctggcgctggacgccgagaacttggattgcgaccccgaagtgatggccgtgtacgagattctgagcgtgcgcgaggagatccccgcgtccgacgatgtgctcttcttcgtggatggctgcgaggcgctggccgcgtcgctgatggacaagtttgccgcgttgcaggagcagggcgtggaggacttttcgctggagaacttgcgacgcgtgctggacgccgacgcccagcgattaacggacgccgccgggggggaggtgcacgacctgtcggcgctcttcgcgcccagtggcgtcggcgcggcgtccggcgtcgggggtggcggtcttcttctcggcgagtccgtcgcgggcaactccatttgcttcggcgtgcccggcgagacgggaggtggctgctttctcgtgaacgccggcgaagacgaggctggcggcgtcggcgggagcagcgggggcggcgggggcagcgggttattgccggccaaacgcagccggttgtaaccgccagcaaacgccgcgacaacggccgccgcagccacgagcatcgcaacaacagcaacaacagtcgcagcccccgtggccgcttttcagaccgcaacaacagcagcaacagcagccaccgacacagcagcaccaggcgacaccgtatcagctaccgccgcaacagcggcgacagacggcgtcgcatcatcaacagcagcaacagccccgaaggttagcgccgcggcaccagagacagagaccgccgccgcgctggcaaactccgacattcgcgtcggcgcccgggccgcctgaggaaggggaggagtgtcagacacagccggtcatctccgagcccccgtcgcccgaggcggaggagccggcggcggcggtggtggaggaggttgcgccgcaagcggcggcaacagcttcgggagcagaacccgcgtcgtcgacgacgtcgttatatattaacgtcaacgtcagtcggcatagcgagcggcccgcgagttatttgtgcaccgactccatgtctctggccggcgccagaccggacgacagcgtctcgtacgtgagcgagtcgagtcatggagatgaatttgttacagaaactatgcgtagtgtgttcgaaatgcaacgaatacgccatggagctggagtgtctaaagtactgcgatccgaacgtgttactggcggagtccacgccgttcaagagaaacgcggcggctatagtgtatctgtaccggaagatctacccggaggtggtggcgcagaatcgtacgcagagttcgttgctgacgctctacctggagatgctgctgaaggcgctgcacgaggatacggctttgctggatcgggcgctgatggcctactcgcgccagccggaccgggcggccttctaccgtaccgtcctccgtttggatcgctgcgatcgccatcacaccgtggagctccagtttacggacaacgtccgtttcagcgtcagtctggccacactcaacgacatcgagcgcttcctgtgcaaaatgaactacgtgtacgggatcctggcgccggaggccggcctggaggtctgcgcgcagttgctggagctcctccgtcgcctatgcggcatctcgccggtggcgcgtcaggaagtgtacgtcgaagggacgacatgcgcccaatgctacgaggagctgaccatcatcccgaatcagggccgctcgctgaacaagcggctgcagggcttgctgtgcaaccatatagcggtccaccgtccgtcaagccagtccgatgtgaatatccagacggtggagcaggacctgctggacctgacaacgcgcatcccccacttggctggagtcctttcggccctcaaaagcctattctcttcttcatcggcctaccacagctacatccaggaggcggaggaggcgctgagggagtacaacctgtttacggatataccggaacgaatatattccttgtcggattttacctactggtcccgtacctcggaggttatcgtcaagcgggtgggcatcaccatccagcagctaaatgtgtatcaccagctgtgccgggcgctcatgaacggcatcagtcgccatctgtacggggaggacgtggaggacatcttcgtgctcggggaaaaggcgttggacggggaggagcgcatgttcgtggggtcggtctttgccgcccccaacaggatcatcgacctcatcacatccctcagcattcaagctttcgaggacaacccggtgttcaacaagctccacgaaagcaacgagatgtacaccaaaatcaagcatattctcgaggagattcgacgtccgctgccagatggcacggggggcgacggccccgagggcgaggctattcacctgcgtggacgggaggcgatgtcggggacgggtacgactttgatgacggccagcaacagcagcaacagcagtactcacagtcagaggaataacggtggcggcggccgggctcgtggaggaggcaagaaagtggtagggggaggggtgaatgggcaggacggcgacggcagcgagaacggcttacgggtgcgcaactgcgacgaacacgaggctctcgacttggtggacgcgcgctcccgcatccacaacgtcactcgcgaggtgaacgtgcgcaaacgcgcctacctgcagaaggtctcggaggtgggctatggcaaggtgatccgttgcatcaaaacgcaggagcgtctgactagcaagctcatcgatgtcaatctagtggggcccttgtgtctggactttatctctaagctcatgaatgggtttctgtaccgcagccaataccaccaggaccaagacgtggtggacgtgggtgatcagttcacctacgatgagcacctgtatgtggtcaataacctgatccacaagagtctgcctgtggaatccctcccgctactgggtcagcagatctacgagttgtgtaacgggcccctcttcacccactgcaccgatcgttatcccctctctcacaatgtggacatggcctatgcctgcgacaacgcgggcgtactaccccacgtcaaggacgatttggtcaaatgcgcggaaggtaccgtgtatcccagtgagtggatggtggtgaagtatatgggttttttcaatttttcggactgtcaggacctaaacgtgctgcagaaggagatgtggatgcacgtgcgggagctcgtgctctccgtcgcactatataatgaaactttcgggaaacaactctcgatcgcgtgcctgcgcgacgaactgcacccggacagagatgtgattctcacgtataacaaagagtggccgctgctgcttcgtcacgaaggaagtctttataagtccaaagatctatatctcctcctctacaggcatctgtccagaccggatgagagtggcgacgtgccaacagctcccgtggccaagccctccaccctgacggccgccgcggccgtctcgggtgtcttcagggagccggaccgaccttggctgccaagtccgtatccctcctcctcgactgcgggtgtttcccggagggtccgcgcgacacgcaagagaccacgacgcgcctcatcgctgctggatttggcccgcgacgaacatggaatccaggatctggtgcctggtagtctgcgttaacctgtgtatcgtctgtctgggtgctgcggtttcctcttctagtacttcccatgcaacttcttctactcacaatggaagccatacttctcgtacgacgtctgctcaaacccggtcagtctattctcaacacgtaacgtcttctgaagccgtcagtcatagagccaacgagactatctacaacactaccctcaagtacggagatgtggtgggagtcaacactaccaagtacccctatcgcgtgtgttctatggcccagggtacggatcttattcgctttgaacgtaatatcatctgcacctcgatgaagcctatcaatgaagacttggatgagggcatcatggtggtctacaagcgcaacatcgtggcgcacacctttaaggtacgggtctaccaaaaggttttgacgtttcgtcgtagctacgcttacatctacaccacttatctgctgggcagcaatacggaatacgtggcgcctcctatgtgggagattcatcacatcaacaagtttgctcaatgctacagttcctacagccgcgttataggaggcacggttttcgtggcatatcatagggacagttatgaaaacaaaaccatgcaattaattcccgacgattattccaacacccacagtacccgttacgtgacggtcaaggatcagtggcacagccgcggcagcacctggctctatcgtgagacctgtaatctgaactgtatgctgaccatcactactgcgcgctccaagtatccttatcatttttttgcaacttccacgggtgatgtggtttacatttctcctttctacaacggaaccaatcgcaatgccagctactttggagaaaacgccgacaagtttttcattttcccgaactacaccatcgtttccgactttggaagacccaacgctgcgccagaaacccataggttggtggcttttctcgaacgtgccgactcggtgatctcttgggatatacaggacgagaagaatgtcacctgccagctcaccttctgggaagcctcggaacgtactatccgttccgaagccgaagactcgtaccacttttcttctgccaaaatgactgcaacttttctgtctaagaaacaagaagtgaacatgtccgactccgcgctggactgcgtacgtgatgaggctataaataagttacagcagattttcaatacttcatacaatcaaacatatgaaaaatacggaaacgtgtccgtcttcgaaaccagcggcggtctggtggtgttctggcaaggcatcaagcaaaaatctttggtggaattggaacgtttggccaatcgatccagtctgaatatcactcataggaccagaagaagtacgagtgacaataatacaactcatttgtccagcatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggaatcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcgggtaaagtacgtggaggacaaggtagtcgacccgctaccgccctacctcaagggtctggacgacctcatgagcggcctgggcgccgcgggaaaggccgttggcgtagccattggggccgtgggtggcgcggtggcctccgtggtcgaaggcgttgccaccttcctcaaaaaccccttcggagccttcaccatcatcctcgtggccatagccgtagtcattatcacttatttgatctatactcgacagcggcgtctgtgcacgcagccgctgcagaacctctttccctatctggtgtccgccgacgggaccaccgtgacgtcgggcagcaccaaagacacgtcgttacaggctccgccttcctacgaggaaagtgtttataattctggtcgcaaaggaccgggaccaccgtcgtctgatgcatccacggcggctccgccttacaccaacgagcaggcttaccagatgcttctggccctggcccgtctggacgcagagcagcgagcgcagcagaacggtacagattctttggacggacagactggcacgcaggacaagggacagaagcctaacctgctagaccggctgcgacatcgcaaaaacggctacagacacttgaaagactccgacgaagaagagaacgtctgaaccaggaggaaaaaaaaactagacaaaaaatattgacacagagacttgtgatatacggggttaaactggatatctaggtgctgcatgtgtattttctttgtgattttgcttcgtaagctgtcagcctctcacggtccgctatgtttttcaacccgtatctgagcggcggcgtgaccggcggtgcggtcgcgggtggccggcgtcagcgttcgcagcccggctccgcgcagggctcgggcaagcggccgccacagaaacagtttttgcagatcgtgccgcgaggtgtcatgttcgacggtcagacggggttgatcaagcataagacgggacggctgcctctcatgttctatcgagagattaaacatttgttgagtcatgacatggtttggccgtgtccttggcgcgagaccctggtgggtcgcgtggtgggacctattcgttttcacacctacgatcagacggacgccgtgctcttcttcgactcgcccgaaaacgtgtcgccgcgctatcgtcagcatctggtgccttcggggaacgtgttgcgtttcttcggggccacagaacacggctacagtatctgcgtcaacgttttcgggcagcgcagctacttttactgtgagtacagcgacaccgataggctgcgtgaggtcattgccagcgtgggcgaactagtgcccgaaccgcggacgccatacgccgtgtctgtcacgccggccaccaagacctccatctatgggtacgggacgcgacccgtgcccgatttgcagtgtgtgtctatcagcaactggaccatggccagaaaaatcggcgagtatctgctggagcagggttttcccgtgtacgaggtccgtgtggatccgctgacgcgtttggtcatcgatcggcggatcaccacgttcggctggtgctccgtgaatcgttacgactggcggcagcagggtcgcgcgtcgacttgtgatatcgaggtagactgcgatgtctctgacctggtggctgtgcccgacgacagctcgtggccgcgctatcgatgcctgtccttcgatatcgagtgcatgagcggcgagggtggttttccctgcgccgagaagtccgatgacattgtcattcagatctcgtgcgtgtgctacgagacggggggaaacaccgccgtggatcaggggatcccaaacgggaacgatggtcggggctgcacttcggagggtgtgatctttgggcactcgggtcttcatctctttacgatcggcacctgcgggcaggtgggcccagacgtggacgtctacgagttcccttccgaatacgagctgctgctgggctttatgcttttctttcaacggtacgcgccggcctttgtgaccggttacaacatcaactcttttgacttgaagtacatcctcacgcgtctcgagtacctgtataaggtggactcgcagcgcttctgcaagttgcctacggcgcagggcggccgtttctttttacacagccccgccgtgggttttaagcggcagtacgccgccgcttttccctcggcttctcacaacaatccggccagcacggccgccaccaaggtgtatattgcgggttcggtggttatcgacatgtaccctgtatgcatggccaagactaactcgcccaactataagctcaacactatggccgagctttacctgcggcaacgcaaggatgacctgtcttacaaggacatcccgcgttgtttcgtggctaatgccgagggccgcgcccaggtaggccgttactgtctgcaggacgccgtattggtgcgcgatctgttcaacaccattaattttcactacgaggccggggccatcgcgcggctggctaaaattccgttgcggcgtgtcatctttgacggacagcagatccgtatctacacctcgctgctggacgagtgcgcctgccgcgattttatcctgcccaaccactacagcaaaggtacgacggtgcccgaaacgaatagcgttgctgtgtcacctaacgctgctatcatctctaccgccgctgtgcccggcgacgcgggttctgtggcggctatgtttcagatgtcgccgcccttgcaatctgcgccgtccagtcaggacggcgtttcacccggctccggcagtaacagtagtagcagcgtcggcgttttcagcgtcggctccggcagtagtggcggcgtcggcgtttccaacgacaatcacggcgccggcggtactgcggcggtttcgtaccagggcgccacggtgtttgagcccgaggtgggttactacaacgaccccgtggccgtgttcgactttgccagcctctacccttccatcatcatggcccacaacctctgctactccaccctgctggtgccgggtggcgagtaccctgtggaccccgccgacgtatacagcgtcacgctagagaacggcgtgacccaccgctttgtgcgtgcttcggtgcgcgtctcggtgctctcggaactgctcaacaagtgggtttcgcagcggcgtgccgtgcgcgaatgcatgcgcgagtgtcaagaccctgtgcgccgtatgctgctcgacaaggaacagatggcgctcaaagtaacgtgcaacgctttctacggttttaccggcgtggtcaacggtatgatgccgtgtctgcccatcgccgccagcatcacgcgcatcggtcgcgacatgctagagcgcacggcgcggttcatcaaagacaacttttcagagccgtgttttttgcacaatttttttaatcaggaagactatgtagtgggaacgcgggagggggattcggaggagagcagcgcgttaccggaggggctcgaaacatcgtcagggggctcgaacgaacggcgggtggaggcgcgggtcatctacggggacacggacagcgtgtttgtccgctttcgtggcctgacgccgcaggctctggtggcgcgtgggcccagcctggcgcactacgtgacggcctgtctttttgtggagcccgtcaagctggagtttgaaaaggtcttcgtctctcttatgatgatctgcaagaaacgttacatcggcaaagtggagggcgcctcgggtctgagcatgaagggcgtggatctggtgcgcaagacggcctgcgagttcgtcaagggcgtcacgcgtgacgtcctctcgctgctctttgaggatcgcgaggtctcggaagcagccgtgcgcctgtcgcgcctctcactcgatgaagtcaagaagtacggcgtgccacgcggtttctggcgtatcttacgccgcttggtgcaggcccgcgacgatctgtacctgcaccgtgtgcgtgtcgaggacctggtgctttcgtcggtgctctctaaggacatctcgctgtaccgtcaatctaacctgccgcacattgccgtcattaagcgattggcggcccgttctgaggagctaccctcggtcggggatcgggtcttttacgttctgacggcgcccggtgtccggacggcgccgcagggttcctccgacaacggtgattctgtaaccgccggcgtggtttcccggtcggacgcgattgatggcacggacgacgacgctgacggcggcggggtagaggagagcaacaggagaggaggagagccggcaaagaagagggcgcggaaaccaccgtcggccgtgtgcaactacgaggtagccgaagatccgagctacgtgcgcgagcacggcgtgcccattcacgccgacaagtactttgagcaggttctcaaggctgtaactaacgtgctgtcgcccgtctttcccggcggcgaaaccgcgcgcaaggacaagtttttgcacatggtgctgccgcggcgcttgcacttggagccggcttttctgccgtacagtgtcaaggcgcacgaatgctgttgagaaacagcggcggcggtggtgactggggacggtgatgatgctgctgagactgagactggtggtgagagtagtggtggggctgcgtcgcctgcgacggcgggtggagatgaggcggcgtggactgggacgaggaggaggggccgcagccgttggtggaaactacgtgcaacggcgacgcggttaagggagaccgtatcgcgtaggacgacgtggcctcctcgtataggttgttgccgctggactgacacagctcctgaatgagctctttgtagcgctcaaaggactcgctcacgtcgttgggaatgtccatctcgtcaatcttgcgttgcaaaatagtcacgtcgatcttgacgctgctggccgagacggcgtgacacagcacgctgataacgacgtggtcgcgcacgatgttgagcgtgacgctgtagtcttcgcgcgccgccgtgagcatctgcgtgatgcagtcgcaggggatgtgcacgtcggggttttcgaagatgacgtgcatgtgcaaccggccgtcctcggcgtgcataaagggcacgatgtcgtggttggcggcgtgcagcaggtaataaatttggaagatgggcggctggttggtggagagcttgagtagctcgctgctcttacagaacccgtaataaaagtttctatttttcatgatgttggacgtctgattgatgaaggccaccatggcgtcggaggcggtgggcaggatgcggttgtcctcgcacgaggtgcaggcgatgcgcgagacctgctcgttgccgtacggcgagatgtcgaggcaggtgtgctgccggtgcgagtggaaattgaagggtaagcagatggactctttgcccgtgatggccatcttcatcatgttaaggtacttgagctccagttcggggtgctcgcggaagatgtcgtgcaggtcgtgcagcgtgaggcgcgggcgcgcgtcggccggcgacggcggttcgccgtggttgttggccgacgtagcgccgttcaccgtcgacgccactttgctggccagctcgcgttggcggcgcttgcggagcagggagcgcaaggccgagcgtcgttcgcgcggcgtgcgcacgccgctcacgctagacatacttgtctatcacgtacgtggggtccaccagcttgatgtcgcaactctccaacagctgcgtgaaatcgcgcataaagtccgccaggtgcactttgcctttgtaggtgcgttttgtaatctgaaaggccttgaagagtgtgatgcagagccacacacgtcgcggaagtcgacttatatagtaattgtcgtgacagatggccagtttcacctcctggacgtggtgggggtgcaggcgtccgaagagcacggcctcgttggtgacgcggatgttgccggcgcactgcgggtcgcagaaaaagtgcttgtagatgcccgtgacgcctgcctgacgcaggacgtggcaaaataccgggtcgggtcgcgccagtgcgccgtcgacgccgctcaggccgtggtagtccgagtcgcctccgggcgaggtgggtgcttcgagtccacagcgcgccacgtcctcgtgtgccgcgccgagcggcgacgtgcattcgcgcaacagatcggccaataccagctgaatgcggtccaccatcttcacattgttctgacaatacgagacgacgcggcggtacagctcgcgcaggacgacgttatcgtaataggagcaggccatgagttcgcacagcagacacacggtactggtttggttcttggtaaaaaaagcgggtacgggacataggtaaatgggacccacgtttttttttagcgtgctctcgctgaaccccccgctggtgccaccgccgttgtgacggcccggatcgtctcctcctttttctcctccttcttcatcctcctcttcttctatcatcatccttgcgtcttctctttccgaggccgtggataacgcgtctagtcgcgcgaacttagtgtgcgtgagttccgtgagtggcgtggtgctcatgacgccggtgccggcccacatatagaaaagcagctgcacgaagcggtcgcggctaggtgagctgtgttctagaaagttgtcgatcagttcttgcggcacttcgacgtgataagggttgtttttttgcttctgttgcgggtggcgccgaggcttgttgtaaggcaccgtgtcttcacccatgaccatggcccgcaccacggccagatggttcagggtgacattctcgttatcaaccgcgtcgcccacttgtttttcaaagcaacgattgatgaaaaagtgcaggtggaaatcgaagaccgtgagaacgtggtgtcggaacaggtcgtcgatgcgcagatcggaaaagtgctgctgcagcagatgcgtaaactcggacatgatgatgagcgtgctgagcgccgcacggggcgcgtaactgcatttgaagcacagcaagctgtactcgaggagccagctctggtcgcagtcctgtttgaggcagatgctgatgatggcgcataggttacagcgcgtgtcgatggccagcggcgcgcacagtcgccgcagttgttcaaagtcggccgccgaggtttcgaggccggccagttctgcatctaggtcgcaggcggccgaagcgccggcgggtcctacgttgctactgccggcgacggctccgccgcagctagtggtgttggtcgcattggtgagtacggtggattgcgtgccgccgcacgtggtttcttccgcacaacagttgagcagttcgtctacctccgaggtgccgaggctgagcgtctggaattcgtaatgacggtaacggttggcggggtgttgaggatttacctggtatgaggcggccgccgcggcggccagcgcttcgtccataggtacttgacgcgggtgcgcgtgccatagcagctcagttgtcaagtccgagtgccactgggtgtactcggtgctccagccgctgtaacgcgaaacggcctgtcgttgcggactgcacaaggtagcggcggcgacggagctggtggacggggccgggctggtcgggggaagaaacgtggtgtggggcccgtgagggggagtcgttgggccgttactgctcacgtgggtactcggattcatggcgatcggcgccgctgattgaggacgcggaaaaaagaatgtcctgggctaagcagcgggtgccgtttctggacgatgacgacggagaggaggaaaacgacgtgcaggatgacgtggattctccggtgccgacgcgaccgctggtgatcgacgaggacgcggagcccgcggctggtacgagcggtgggctcgaggggggaggtggtgacgacgaggacggtgaagacggacacgcgctacccgatcttgacgacgatctgctattacagttcgagccgatgctgccgcgcgtctacgatctgttgctgccctctctggacgcgcgcttaaatttcgtgaacgcgggtcagaagtacgccgccttcctcaagtacgtgcacggcgactgcgcgacctgcagtcacggagagatcctccgtgagaagacgcaactattaacggcgatcgtcagcaagctcatggacattaacggaatcctggagggaaaagacgagtcggcgccgggtaaataaatcggcggtggcgtcggtgcgatggagatgaacaaggttctccatcaggatctggtgcaggccacgcggcgtatcctcaagttgggtcccagcgagctgcgcgtcaccgatgccggcctcatctgtaaaaaccccaattactcggtgtgcgacgccatgctcaagacagacacggtctattgtgtcgagtatctactcagctactgggagagccgcacagaccacgtgccttgttttatctttaaaaacactggctgcgccgtctccctctgctgttttgtacgagcgcccgtcaagctcgtttcgccggcgcgccacgtaggtgagttcaatgtgcttaaggtgaacgagtcgctcatcgtcacgctcaaggacatcgaggagatcaagccctcggcctacggagtgctgacgaagtgcgtggtgcgcaaatccaattcggcgtcggtcttcaacatcgagctcatcgccttcggacccgaaaacgagggcgagtacgagaatctgctgcgcgagctgtacgccaagaaagccgcgtcgacgtcgttggcggtccggaaccacgtcaccgtaagcagtcacagcggcagcggtccgtccctgtggcgcgcccgcatgtcggccgcgcttacgcgaacggcgggaaagcggtcctctcggaccgcatctccccctcctcctcctcgtcatccgagttgctctcccaccatggtcgccgctggcggcgccgctgccgggcctcggccgccgccgccacccatggcggcggggtcgtggcggctgtgtcgttgtgaggcctgtatgggacgatgcggatgcgcaagcgagggagacgctgatgaagaggaggaggagttgctggctctggcgggagaagggaaggcggcagcggcagcggcgggccaggacgtcggagggtccgcgcgtcggcctctggaggagcacgtgagtcgtcggcgaggggtgtcgacccatcaccgtcatccgccgtctccgccgtgcgcgccgtccttggagcggactggttatcgttgggcaccgtcatcgtggtggcgagcgcgctccgggccatcgcgaccgcagtctgggccgtggctgcccgcgcgctttgcgactctgggcccgctggtgctggctcttctgctggtgctggctctgctgtggcgcggtcatggccagtcgtcgtctccgacacgctccgcacaccgcgactgatgagttccaccaggctctgcgccgtctcttcgcgcccctctgcgttcacgaggaccatttccatgtgcagctggtgatcggccgcggtgcgctgcagccggaggaagcggcggtagaaacgtcgcagccaccggcgcagtttgcggcgcagacgtcggcggtcctccagcagcagctggtgcatcacgtgccacgttcttgcgtccttcatctcttcgtgacggataagcgctttctgaatcgcgagctgggcgaccgtctctaccaacgcttcctgcgcgaatggctggtgtgtcggcaagccgagcgggaggcggtgacggcgctctttcagcgtatggttatgaccaagccctactttgtgtttctcgcttacgtctacagcatggactgtctgcacaccgtggccgtccgcacgatggcctttctgcgtttcgaacgctacgacaccgactacctgctgcgccgtctgcggctctacccgcccgagcggctgcacgcgttgttggacggtgtcaccgcctcgctgctaggtgaccttcaccgtttccttttcggggtggaccttcggctgcccgtgcttcaccccaccagctcgccgtgcctagcattactacgcgccaagcgcttcgacgcccgcgctgatttggccgtataccaccgtaaccagtggtgtcaccaacggcagccgcggtcgccgcagttgcggggcctcatcgcagccttgcgccggtacgccgggaaggtaccctgcggaaacccgctctacgtactggcccgacaagcggtgcagacgttttgcgacacgtgtccgcgatacctggtgccgttgcgggcactgggtctgcacgacgagacgcgcggaggaggctcgacggcggcagctgcggcggtaggacacgcgggcgccggacagcaggcgcgtcacgtagagcccaccaagatcgtcctctttgcactcagcgccgcgctgcgcggcggcctcatcggcagcgtcatcgacctgccgctctggtgtctgtgtcgactcaagtgcgagcgccatctggacgcgcgctcgctggtggccgtggtctgtcggcagtgcggacactgcctcaacctgggtaaggaaaagctacactgccagcaaaactttccgctcaactcgatgttctattatcgggaccgtcaagaaaagagcgtcatcttcaacacgcacgccgagctcgtgcactgctcgctctgcggcagtcagcgggtggtgcggcagcgcgtctacgagctcgtctccgagacgctctttggacagcgctgcgtacgcgtgggctggaaagccgtgctgggcctcaacgcggcttgtgccgtgtacgatcaccggctggctttcgacgtcattctgccctgcgcggcacgcacctgcgactccactgtggtggtacgcgacgtgacggtcccgcgtctcctgcgcctcacttcgcacgggcacggcctgctgtgcgcgcgctgtcagacgggcgagtaccgcgacagctgtttggaaagcgaggacggcgccccgctgtgtcggggctgcgcgctggttaaacagaccgcctgccacgtcggcggccacattgtgcagcaggcgcgcggcggtttagcagcggcttcctcttcgtcctccccccacggcctgccccatgtctaacaccgcgccgggacccacggtggccaacaagcgggacgaaaaacaccgtcacgtcgttaacgtcgttttggagctgccgaccgagatatcagaggccacccacccggtgttggccaccatgctgagcaagtacacgcgcatgtccagcctgtttaatgacaagtgcgcctttaagctggacctgttgcgcatggtagccgtgtcgcgcacccggcgctgacagcccaaggggaaaaggaatagcaagaataaatcaccgtgaaagtgatacgttgttttgtaacataaaaaaacgataaaaatcctattgtttttattacccgctactgtcagtgtcggttacaaaagatagagaaaccgcatgtgttgaatagtgtcctgtacggattgcgccagttgtcgcaggtccaatcgcactagccgcagtatttctagagcactgaggacgttctgcgtaagcaccgtgataggcggcgaggcgaaactggtgctggcggcgccgggcgccacggccacaagttcatctcggcatagtggtgtttctcccaatcggttttcttgaaagacggacccgccaaaggcggtagagactaatgcagagtcggctgtccttgatgtatcgtcttgtacgtgatctatctgtccgtcgtcgtctgcggccgcggccgctcgatgacgatgtcggcgcggcggctgctgaactcgcgcgatgggtggcgggttttcacgcagaaactgaatattgactggcacgcggttgaaaggtaccggcggtgttggagcggcgccagacgcagcgatgttgtccgcggatgagttatcatcttggtcatacagcgggaaggtggggaaggcctcgtccaacaccagccgactgtggtcctgttcgaacgtggagggcggtcgcagcacgcgtacgacggtgtggtcctgtgcgttgtaaatgactaggggaataaactctaagcgggtggggaaacgcaggtaatcgcgtagccgtctgatttgggcttgtagccagcagtgctccagcggcgtttcggtccacgtgtcctggagcagttgactgagattgagatcccgggagcgttggatgcggaggaagtcgcggtctcgcgacgtgtattcgaggtggcgcgctactagtatacgttggcctttcagcaggtcggctacatgcacgccgagacacacgggtatgccgaaaagccaggagcccagcgcgtagtctagggcggtttctgtttgaataaaaacatctaaaagtcccggctccgtggtcgtgtttgtgtctgtggtggttgtgtcctgacgtggcacgcggatcatctgaagcaccggctctccggtggggagctgcggttgcgtgtacccctcggtcaccatttcgcattgttgcgtgaaaatctgaaacaacgtctgtaccaattcggacaccgaggcgtatgtctcggcgtactggggtttcagttctagccacagacactgcagcatgtcttgtggaaagaccagcgtggccatggcgtagagccatagcttgcctaagggcggtgtgcttttttgcgggcctacctggcacagttgctgtaccagtttattttcccaaaacagtttattgagctgcatggcgggccattgggtgggggtgatacagaaggccttgacctgttcggggaggtggtcggggggcattttgtgtgtgttattgactaccgcgtgtatcacatcctgatgtaggtgagctgtgagggagggtagtgacatctgcaccgggtatttgaggacggtgtagatgtactcggggtacagagccgctatgagtacacaaaactcttgcagactcaggcgcagcacggtaccgcggcccggtctctgttcccctacgtcaccaccctcgccgctgcctacgcgatcggcggccgtcagctcctgctgcgtgtcgatgcgctggtgccaggcggtgctcaccagataacaaaagagcttaaggttatgcaacgtgtgagtctccgcggggtgcgtgtggctctgatgctgcgtgaggtagggtcgtaggtcgtactgcgagatctgtggccagaaagtgcgcaatgtctgacagacggccacggctaccgtgatggctttataacgtgtggtgacgacgttcttgagtcctccgccgctacagcggcgccgccatgccaggggccgaccatcgtctcgcagcgccaagtacttaaaggctacgttgccataatcggtgaccaggtgaatgggttcgccggcctgcgtgacgatttgccgcatgccgaagacgtctaccacttcaaggaaggtgtcgtggtgacgcgcgaagcataggcgacgcaggcggtcgcgcattatcagcgcggggtcggtctcgtgtgttgccggaagcacgctaggaatgtcttccagcctatagactagcgatgagccgttgagcttgttgagcagatactggtgacccagctggacgtgtcgttccagcgcgttcaacccgcgtgtaaaggcgcccagtgaagtcgtcgcctgcggtttccgggggttgggcaggactccctcgttggagagacgcgtgccgcgtcgcttggccagttccgcaaaacgagtccgcagatcgcggatcttttccaactgcgaccgaaagtccagcccgtagctgaaggtctggattccgtgtaacagcgcaaagtattccgtcgccaacgtttcctgcagttctaggtcgcctagcgtctgacccaagcgctgcaacagttcctgcactttttgatgacgcgcggcgccgccggctacgcgtccgggttccagtcgctgccagaccgcttccaccgcctggaccatgtcgacccgcggcgtggacgcgccgttggcagtcgcctcttgatgctgtgcaataaaattttcacaggccgcgttttgttcgatttgatgcgctagcgtcacggcgctctcgacagcttgctgttgcaggttccggtagtgggtcctgcttccgtgatgcgggtgcgtagggtccgcggtgatttgcgcaagggcttcctccagaaaggccagcatccagcgcactgtgcgttccgccgacaggtacggcagttgttgcgtggctttgcccaacagctcgcgaagtgtctccagcggcttttccatcagcgccttggcgtcgggggtggtcacgtccagtccgccgctcattttgtggcgcgtgaccagatcagtccacaggttctgcgccgtgctcagctgctcgtcgcgttgtcgcaactgcgtctgtactttctgattcagcagatcggcctcgtcgctgagcgctttccgggccgcgtcggcctgctgatctagcagcgttttgaaaacgggctgctggaagtcggcgggcgggggcgtgatccgacccgccagctcctgacccttgaagggtttctcgggtacacgcgtgacggagctgctcccgggatcctggcgcagcgagcgatctagccgctcgctagtctcggtcatctgttgtctagtctcttgtaattgttcctccatcttctgttgactgctgcggtagcgtgcaaagtcgccctcgaactcgctgcccgtgatggctgtagttggatcgccctgttgacacttctcgatgaactgcgcttgatggacggcgtgttgcagggcctgctgcgtctcatggatcagaagttgcggacccaaaatttggtccaagtggtttagcgaggcttgggtttgcatagccgcttctcggtgcgggtgacagcgccgctctacatcacccgtcagcacgccgtgcagacactcgttgattcgcccgtctagttttttgctcagctgctgcagcgccgacagcaagtcctggttgaacttgtctagtagcggttgggcgcgttgatctaggcccaagagcagctcgagtgtggcctccagtggttggtgcgggatggtggagagcatctcgcccttaacggcgtccaccacgcgttgcaaatcctgctgcacctttttttggtagccgtccagtagctgccgttgctgttcttcctgtttacgtttctccttgtctaaaaagtcttgcatcttggtggttaacgtttgttgcatttgatgcatgacacgatggctcggtgcccgggccaagacacgctgcacgtcctccacagaagttaccgtgagcttgccggcctcttcttgccattcacgttctagccgttccaggtgctgttcttccatctcgtgttgatatcgctcgtagagttccgttacctgaggtccgacgcccagtcgtccgaccatatgttgaaagaaatattcatgattacggaaaaagtaaaccaactcccgtaacgcttggaaacgtttttcggatgcgccggtaccggctttctcgatctgctccagtttcttgaccatctgcgcgtacgtggcgttggcggcacgcagatcctcacgttcgtgcgagtcgggtggcagttgctgcaacaacaaactgacggcgtcaaaaaacgtcggtcgcggcgactcgtcgcgcgccagtcgcatcactaatgtgtggaacatgctcagtacggcgttgatgagtcgcagacgcgtctgttcgtcgcgacgtaacatctcgcgtaattgtgggtgtcgcttgatggtctgttcgttgggcggatcgtcgtacgagagtccgtcgaggaaacgctgcgtttcctcttcctcttcgtagaggcggcttagcgcgagttgcgcgttctgtaggcgctgctgcacttcgggtagctgcaggccgcctagcgcttccagctgagctagctgctcctgtaccaaggccagtgtcagcgccgagccgcggctgcccgggtcgcgcaccagcgtctcgatgacatgaagcaggtcgtggatctgcgtgaggcgaccctcgttttgctgcgtggcttgctggtacgcgtgtcgcagctgcaggatctcttgcagtagcggtacgttgtcgcgcacagtgcccgtcatgaggtagctcagttgttcgcgtatgacgacgaatccctcttcgtagctgccgtcacacagtttcaggtcgcgcaggtcgtaaaagagtctcagtacctgctcgacgacgcgttccatctgcttcaggtcctctaccggcaaaaagccgttaaggatgtgattgtgcacgcgcgtcagcagctgcgtgctcagacggtccaggtccatctgcaactctagcattttggcgttgcccaggcgaaagagttcctgcttggcgttgtcgtccaacggctgcagcgctttcagaatttcgcgtcggttcagatcgctggcgtctaggtcgtgaatgtcgatgctggtgatgaggccggccaagtgctcgtaaacgccgtggtattcctcgcgttgacgttgcaacacccgacgtcgctgttcgatgacctgcgtcagacgctgaaagtctacgggtcgcaggcagacgaagctgtcgctaacgggcatcggtcgcttggttacgaaacgttgcagtcgttgagacagttcgttagtgggcttgctttccacgtagcgcagcatctcctccacccaggcgatgagcgccgggccgtgctgacgtccgtagggatcgaagacgacttgcattttctccagcagtgcgcgatccagcgtcgagtacgtgcctttggtggtcttgtggctcaggtagtcgtgcatgcgctgcagatccaggccgtggtgcagccagttgagcagaaaggcatccagtttcttggataggcccagataggcgcgtaccgcctgctgcgccgccgattgcggaccgcaggggcgacgcagacacgagcgctgattgacggcatggatgatgagctgctggagacgatcggtgaggaaagcttcgtcgaaggacggcgccgtggccgttgccgcgttagcgccgctttcggtacccgccgcgtgcaacgtccaggcgctggtgttggcaggcaacggcggcagcgtcagagccttcaactcctgctctacctcgtcgaccagctgttggtagcggcccagggccggcagggccccttcgccgcagctgtaggacggtggtaccgcggacgaagaagaggccgccgctatcgctgagggggaggaggaggcggtggccagtgttttggacgtcgtggacgggggtttctttttgcctccgtgtttgctaccgctgaggtccttgcggcgtttctcgggtgtttttttgggtgaggacgagggatcgtagacgggaatgctgggcgccacgccaggagggcaacccgggtcgacgatggggtcgggcagcggaggtaaggaaggtgcggcggtggtcgttgtcgctgccgtgtccgcgctttctcggacgacgccggtgaggtcgatatcgcggtcgcgataggtggagaccaaacgcgcggcgatctcagcctctggtacggtcgccacatccagcatgtagagaaaaagggcctcatagtagaaagcgggcgacagctgcacgccgaagcccgtgagcaccatcagcacctgatggagaccctcgcagtgatacacggcggcgttgtgacattccgcggagctgtgcggatcaaagaccaacatgtggtcctcggtgaagaccacggcgcgcgccaacgagttgacggtgacgagtacgtaggtgggacgcggtttggcgtgcgcgtaccgcagaaagtcgaagatgcccggacacatgtagccgtccaggtcgcacgtctcggtggtgccgttgaagggccgcgagagcgcgtgcacggtccggccgaaccgcgactccaggcggcgcggcacttcgtcgcccagtctgtagaccggcagccgcccgccggcgggcagcttcttttgcaactcgcgctctagccgcgcgtccagacgcgcgccctcttccatgatggcgtccagcgcctcggtctgcaggacggcgctcgttccacccaggtgcaaggcgtgtaggaacatgatgccgttgcagacgcattgattgcccgctcgcgctccaaagcgagcgatgtcgccctggtggcagctggcctgtgtgactttcatggcgaggccggcggcagggacaccgatgtcgagccggcgggcgggtcgatcgaagacaagatgtcctgctgcgcctggcttacggggacgatgtaccagtttaataggtcgctcgcggccaggtgtgcgggttcgtagcgcgcacccaggacctccggtacggacgtcgcgcctgccgttgattcttcgtgatcggtgtcgggcgtcatgcggagtcgcggcggttggggcgccgattcccagggcgcctccaagaactcgcgtaaggcgcgatccgcttcggccgccgccgcaacgcccgtgcccgcgggccaggtcatcggcgctagcgcgcgatgtcggtgcagtaggctcgtcgcttccgtcagacagagctgtgcgccgcggcgttccaagttctcgcgacttagtacgtcaaagacggctagcgcgcgttgcaccgcggtaacgacggcgccattggaacgttgcgcctgctcgagcgccaatgtcacgcgtgtttccaacactttgattttggaggccgtctttttgagcgccttgctcatctgggccaccgtgcggtgacccttggcgtgtcggcttacttcctctgtgtcgctgctgatctgacgtacgcgcacgcgaacactcagcaggcgctcgttcaagccgcgcagattctcggccaacagccgatcgcggcgaaccagctcgcgcaactgttctacgaaacgcgtggtgggtacgcgtagtccgtattgaccttgtacctccacgtacaccgtcacgccgtcctccgagaggcgcgcccggccacgcgccagaccgaaacagagtcgcgtatgtcgcagatagtttctcagactgccggcgctgctgcgcatcacgtcctcgatcagcgggttgacggtggtgtacaggttatgcgctacggagcgcgccatgagctcggccagcaggtccacattgggcgtgacgggtacaccgctgaggtgctcgagagtcgtggcgatgtcgaagacgcaatcgcgtaccgtcttaaaaaccgcggcgtcgatgtgcttgacgaaggtggtcaggttgtagatggagaccaggttctggtacagcgtcacctgctcgggcaacaatacacggcacagctgaatgagtgcgaaaagacgcggcgaacccacggcttgaaacaggccctgcgggataccaaagatctccgagaactcagttaccaccaccaactgcgcgaagatgctggggaactcgggatgatggctgaaggctagcagggaggcgtagttgacgcggccttcgttcagattaacgagcgcgcattcgcgtaagatgtcggagcgtgtgacgccgtcaagcggaggcaaaggcgaggccgcgccggccgcgccgcgagacggacgcaaggtaaacaggtgcacgccccacttgctgtgcaggtcccgatacaggtactcgcgctccgcctccgtggcacccttcgtatgtgcctcaaagtcttcttccgtgtactgaaccgcaaagtgcgtattgacgttcagtgtcacgttgctccagacgtgctgtagttcctccttggagccgatcaacgtggatcgatgctgctccaaaatcaaccgccgccggtggtcgaacaggaacgtggggctgtacacatagaggcacatgaaaaacgtgtaaaaattgtagatgatctgtatgagtttctcgcgaatctcgctgacaaagagcgagctcttctgactggccggctggatcagcgccatttgtgcgtaggccgcgcaggtatcgtgattgaaacccagttccaccagtcgcattaccatctgcgtcagatctagtagccgttgcacgcgtcgcggcgtatgcaagtggtcttccagcacgcgatcgcacacgcgcgcgtaagcgtctaggttggcgcgcggcgaaacttcctcactcaacagacgcgagatcagacccgggtggaaaaacatacgttcgggcgacaggtaaaggttcacggtggagatgcgcgtgctaatgatgggaaacatgaggccgctggcgtcacgcgcttgcagattacccacgaacagcttgtagctgacgtcacgcatgtgttcggcaccgggcttctggtcgccgtcgatatcggaactgacgaaagagctcatgtgccgcacgctgttcttgacgtagttttgaaactccacggccaaatcgccgttaaccgaacggtagtgtgtgtaaaaaaaatgcatcagaagcaccgtgtccagttcggtgtcggtgtcgcgccgaaacaacacgtagggcatgagcgtgcaggcccagtagatgagccgctggtaggtcaggtccaggagttcggccacggcgcgacaattgacgtagggccgcgcctccgtggcagccgtttccagctgcgtgatcacccggcggaccagcggctgctggcccccggaactcgaaccgcccttcttgccgcggcgctcggtcgacgcgttgttactggcgatcaagtccgccgccgccgcggtgccgccgctctgttcggctattacggtctggatctcgcgcagggtctgcaacagcttctggaaagccgtcagcgtggccccgttgtggtagaacggcaaccggtcctcgtctccgccgccgtcgtgctggtgtcgcaggaagcggtccagctgttcgtgcaactgctcggcggcgtacagcgggtcgcgcgccgtctgtaccgtggcgtggcttaggaggtaaaagaccacgttctgacgcacgaagccaaagtggtagcccgagctcggcaacgcacccacgaaggcgcgcacggcgctcgcggtcacgtcctgggcatccaccgcgccgatctccaattggctcacggtatttaacgcctccgctttgtccgtggcccgtgcccgcagctgctctatcaactttttgaaatctaccgtgcgcctcgccatcatggacgcgcgcgcggtggccaaacggccgcgcgacccggccgacgaggacaatgaactagtgacggcgctcaaagccaaacgcgaggtaaatactatatcggttcgctatctctaccacgccgatcaccaggcgctcacggcgcgtttcttcgtgcccgagggcctggtagagttcgaggcgcagccgggcgcgctgctcatccgcatggagacgggttgcgactcgccgcgacacctctacattagcctttacctgttaggcattcgcgcctccaacgtctcggccagcacgcgctgcctgctcgaaagcgtgtacacggcctcggccgcgcgcgccgcgctgcagtggctggacctgggcccgcatctgctgcaccgccgcctcgagacgctgggctgcgtcaagaccgtctcgctgggcatcacctcgttgctcacctgcgtcatgcgcggctacctttacaacacgctcaaaacggaggtgttcgcgttgatgataccgaaagacatgtacctgacgtgggaagagacccggggacggctgcaatacgtgtatttaatcatcgtctatgactatgacgggcccgaaacacgtcccggcatctacgtgctcacctccagcatcgcacactggcagaccttggtcgacgttgcacgcggaaagttcgcccgcgagcgctgtagctttgtcaaccgtcgcatcacgcgcccgcgccagatccctctgtgtaccggggtcatacaaaagctgggctggtgcctggctgacgacattcacacctcgttcctggtacacaaagaactcaaactgtccgtcgtccgtttggacaactttagcgtcgaattgggagactttcgagaattcgtctgagcggcgctgacagcatacggggaggagacacagaagaaaaaaacacatcgcacacagactttataaaccgtagttgtcggcgccatctagactcactttattgaaatctacctgatttctttgttattttcctcgtaaacttatgaatccggctgacgcggacgaggaacagcgggtgtcctcggtgcccgcacatcggtgccggccaggtaggattccaagccgcagcgcggaaaccgagacggaggaatcgtcggcagaggtcgccgctgatactatcgggggagatgacagcgagctcgaggaggggccgctgcccgggggtgacaaggaagcgtccgctggaaataccaacgtatcgagcggtgtagcatgtgtagcgggttttacgagtggtggcggcgtcgtcagttggcgtcccgagtcgccgtctcccgacggcacgccgtctgtgctgtcgttgacgcgtgacagcggtcccgccgtgcccagtcgcggtggacgcgtgagtagcggtctgagcacctttaatccggccggcgcgaccaggatggagctggacagtgtcgaggaggaggacgatttcggggcttcgctctgcaaagtatcgccgccgatacaagctacgcgcatgttgatgggcaaaaagtgtcattgtcacggctactggggcaagtttcgcttttgcggcgtacaggagccggcgcgggagctgccgtccgacaggaacgcgctgtggcgcgagatggacaccgtgtcgcggcacagtgccggtttgggcagtttcaggctatttcagctcattatgcgccacggtccctgtctgattcgtcactcgccgcgttgcgacctgctgttgggtcgcttttatttcaaagccaactgggcgcgtgaaagccgcacgccactgtgttacgcttcggagctgtgcgatgagtcggtgcgccgttttgtgctgcgtcacatggaggatctacccaagctggccgaggagacggcgcgttttgtggaattggccggttgctggggcttgtacgcggccattttgtgtttggataaggtgtgtcgccaactgcacggacaggacgagagcccgggcggcgtgtttttgcgcatcgccgtggcgttgacggccgctatcgagaacagtaggcactcgcgcatctatcgtttccatctggatgcgcgtttcgagggcgaggtgttggaatcggtgttgaagcgctgtcgcgatgggcagctgtcgctgtccaccttcaccatgtctaccgtgggtttcgatcgcgtgccgcagtacgactttctgatctcggccgaccctttctcgcgtgacgccagttgggcggccatgtgcaagtggatgagtaccttgagttgcggcgtttctgtgtcggtgaacgtaacgcgacttaacgccgatgtgaacagcgtgattcgttgcctggggggatactgcgatttgatacgcgagaaggaggtgcatcgacccgtggtacgtgtgtttgtggacatgtgggacgtggccgctatccgcgtgattaactttattctcaaagaaagcacgtcggagttgacgggggtttgctacgctttcaacgtgcctagcgtgttaatgaagcgctaccgtgcgcgtgagcagcgctactcgctgtttgggcggcctgtctcccggcggctctcggacctgggtcaggagtcggctttcgagaaagagtattcgcgctgcgagcaatcgtgccccaaggtggtcgtgaacacggacgattttctgaaaaagatgttgctgtgcgcgctcaagggccgtgcctcggtggtctttgtccatcacgtagtcaagtactcgattatggccgacagcgtgtgcctgccgccgtgcttgagtcccgatatggcgtcgtgccactttggcgagtgtgacatgccggtgcagcggctgacggtgaacgtggctcgctgcgtgtttgcgcgtagcgacgagcagaagctgcatctacccgacgtggttttggggaacacgcgacgttactttgatttgagcgtgctgcgcgagttggtgaccgaggcggtggtttggggcaacgcgcgcttggacgcgctaatgtcggcgtccgaatggtgggtagagagcgcgctggaaaaactgcgtccgctgcacatcggcgtggctggcttgcacacggcgctcatgcggttagggttcacgtactttgcctcttgggacttgatcgagcgcatctttgagcacatgtactttgccgcggtgcgcgctagcgtcgatttgtgcaagtcgggtttgccgcgctgcgagtggttcgaacgcaccatctatcaagagggcaaattcattttcgaattgtatcggttgccgcggctctccatcgccagcgcgcgctgggaagcgctgcgcgccgacatgctcgagttcggattgcgcaactgtcagtttctggcggtgggtcccgacgacgaggtggcgcatctgtggggcgtgacgccgtcagtgtgggcttcgcgcggcaccgtgttcgaggaggagacggtgtggtcattgtgcccgcccaaccgtgagtgttacttccccaccgtggtgcggaggccgctgcgcgtgcccgtggtgaattacgcgtggttggagcagcaccaggaggagggcaaggcgacgcagtgtctgttccaggcggcaccggcgatccaaaacgacgtggaaatggcggccgtgaacctgagcgtgtttgtggaccagtgcgtggccctggttttctactatgactcggggatgacgcccgacgtgcttctggccaggatgctcaagtggtaccactggcgctttaaggtcggagtatataagtactgtgcctcttagtcgggggcccgctggctcggcgcggctgtattattagacgccgggcgtcttcgcagcgttcccggtcgtcgtgtgtgctctctataaaactttcgctcgctcgcgcccgctccttagtcgagacttgcacgctgtccgggatggatcgcaagacgcgcctctcggagccgccgacgctggcgctgcggctgaagccgtacaagacggctatccagcagctgcgatctgtgatccgtgcgctcaaggagaacaccacggttaccttcttgcccacgccgtcgcttatcttgcaaacggtacgcagtcactgcgtgtcaaaaatcacttttaacagctcatgcctctacatcactgacaagtcgtttcagcccaagaccattaacaattccacgccgctgctgggtaatttcatgtacctgacttccagcaaggacctgaccaagttctacgtgcaggacatctcggacctgtcggccaagatctccatgtgcgcgcccgatttcaatatggagttcagctcggcctgcgtgcacggccaagacattgtgcgcgaaagcgagaattcggccgtgcacgtggatctagatttcggcgtggtggccgacctgcttaagtggatcgggccgcatacccgcgtcaagcgtaacgttaaaaaagcgccctgccctacgggcaccgtgcagattctggtgcacgccggtccaccggccatcaagtttatcctgaccaacggcagcgagctggaattcacagccaataaccgcgtcagtttccacggcgtgaaaaacatgcgtatcaacgtgcagctgaagaacttctaccagacgctgctcaattgcgccgtcaccaaactgccgtgcacgttgcgtatagttacggagcacgacacgctgttgtacgtggccagccgcaacggtctgttcgccgtggagaattttctcaccgaggaacctttccagcgtggcgatcccttcgacaaaaattacgtcgggaacagcggcaagtcgcgtggcggcggcggtggtggcggcagcctctcttcgctggccaatgccggcggtctgcatgacgacggcccgggtctggataacgatctcatgaacgagcccatgggtctcggcggtctgggaggaggtggcggcggtggcggcaagaagcacgaccgcggtggcggcggtggttccggtacgcggaaaatgagcagcggtggcggcggcggtgatcacgaccacggtctttcctccaaggaaaaatacgagcagcacaagatcaccagctacctgacgtccaaaggtggatcgggcggcggcggaggaggaggaggcggcggtttggatcgcaactccggcaattacttcaacgacgcgaaagaggagagcgacagcgaggattctgtaacgttcgagttcgtccctaacaccaagaagcaaaagtgcggctagagcgcgggccgcgtgcctgggaacgcgcgcacggcgcggtcccgtgatggagaaaacgccggcggagacgacggcggtttcagctggcaacgtgccacgtgactcaattccgtgtataactaacgtgtccgcggacacccgcggccgtacccgccccagcagaccagccaccgtccctcagcgacgtcccgcgcggatcggacactttaggcggcgcagcgccagccttagctttcttgactggccggacggcagcgtcacagagggcgttcggacgacctccgcgtcggtcgccgcctccgcggcccgtttcgacgaaatccggcggcgccgtcagagcatcaacgacgagatgaaggaacgcacgctggaggacgcgctggctgtcgagctggttaacgagaccttccgctgctctgtcacctccgacgctcgcaaggacctgcagaagctggttcgtcgcgtcagcggcacggtgctgcgtctcagctggccaaacggttggttcttcacctactgcgacctgttacgcgttggttactttggacatctcaatattaaaggtttggagaagaccttcctgtgctgcgacaagttcctgctgccggtgggcactgtgagtcgttgcgaagccatcggccgcccaccgctacccgtactcatcggcgaaggcggtcgcgtctacgtctactcgcccgtggtggaatcgctgtacctggtgtcgcggtccggtttccgcggcttcgtgcaggagggcctgcgcaactacgcgccgctgcgcgaagaactgggctatgtccgcttcgagaccggcggcgacgtgggtcgcgagttcatgttggcgcgcgacctgctggccttgtggcgcctgtgcatgaagcgcgagggttccatcttcagctggcgagacggtaatgaggcgctgacgacggtcgtcttgaacgggagccagacttacgaggatccggcccacggcaactggttaaaagagacgtgctcgctgaacgtgctgcaggtatttgtggtgcgggccgtgccggtggagtcgcagcagcgcctggacatctccatactggtgaacgagagcggcgccgtcttcggcgtgcatcccgagacgcggcaggcgcactttctggcgcgcggactcctgggcttctttcgcgtcgggttcttgcggttctgcaacaactactgcttcgcccgcgactgttttacccaccctgaaagcgtggcacccgcttaccgcgccaccggttgtcccagagaactgttttgccgtcgtttgcgcaaaaagaaggggctctttgctcgaaggtgaaccgcggacgccgtcggtaccgtctccaccacagttaccaccgtcgccgtcactgccaccgacatggagcccacgccgatgctccgcgaccgggatcacgacgacgcgccccccacctacgagcaggccatgggtctgtgcccgacgacggtttccacgccaccgccgccaccacccgactgcagcccaccgccctatcgacccccgtactgcctggttagttcgccgtcgccgcgacacacgttcgacatggacatgatggaaatgcccgccaccatgcatcccaccacgggggcgtactttgacaacggctggaaatggacttttgctctcttagtggtcgctatattagggatcattttcttggccgtggtgttcaccgtggtgattaaccgggacagtgccaatataacaacggggacgcaagcatcatcggggtaacggggatagagcatgtgcttgactgtaccatcattgctgctacggaataataactacgctacgacctggcctgtggtgtgtgttgttttttgtgcacgcacgacatgacactcttttgccgcaccgccaacagcaccgccggctacgtcgacatgaacgtctgcatcggcatgatcggcgtggtttgtttcgttttcggggtctttattctcatcttttgctccacgttgaaagctttctacgtgcggcaaaagacttaccacctcctgggtaccgagtcggacgacgaggagaccacggtttgggaaaagcgccggatggagtcggatacagacttttaaaagaagccataaaaatatgggaattcccctgcctacgtcttcatgacgggcgcctttttcttcgcctcgggctctgtcttgtcgtcattcgggccaggactttttaatggccaacagcctgtggcaccgcctccgaacgctcgtgagcaacagtcggcagaatgaacaaattcagcaacactcgtatcggcttcacttgcgcggttatggctccgcggactttaattctgacggttggactcctgtgtatgaggatcaggagtttattgtgttctcctgccgagacgacggtaacaaccgccgccgtgacgtccgctcacggtccgttatgtccgctcgtgttccagggttgggcgtacgccgtgtaccaccaaggcgacatggccctcatgacgctcgacgtgtactgttgccgccagacctccaacaacaccgtcgtcgcgttctcgcatcatcctgccgataacacgttgttgatcgaagtgggtaacaacacgcgccgccacgtagacggaatttcctgtcaggaccactttcgcgcgcaacaccaggattgcccggcccagacggtgcacgtgcgcggcgtaaacgaaagcgcttttgggctcacccacctgcagtcctgttgcctgaacgagcattcacaactctcggagcgggtggcctaccatctgaagctgcgacccgccacgttcggtctggagacctgggccatgtacactgtgggcattctggccctgggctcgttctcctccttctattcccagatcgctaggagcctgggggttctgcccaacgatcatcactacgccttgaaaaaggcttgataatgataattgcacatcctcacgagtgcccttacctatcatcacactaagaataaagaaaatcgatcggtgtcgtgacgtgtggtgtgtgtttttcacggttatcgggtaccagggaggaggggttaagaggtcacaggtgcgatttaccgtaaagagagtcacacttaagaaaaaggtggaaatccctcacccgtcttattcccgtcagtgacgtgaatcgcccctcacgtcagtgttgtcccctatccgcgtgagttgggtggctcaccgtcaggtgctccgagacgcgcgtactcggaaactgtgcgtcaatgcggtcggtcagccgaccctttgatgtagtacatcgcgtgcgaagatgaaaaacatcttaagaaaccgggtcgcctaaggggaaaaccccacgtgtcttgggcgcgtcatgtccggcatcttcatgtatataagacggtgtttcaagacgacgtgagacccacacgcgggtttcacttctttctttaattatgtctccagtctacgtgaatctgttaggtagcgtgggcctgctggccttttggtactttagctaccgctggatccagcgaaaacgccttgaagatcctctcccgccttggttaagaaagaaaaaagcatgtgcgctcacccggcgttctcggcaccggttacgccgccaacatggcgtaattgacggtgagaactcggagaccgagcggtccgtggacttggtggccgcgctcttggccgaggccggggaggagagcgtaacggaggacacagagcgggaggacacggaggaggaaagggaggatgaagaagaagaaaacgaggctcggacgcccgaggtgaaccccatcgacgccgagggcctctcaggacttgcgcgagaagcctgcgaagccctcaaaaaggccctgcggagacaccggttcctgtggcaacggcggcaacgagctcggatgctgcagcacaacggcccccagcagtctcaccagtaagcaggggtaaacaaaaaaaccacagactccgggatagtataagaagggactttaccgctattgctgctattcatagagaaggatagaaaggatgactacgaccacgcatagcactgccgctatcatgagcctgctggacgaggccgagtggcgacagacgcagatggacgtggggggactgatccaggcgtcggcgttgggcaaggtggcgcttcgctacgcggtgaggaaactgatgaagcgcggagccaggctgcggcacgactcgggtctctacgtgtgcatctgcgacccttcgtacgagtttctgcagatgaacctgagcaagatcagttggctggagcgacactgccccccgttggaccaggagctcatcatgttcggggtcatcgaggcctgggaggaagcttcggtgcggcccacgcgtcagctggtgttgttcatgacgcccaagtgggacgtgttcgcctacgactccggtatcctgtttttcctggcgcccagcatggcgcagttctggcacggtgctatcgtgctggagtattggaacgctttgttcccggtggaggtgcgctcccacgtccgtcagcacgcgcacactatggacgacctggtgatggtcttccaccagctggactacgaaaagcaggtgctggaagcgcgtcgcgacaagaatacggaggggccgcgcacttttgccaagtcggtgaacagctacgtgcgcgccatcctggaatctgagcggcggatccgcgaagggaaaattcctatgaccttcgtggatcgcgactcgctgcgagccaattcgttggcccacatccaggccaccggggctcagccttctcacgccccggcgcaacgggtgctgtccgcgccgccgagcctgccgttgcccgtgtcggaagaagatcccgctgccgccgccaccccttcgtcctccgccgccaccacccccccgtcctctgtcgtcccggcctccgtcgagagcgagttgtcctcgtcgccgccgctgccgccggtcgtggtgaaggatgtcgtgtacacggccggggagggcgacgtggtacagatggtggtcgtggtctagaaggagaactttgctgctagatgaccatgttcagcttttttttttgtagtattttttcatagttgctatacctcagttatcccccctattagccccacatgctgcttaataaacatacttgtttcattttctttctagtgccgcggttttttgtcgcgtccacgggctgcgcgggtttcaggtaaaaacaacgtgtgtgataaacgtgggtttttacctacgggaaaggggagggtagaaacgtgagtctccgtcaataaaaagtcccgtgtcgtctccacgtaggtttctgtgtggctgttgttgacgctgctttggagcacgggacacggtgtttcggtccgatgtacgtaccacggtacggacgttaatcgcacttccaacaccacgagcatgaactgccacctaaactgcacacgcaatcacacgcaaatctacaacggcccctgtctcgggaccgaagccagactgcccttgaatgtaacgtttaatcaatcacgacggaaatggcacagcgtcatgcttaaatttggttttcagtatcacctggaaggctggtttcccctgcgtgtcttgaacgagagtcgtgagataaacgtcacggaagttcacggagaagtagcatgttttaggaatgacacgaacgtgaccgtgggacaactgacgctcaacttcaccggccacagctacgtgttgcgggcaatagcgcacacgagtccgttcgaatcatacgtacgttgggaagaaacaaacgtcactgacaacgctacttcttcagaaaacactaccaccgtgatgtcaacactgacgaaatacgcggaaagtgattatatctttctacaagacatgtgcccgcgatttctcaagaggaccgttaagctcacgagaaacaaaacaaaacataacgtgacagttacgggaaataacatgacaacgcttcccgtctggacaccggaatgcaaaggatggacgtactggaccacgttgtccgtcatgtggagaaaccgccgttcggctctcctccgagccaaaagtcgcgccttgggacactgggcgttgttgagcatatgtactgtggcggcgggcagcatcgcgttgctcagcctcttttgcatcctcctcatcggacttcgtcgcgatttgcttgaagatttccgctacatttgtcgggacgagggaagttccagcacaaaaaacgacgttcatcggatcgtctgacgtcaacgctgatagtgtctataaaggccgtgccgccgcgccgtagttctccgaaggcggacggaggagtctgtcgaccgcagcggtggctggagaagcgcagcgtcggcgagcgaaggtagaggagtccgtcatggacgacctacgggacacgctgatggcctacggctgcatcgccatccgagccggggactttaacggtctcaacgactttctggagcaggaatgcggcacccggctgcacgtggcctggcccgaacgctgcttcatccagctccgttcgcgcagcgccctggggcccttcgtgggcaagatgggcaccgtctgttcgcaaggtaagccccacgtcgttgaagacacctggaaagaggacgttcgctcgggcacgttctttccaggtgttttcaacgtgcgtggattttttctattctctaccaggtgcttacgtctgctgtcaggagtacctgcacccctttggcttcgtcgagggtccgggctttatgcgctaccaactcatcgtgctcatcgggcagcgcggcggcatctactgctacgatgacctgcgcgactgcgtctacgagctggcacccaccatgaaggactttctgcggaacggctttcgtcaccgcgaccacttccacactatgcgcgactaccagcggcccatggtgcagtacgacgactactggaacgccgtcatgctctaccgcggtgacgtggagagcctgtcggccgaggtgaccaagcgaggctacgcttcctacaccatcgacgaccctttcgatgagtgtcccgacacccatttcgccttctggacccacaacacagaggttatgaagttcaaggaaacatccttcagcgtcgtccgcgcgggcggcagcatccagaccatggagctcatgatccgtaccgtgccgcgcatcacctgttaccaccagttgttgggcgcgctgggccacgaggtgccagaacgcaaagagttcctcgtacgccagtacgtcttggtggacactttcggcgtcgtctacggctacgaccccgccatggacgccgtctaccgtttggccgaggacgtggttatgttcacctgcgtcatgggaaagaagggacaccgaaaccaccgtttcagcggccggcgtgaggccatcgtgcgtctggaaaagacacccacctgtcaacatcccaaaaaaacccctgaccccatgatcatgtttgacgaggatgacgacgacgagctgtcgctgcctcgaaacgtgatgacgcacgaggaggctgagagtcgcctgtacgacgccatcaccgagaacctgatgcactgcgtcaaactggtgacgacggactcgcccctggccacgcacctgtggccgcaggagcttcaggccctgtgtgacagcccagcactgtcgctgtgcaccgatgacgtggagggtgttcgccagaagctgcgagctcggacgggctcgttgcaccactttgaactctcctaccgctttcacgacgaggaccccgagacctacatgggcttcctctgggatatcccgtcctgcgaccgctgcgtgcgccgacggcgtttcaaggtgtgcgacgtcggtcgacggcacattattcccggcgccgccaacggcatgccgcccctcaccccgccacacgtttacatgaacaactgatcaaggaggggatgatgagcacgatggtcccgtttgtttatgtgcatgtttttgtatataatacagcattttatataacctttccctgtcttttctactcgtaaactgtgtacttcgctagtcaataaagaaaaccacactgttaaaaaaaccacgtcgacggtatttttattgatatcgacgtctcatcttgagacagacacgtagaaaaagaggaaaaaccgctttcagagatgccgtaggttttcggccagatcgtcccgcgggtcttcgacgtcgctgccgtagctagtgctcggcatgctgtcgggtccctggaagcgtgtgtgggccggccctcggggtgcgggtggcgggctgcgtcgccttcggtgacgtcggtggtggctgtaggctaccgagtagggcgaaaagagggtcacgctgaccatgcggcgtcgttgccggggcggctgctccaggtccgcggagctaatgccgtgcgaccccgacaaggaagaagagagcaagagacctgtggtagaagaagtcccggccgaggtgtacgtggacgcgggcgtggtggttcgtgtggatgacgacctggcagacggcagcgaaacagaattcggagatgctgaggacgacgacgaagacgcggacgacgaagaagccgcgtcggtcacaggacggcgaaaaacatcggcaaataaatcgcgatgttctgtgatctcgggttccgactcctggcccagaggcgctctgtcgaggagttccatgaagcgcttgggtgtcaggcccgtctgccgagaggcgccctcgatcatcatgctatagatgcgctggaggtgatacgtctcggtggtgatcttgccttcgtggaagttataaaagatctgcagggtttcgggccgttccacgaacatacgtcggcgcaggtagcggctgggctgttctggcacgcggaaaacctcaccgttgccgtacaggttcttggagaagaaaaagagctcgccctcgcgcgccgtgggatcggcttcgagatcgagctgggcctcgcgcggctcgccgtcgttctcctgctcttcgtcctcgtccccgaactcgccgcgctcgcgggcgtccgagaccgattggatctttttcagcagcttgtacgcgctgaaatgtaaatatcccgggcagaggtacacgttggcctcgtgcagttgcgtcagtagctgcaacagattgtacagcatcggctggaaggccggactgctgtgttgccgcgcaagttccagcccacgcaccagcgtgacgaaagtctgccgcgtctcgggggcttgcgtgtaacaaaagtaaagcgcgtcgcaaagccggttgcagcgttccaccacccagtcctgcatcatttgtagctccagcgcgtgtcgcagctgcaagtgtcgcagcgtcaacaacagatacatgtcgtttagcgcgtcctccagggtgcgtgagcccgggcgtttgatggaggtgaggcagcgcaacggtcggttacgacgttgtgttacgtcggacaggttctcggcgcacagatccaccgcctcgaccgtggtgaagggcggtgggtggaacagcaggttgtaggtggtgaggcgcggatagcgcgcctcggcctcgggagacgcgcgcagccccagcgcgtcgcgtacccggtgcagccggaccagcgctcgttttagcacgccgaatgtcacatcgtcggcgcctaggtgcacgctgatgtcctcgggcttgacgccggtttgcgcagcgcggcagagccggatgagccctctaagcagccgcgtcttaagcggatccgagtacagcacgtcgagctgcgtgcgcaggtcccgcaacacgtcgcggctgttgcggtagtggttagcgagtatgcagatacggataatctcctgggccacgggctttaccttcataaaagcgttgcgcacctggaagtccaccagggcctccagcgcgtatacggggctgggcacgccaaagttgagcagccccacaaagttggagcagccctgggtcaacatttcgagcagcaggcgccggtgctcgtccccaaatagatcaacccgaaagttgagccagtcgtccacggggagaacgggcagtggcgggcccgatggggctcgcgatccttgggccatgatggggctccctttgaaaacgaaaccaaaaccagagcggaacttgagaaatcaacgctttattgttctccagtgacgttaaatacacaacggggttatgggggacgtgacgggggtaagggctggggtgactgaaggtgagggggtcgcggcgacccgcacagcggtctggctggctagaggtccgtcttcttcgtcggcgcgatgccgcagggcggtcgctagcgtgtcgcagcgttcgccgccgttgccgtcgtcgttggagacggagggttctgcccgcaggaatgctgcggttgccttgcaggagggaaacagctcctcttcttcctcctcgttttcttcgggcttttgctcgtgaggcggcacgcgtgtgcggggacgacgggcgttgcggggcttcttggactcgtgaagcggcgccgggtcgctgtgacggagctcgtcgtcgtcctcctctccctcgtcgttgttttcatcggcctcgggcggcccggccgccgcgccgtgtgagagttccagggccgccgacaccgagtccgtatgaccgatctggaagagcatgcggtaggcctcgctgtggtaacagccgtcgaaaacttgtgcgatatccaaacctgagttcatcaacaggtgtaggaagctgttctgcaggtagtggcgcaggtgtccgatgagacggatggagcgcgcccacatgtgcggcgtctggtgcaacaagccgatgaggacgtggcacagttcgcggtggcgctcgtgtggcagcagggctaccagttgatgcacttccacgcccagcgccgatttttcgccgcagcgtttagtcagctcgtcgcgcgcgtagctcaccaccttgtcctggtgctcgcagtagtggcgcagctgggccgtgaaaaccagctggttgaagagcgcgcacacgcgcgacacagccgtctgcagctcgtcggccggcgtgggcggctcgcggagactgggctgcaggcggcagcggatactggccgtgacttgctggatctcgtgggggtccagttcggccggcgcgcgcttgagctgtgcgatgccctggtggaacttgcggtagtcgcgctcggtgcagaaaacgaagaggttgctgttgcggcgcgagcagccgccgggcggcacgggcaagtgcttcagcagcagcttcttcttgccttcggcgcgtaccgtgcccttgtacgctttggaaatcgagcctgccacgttgtcacgcatctcggcggctcgcaggactgaatcgtcgttggagaagtctcgggtggtgatgatgaagttcatgacgacgacggcggtggggcggtaatagtataggtccgtgcgagcaggccgccgccgtgggggccgcggagggaggagagggacgggaacgatcaccgctcggagaaaacaacgtcgacgggggacgttgtttttatcgtaccgtgccgagacagaagttgcgccggacggcgttgtggcgcgcaggggctccgacgtggcgttataatgaagccggggcgccactcctacgccacgcgattggccgtcggcgtccgcagtcgggcgaaatctgtgtaccgtgatgacagatcagggggacgtgtaccgtatatgaggggaaatggcgacgggttctggtgctttctgaataaagtaacaggaaagctcataccccgctgaggttatgatgcgattgtgagagtcgatgggggatttttgtggatgtgtcgttggacgcggttttctggccgcctttccacgtaccgctgggaaaattgaaagacacgctgcgtttggcgtgctgattgtagtttttgctattggtgtctaatgacgtagccactgattgtgaattgttgccagccgctagatttgtctccgctgtagctcgctgattctgctgcgatctcaggaaagcgcggcggtccagcaactgaccgcggaaacactgccgcatgcgttgcagaaaatcatgacccagcagcgcgtacaggatgggattaatgaggcagtgtaggtggggcaccacacgcgccagcgtgccaatggtgcgtcgcagtgtgaggtgttcacactgcatgggccaggcggttgtggcataactgttgaagatcatgagagagacgtagggagtttgtagcgccacgaaggagatgagtagcacgctaacaaaggttaaggtacgactcctttgtttctgtgacgtgcgctgtacggttgagtagaagaatgcgtagaaccacgtcatcattatcacgggtgcggcaccccataccatcgtcagcagcactttccacgaaagcagcactgtgtgcacttcttcagctacgaagtacagtacacaggtggcgtgcccattagtattattggtatcgttggcatcgtgatgcatcaccaccgtggtgtaaacagctgcgggcacggaaaaaattagtccagcgagccatgtcaatagcaaaatcatataggttgaacggtatgattggcgtgcgtatgttcgtttatgaaggacgcgataacgatcggcggcgatcagagctacggtggcaaagcccactgtgcagcttgagtagtagatcaccgatagaaatttacacgaggccacgccggccggcaacagccactggttgctgagtacgataaagggtagcacagtaagcgtgagaaaattagtagagtagaggttggtcatgtaaatggtgggcgtcgaatagccaagcacgcgattcgtgagcagctgcgtgatcaacactatggcgttaagtggaccgcccacgaagatgatgaatgtgttgagtacggcttcggtggttcgaatggcgaatagcggccctgtcatgttgcaagtgtcattgatgtgcggaggagtgttgttgcgggtctgggcggaacagcacacggggcgaaaaaacagaagaaacaagtcagcggcgcttaaaagaaaaccgcgtatccgcctccgctattaaactaccccccctccctctaggtggggcgctcaccgagttgtggatgatggtgtccatcgtgggcgaatagcagaccgcgggcgcagtccggggcgacgacgcttccgggttctggagaaaagccagcatgagtttgcagtttatcggtctacagcggcgcgatgtggtagccctggtcaactttctgcgccatctcacgcaaaagcccgacgtggatctcgaggcacaccccaagatcctgaaaaaatgtggcgaaaaacgcctgcaccggcgtacggtgctgttcaacgagctcatgctttggttgggatactaccgcgagctgcgttttcacaaccccgacctctcctcagtgctcgaggagttcgaggtgcgttgcgtggccgtggcgcgtcgcggctacacttacccgttcggtgatcgtggtaaggcgcgtgaccacctggctgtgctagaccgtaccgaattcgatacggacgtgcgccacgatgccgagatcgtggaacgcgcgctcgtaagcgcggtcattctggccaagatgtcggtgcgcgagacgctggtcacagccatcggccagacggaacccatcgcctttgtgcacctcaaggatacggaggtgcagcgcattgaagaaaacctggagggtgtgcgccgtaacatgttctgcgtgaaaccgctcgaccttaacctggaccggcacgccaacacggcgctggtcaacgccgtcaacaagctcgtgtacacgggccgtctcatcatgaacgtgcgcaggtcttgggaggagctggagcgcaaatgtctggcgcgcattcaggagcgctgcaagctgctggtcaaggagctgcgcatgtgcctttcctttgattccaactactgtcgcaatatcctcaagcacgccgtggaaaacggcgactcggccgacacgctgttggagctgctcatcgaggactttgatatctacgtggacagcttcccacagtcggcgcacacgtttttgggcgcgcgctcgccgtcgttggggtttgacgatgacgccaatctcctctcgctcggcggcggttcggccttctcgtcggtacccaagaaacatgtccccacgcagccgctggacggctggagctggatcgccagtccctggaagggacacaaaccgttccgcttcgaggcccatggttctctggcaccggccgccgaagcccacgctgcccgttcggcggccgtcggctattacgacgaagaggaaaagcgtcgcgagcggcagaaacgggtggacgacgaggtggtgcagcgtgagaaacagcagctgaaggcttgggaggagaggcagcagaacctgcagcaacgtcagcagcaaccaccgcccccggcacgtaaaccgagcgcctcccggaggctctttggctccagtgccgatgaggacgacgacgatgatgatgacgagaaaaacatctttacgcccatcaagaaaccgggaactagcggcaagggcgccgctagtggtggcggtgtttccagcattttcagcggcctgttatcctcgggcagtcagaaaccgaccagcggtcccttgaacatcccgcaacaacaacagcgtcacgcggctttcagtctcgtctccccgcaggtgaccaaggccagcccgggaagggtccgtcgggacagcgcgtgggacgtgaggccgctcacggagaccagaggggatcttttctcgggcgacgaggattccgacagctcggatggctatccccccaaccgtcaagatccgcgtttcaccgacacgctggtggacatcacggataccgagacgagcgccaaaccgcccgtcaccaccgcgtacaagttcgagcaaccgacgttgacgttcggcgccggagttaacgttcctgctggcgccggcgctgccatcctcacgccgacgcctgtcaatccttccacggcccccgctccggccccgacacctaccttcgcgggtacccaaaccccggtcaacggtaactcgccctgggctccgacggcgccgttgcccggggatatgaaccccgccaactggccgcgcgaacgcgcgtgggccctcaagaatcctcacctggcttacaatcccttcaggatgcctacgacttccacggcttctcaaaacaccgtgtccaccacccctcggaggccgtcgactccacgcgccgcggtgacacaaacagcgtctcgggacgccgctgatgaggtttgggctttaagggaccaaactgcagagtcaccggtcgaagacagcgaggaggaagacgacgactcctcggacaccggctccgtcgtcagcctgggacacacaacaccgtcgtccgattacaacaacgacgtcatttcgcctcccagtcagacgcccgagcagtcgacgccgtccagaatacgtaaagctaagttatcgtctccaatgacgacgacatccacgagccagaaaccggtgctgggcaagcgagtcgcgacgccgcacgcgtccgcccgagcgcagacggtgacgtcgacgccggttcagggaaggctagagaaacaggtgtcgggcacgccgtcgacggtacccgccacgctgttgcaacctcaaccggcttcgtctaaaacgacgtcatcaaggaacgtgacttctggcgcgggaacctcttccgcttcttcggctcgacagccgtcagcctcggcgtccgttttgtcgcccacggaggatgatgtcgtgtcccccgccacatcgccgctgtccatgctttcgtcagcctctccgtccccggccaagagtgcccccccgtctccggtgaaaggccggggcagccgcgtcggtgttccttccttgaaacctactttgggcggcaaggcggtggtaggtcgaccgccctcggtccccgtgagcggtagcgcgccgggtcgcctgtccggcagcagccgggccgcctcgaccacgccgacgtatcccgcggtaaccaccgtttacccaccgtcgtctacggccaaaagcagcgtatcgaatgcgccgcctgtggcctccccctccatcctgaaaccgggggcgagcgcggctttgcaatcacgccgctcgacggggaccgccgccgtaggttcccccgtcaagagcacgacgggcatgaaaacggtggctttcgacctatcgtcgccccagaagagcggtacggggccgcaaccgggttctgccggcatggggggcgccaaaacgccgtcggacgccgtgcagaacatcctccaaaagatcgagaagattaagaacacggaggaatagttaagaaacacacacgcagacgtactttttaatgaaaccatcggatagtgacgtgtcgggaaaggaggacggacggagggtcagggatggggagacgtgagaaagttgtccgcgggcaattgcatgtcgcccagaaagaacgtggttgttccggcggcgtgcatctgccgaaacaccgtgtggtggttgtacgagtacacgttaccgtcgccctcggtaatttgatacaacgtggcgatgggggtgccctgcgggatcacgatggaacgcgtgcgcgtccacagcgtgactttgagcggctcgccgccgcgccacacgctgagccccgtgtaaaaggcgtcctcgtgtggcaagttggccaccaagaaacaccggtctgtgatctgcacgtagcgcaagtccaactccaccgtctgccgcggttgcaccccgaagtggatatcgtaaggcgcgtgcaccgtgagcgaaaacacgttgggctcattgagaagcggacagttgagcgcgtcgccgctaaaaaagagtgacgggttgcggctgaatcgcaggtcgtacccgcgctgcgcgctcgtcagcaggtagaaggaaaaagcgcgcggcatgttgcgcgccgtgatcttgtccgagacgcggtgacagaaggaggtggccacggtgcccagcagttggcgctgttccgcgtccacgcatagtgaatccacgttgacggtgaaaatgagacccatgaattcgtactgcacgtttttggacgcgatccacgcttcgtcctcgccgggtagcgctgcctcgtcgtcgtccatcgtgccgcggaactgcgcgaggtagcgcgtaatttttttgtgtccgtacgtggttacgcgcttactgatccaggtcagatggtccacgcgacatagcagcgtcgcgccatgccgcgtgacgctgacccgtccaaagggcgccgcctcctccaaccccgcaacgccgctcggagcaccgccgcagcccggctttcccggcgtcgtgaaaggcacggcgtaatgcgggcaggcgtgcggcacgaagggcaccatgaccagttgtgtgtgcagaaaaccgatctgcaccgcctgcgactgccgcatggtttcctcgtcgtaaaccgccatggacgagcagagcccgcccttggtgatgagcggttgcagcaccacggagctctcgctggtggagcagagcagaaagaagagctcggcgtacgccgccttgggcgtcaccacgttggaccagtcgtacttgtagccgcagccctgcgtgttgttgtaaatgacgggaaacgagagaaagatgcagccctgcacgtacgaagctttctccgtcacgttcgaggccgtgttgtactgctcggtgatggacaccaagtacgactcgtaggccgtcaggtgcgaggccgaacggtgaatcttggcgtggcgcacgcagcgaccgtagttgtcgcggtccgcgtcgcgtagcgcttcgatccacgaggtcaccacgtcctgcgccggcagacgatagtcctgctcggggtccatgtggcggcacagccgcaggcgctctgccagttggcgagggataccgtcgtgcgaccttttgaccgcggtggtgcctgtcgtcctcgtctcccctccttcgttctccctgttttctcttctctcattcccggtctccggatccgcagccgctacctcttgctccgcggttttctcgcccacctcgctcgtcgctgtcgccgccaccgcagcggcggcgacggacggcggcggtaacaacagctccgtgaagctgacgagcggcagcggcgacgacggtggcggcgacgacacggcgacggtcaacagggtcacaagcgtgggtttgtcccccataatctggtcgccgccaccgccgtcgttgccggtccccgtttcctccggcgtcgcggtttccgccgtctccggatgagcggccgcggcgcgggctcggcgtcccgccgtccgagacggtgtatataaaccgcgtcggcctcgccggcccgagcgcgccggggagaagaacctcttcccgggccccgcgttcaagacggcgtgccgtgacgctcgatgggtccgcttcatcagactgcgtacgctttggagcgtcagacccagggcgcatgtagccgacttggaggactttgccgccttttatcgcaccctctcggacagtgagcagcaggagttcgagcaagaagccgaactcgcctcccgctcacaacgcgtgcaacacctgcgcgaggcccggcgccagctcaagatggacctgatgtgtcacggcggttgaaaacgcgcatgatctcgcgaagccatctacgcgcctgtcagggcgatgacgacatcagcgatgacggctcctgatacgcgccggcagctgcagcacgtggagacgctgcgtcggtttctgcgcggcgacagctgctttgtgcacgatctccggggcatgatggactatcacgacgggctctcgcgccgtcaacagcgtgccttttgccgcgcgagtcgcgtgttgacggacccggagcccatccagagcgaagcggagggggagaataaacagtttacggagcacacacacaaagtagtctcgttttttattaaaagtgtctttgtatttccctatcttgtgttgcccaactgctgtcaggtctccgtagatcgctcccgggtgcccgagacggggggcagatggctataaaaacccaagtagcggcgcgccccggcgttcagtcgcggctgagcgtgtggaggacggggtggagcgggtcgccgaggctactgctgcttctgcttttttgtctcctgtggatcgtcgcggactgccggcatgtccggccgtcgcaagggctgctcggcggccacggcgtcttcctcctcgtcgtcgccgccgtcgcgccttcctcctctgcctgggcacgcgcgtcggccgcgtcgcaaacgctgcttggtacccgaggtcttttgcacgcgcgacttggccgacctgtgcgtgcgacgcgactatgagggcctgcggcgttacttgcggcgcttcgagggctcgtgcgtgtcgctgggctggccctcgcagtgcatctacgtggtcgggggcgagcattcgccgcactcgctgaccgagatcgatctggagcactgccagaacgactttttcggcgaattccgagctctgcatctcattggcacggtctcgcacgccacctgccggtaccaggtgttcgtggacgcgtacggcgccgtgttcgcctacgacgcgcaagaggactgcctgtacgagttggcctcggatctggccggattttttgccaagggcatgatccgctgcgacccggtgcacgaatccatctgcgcgcgtctgcaacctaacgtgcccttggtgcatcccgaccatcgggccgagctgtgccgccgctcgcgcgcctccgctcgcggccgctacctacgttcgctgctggctttccgcgagttgctggcctgcgaggacaccgccgctcgttgcgcctacgtagaggcgcaccgcgaggcgcaactgaccctcatctggcccgagaagcattccctagtgctgcgcacggcgcgcgatctggggctctcggcctcgatgctgcgccgctttcaacgttcgttgtacacgcgcgagcccgtcatgccgctgggcgaaattgagggcgccgaggacaagaccttctttcaccgcgtgcggattctctgcggcgacacgggcaccgtgtacgcggcgctggtggggcaggataagttggtgcggctggcgcgcgacctcaggggcttcgtgcgcgtggggctggcgctgctcatcgacgactttcgctacgagagcatcggccccgtggaccgcagctcgctgtacgaggccaatcccgagctgagactgccgttcaaaaagcgtaggtgagtcatcagtgtacacgcgcccagaaatagggcgacggtgtttttataaccgaaagtagcgtgtttgagacacgcgcttctggtcggttttttcaccgtcgtcgctctaggtttgattttcgcgctcttgtgtctcccgacaggctcgtcgtgggctactttgactcgctctcgtcgctctatctgcgcgggcagcccaagttcagcagcatctggcgcggtctgcgtgatgcctggacccacaagcgcccgaagccgcgcgagcgtgcgagcggggttcacctgcagcgctacgtgcgcgccacggcgggtcgttggctcccgctgtgctggccgccgctgcacggcatcatgctgggcgacactcagtactttggggtggtgcgcgatcacaagacctaccggcgcttctcgtgcctgcgccaggctggccgcttgtactttatcggcctcgtcagtgtgtacgaatgcgtgccggacgcaaacacggcgcccgagatctgggtctccgggcacgggcacgcctttgcgtacctgcccggcgaggacaaggtgtacgtgctggggctctcgttcggcgagttttttgagaacggcctctttgccgtgtacagcttctttgagcgcgactacgtggatgagatcgtagagggcgcgtggtttaagcacacctttgcgggcatgtacgaactctcccagatactgcacgaccgcgccaatctgctgcgcgtatgtcagctccacgccggtagcaagatccgcctgggcggctcgcccgcttgtactttcactttcggctcgtggaacgtggccgaggccgacgaggccaacaatttcgtgatcggcgtgctagaacaggcccattttgtagtcatcggatggatggaacccgtgaacaaagccgtatttatggacgcgcatggcggcattcacgtactgctgtacggtacgatgctggttaagttggccgagacgctgcgcggttttatccgtcagggctccttctggtttcgttgcccacggcgtttttgcttctcgccgttggactcgagcgcaaccgtcgccgcgaaaccggtgagcagccatacatcgcccgcgtacgacgtcagcgagtacgtgttttcgggccgtagcgtgctggatagcgtgagcggcacgggggcgtcgtgaaggaggagactgtgatgactagctatatagccggtgtctggctttaccgccgtcgctccgcgtcgcttcgccgccaccttcttcttcctctcagtcatgaaccccgtggatcagccgccgcctccactgccaacccagcagccggaggagcaggctaaagaagaccatgacgacggtgacgagcgcctatttcgcgatccgctcaccacgtacgagtatctcgacgactgtcgtgatgatgaggagttttgtcaccagttcctgcgcgcctacctgacgccgattcgtaatcgacaggaggctgtgcgcgccggcctgttgtgtcgcacgcccgaggatctggcggccgccggcggtcagaaaaagaaaacgccggcgcccaaacatcccaagcacgccatggtgtacattcgccgcagctgtctggtccattcagcctgcgctacggcgcacggcaagtacgacatccgcggtctgacgctcgagtcggacctcgctgtctgggccgcgcttcgaggcgtgcccttgccgcccgatccgcagcattttcgctggctcaacgccggcgctttccgccgtctggtgcacgaggcgcagtacttgccagagatcagtcgtgccgccaaacgcatcgctctggccgtggccacggggcaatacgtggtgtgcacgttgctcgattacaagacctttgggacgcgcacccattacttgcggcagctatgctcgatgaccgaggagctgtacctgcgcctggacggcaccctgtgcctgtttctggagcccgaggagcgcgaactcatcggccgctgcctgccggcggccctgtgccgcgggttgcccgtcaagtaccggacgcaccgcgccgccgtttttttccacgccacgtttatggcgcgagccgaagcggcattgaaggacctctacgcggccttttgcgagtgcggcgacgggcgcgacaacggcggtaaccacgacggtaaccacgacggcaatgaccactcctctttgtcgccctccgcggtggcgtcccaccattcccgtttggagcacgccgagctgaggctggagcgcaaccgacacctgggcgcgtttcacctgccggcgatccgccacctcacggccggcgacgtggcccgcgtccaggacagcgtatcacgtgacctgggcttcgccgactggtcgcagacgctgatcgacgactactttctgctccccgcgggctgggcctgtgccaacccgcgtcgcggctacgccatgtacctggcctctaacgccgtgctggccctgcgtatcattcggctgctgcgcgccagtatacgtcacgagtacacggcgtgtatacgtatgttgagcggggacgtgcagcggctcatcaggctgtttaaaggcgaggctgcgctgctgcgcaagggactcgctcagaaccccgtgcaacgtcgagaactgtcgcggtttcgcaaacacgtccacgatctgaagcgcattcgcttcaccgaggacacgttcgtggagaccttctgcgactttctcgagctggtgcagcggattcccgactaccgcagcgtgtcgctgcgcatcaagcgcgagctgctgtgcctgcacgttttcaagctgcgccggggctgtcgcgcgccgccgacgcccgagacggcgcgcgtccagcgcctgctctggcactcgctgcgacacggggacgcgccgcaggatcgcacgcggctgccgcagttcagctcggcgctctcggacgccgagctgagcaaccacgccaaccgctgccgccgcaaggccccgctggaactcgggcccgccgtcgtcgccgccccggggccctcggtgcgctaccgggcccacattcaaaagtttgagcgtcttcatgtacgccgttttcggcctcacgaggtcggaggtcacgccacatgaagccgcggcggcgcgttataagcaccgtggggtcatcgaccgacaaggcgcggcgatgacgagtaggcgcgcacccgacggcggtttgaatttagacgattttatgcgccgccagcgcggtcgccacctggatctgccctatccgcgcggctacacgttgtttgtctgcgacgtggaggagaccatcctcaccccgcgcgacgtagaatactggaagctgctggtggtgacccagggtcagttgcgcgtcatcggcaccatcggactcgccaaccttttcagttgggaccgcagcgtggccggcgtggcggccgacggcagcgtgctgtgctacgagatcagccgtgagaactttgtagtgcgcgccgccgactcgctgccgcagctgctggagcgcggcctgctacacagctactttgaagacgtggagcgcgctgcgcagggcagactgcgtcacggcaaccgctcgggcctgcgacgcgacgccgacggccaggtcatccgcgagtcggcctgctacgtgagccgcgtgctgctacgtcaccgtgtgacgccgggcaagcaagaaatcaccgacgcgatgttcgaagccggcaacgtgccatcagcgctgttgccgtaacaaaataggaaggaaaaaacacgtgaaaaaaaaacccggagaagacagagaggacgagcgtccacacaccgctttggtcgtagacgcactttttattcttggtacattaaaaaaaaaacaacacatactttcctgtgactttctatcataaactgttccgccctgctgtttcgtcccaccatcagcaacagtattccccgctgtcgcggcggtcgcgacggtgacggtcccgctcgtcgcgttgaggatagtcgcgcggtggcagcgggggtggtggggatcggcagatttgttcggggtgattaccgttcgcttccataaacgctttaagagccatctcgcgtaacgtgtcttcttcgcgttcgtcgggggggacttggctaaagattttgagcagggtgacggaggagacacccgtgtgttcgaccggaatgtgtcgactcgagggctgcgcttgcaaccgcgccacgcatatgtcgcgggtgatgagtttctggcgcaggtgggtggcgcgcgggtcgcgcaacagcggatcgcgcaccataaactcgcctacgaggcgttgggagctactgctgccgccggtgtcaccgataataggtctgtcgggacaggccagcagacgcagggcgcagtacacgtagtcggtgcaaatgaaggcgtcctgctgacgcacgacgcgtaaaaagtcaaacaacgccggcgtgctcgcgtagagcgcgtagtcgtagttttgactgacggcccagtagatcacgtcactaagctgcgcgtagtcttcgcgcaacgacggcagttgtacatagatgaggtaacacagctccgagatgctctgcagctggtgctggagatagcagcgcagcacgcgaatggtgcgttgaaagtgcgtgatcataagctcgacgcctactaggaacgccagatcgttgagcgtgtgctcttcgcatatctcttcgaccgaaagcagccggagcatgccccggtggttctcgttgagccgctgcaggttttgccgatagaggtagagcgcgccgcgcgaggtgtagtgggcggtatagaagagcacgttgtaatcgcgtagcgtctggtaaacctcggtgagccgcggcgattcgggcgtgccgcgatgccgcagctcttcgtccagccgccgcagagacgtggcgtactggccgtccgtcactccttttcgtgacgtgagaaaatgaagcgctagcgcggccgcacgccccgaacggctctggttgttgacctgcgcggctacccggcgtaccgtgtcgccccgcacggtggtccgtatggcctccaccatgtggcgcgctttcttttgcgccacgtagtaatagttgatgatcaccgcgtgcgtgattatccgacgcgtgagatcgcgctcgccaggcgctacgttgtttaagacggggtcgacgaggctggtgagcgcgaaggccggcatgggtatgcattcgttgaggcggcggaggtgctgcacgtcaaagtcttgcagcacgaatttgagatactcgacgtgctgcggcgcgaccacgctgggctcgaagcccagattgtcggccacgctgacccggtaacattcgcgctcaaagtcttcgatgtcgctgtcgcagaaggaaaactcatcgccctcggcagcggacggctcacctggcgccacgggactggtacttctgctactgttactggtggtgcgactgctgctaccgccgctgctgctgttatcgtcgccaccgccgccggcgccgttctcgggcagcgagggcacactaggcggtcgcgagactttaggcgacttgccggccttgggtgtcgccggcgagccccgaggcgcgcccgctgcgatctgcggttgccgacgcgacgacgatcgtttcttttcgctcggtttcttggcggcgccggtgccgccggtctcgcgcacgagctcgaaggacgacggagcgtccgaggagacgctgtagggcgacaaaccggcctccatgcgatccagatcttccgtggcgctgcgcgcccgcgtgctcgtgaaaacgctgtcctccgcctcctcatccgccggcgtgtcctcgttgctcgaggggatataaatcaccgtcgagggttcgccagagcgacgtgacgagctgcgacgccgcgacgacatcctctcgtctgctgaggtgcgttcggctcagttgcttacctgcatacatggaggagacccgggcgggacgttatatagtgagggccggctccggcgggcaaaccgaagatacagcctcgggcgcggaaagtgtcctcgccacgctggccgcggtgaggacaagaagacggagcgtggtgtgcgacgggcccccgggctcgcccactgactcggcgcgtcacatgagcgatctggctagcctggcgctcacggccgagttcggcctgggctgtctggaagcttacgtgcgcatcaacgcaggccaggtgttgcccgtggtctggccgccgggctggaacctagtgctgcaggagatcgagacggacgaggacttcaaaccggaggacgtgaaggcttggagtcactacctgtgttgccagacgcgcctggccttcgtgggtcgcttcgtgaacgagggcgtgttgtcgccggatcagcagaagaagaccgctgtgtgcctcatctcggacgagggctatgttttttgctatgtacgcgaggacaccgccgtctactacctggcccgcaacctcatggagtttgcgcgcgtcgggctgcgcgccgtcgagaccctgcactgcatgcgctacctgacctcgtcgttggttaagcgctactttcgcccgctgttgcgcgcctggagcctcggtttggataccatggcgcgattaatcatccgccaccacgggcagttcatgccgttgacgtacccgccgggaacggaactgcgtctatgcaacctcaggtgtttcgaaaacagcgtggaaggcggtcacttgctgcgcaacatcaaaaccgctttcggaatgcgcgttctcggcctgggaaccgtcagcctcaagggcgagaacgcgccctttcctcacttgcgctggcccgtcgaccttatccccatcgtcgtcgcctataccggggccgtctacgcctgcgacgtgcgcgacgaccgctacatccgggtgggagataatctcaacacgttcatgtgtctgggacttaacctgctgtttgaaaaccgacgtttcagcggccacaacggcatctacgatcgcgtgcccgactgccccaaaggacgtcagcaccgttgactgtgacgccacgagtgacgacgacgctgcttggggcataaaacaccgacgctacttcccgtttgactcgcgtgccaattttttcgctgccaacgccgtcaaggccgcctcttctggccctccgccacccttcgctcgagcacggcggtgttttgccgtcgttttttttttccggatcggcccgatttctttttgtccaccgacgcgcgaccgcgatgtcggtaatcaaggactgttttctcaatctgctcgaccgctggaggcctcctaagacgtcgcgaccgtggaaacccgggcaacgcgtggccctggtctggcccaaagaccgctgcctcgttatccggcgtcgctggcgcttggtgcgcgacgaaggacgggatgcacagcgtctggccagctacctctgctgccccgagccgctgcgtttcgtcggcagcatctgcacctacaactttcttaaacacaagggcgatcacaacgtgccgtctgaactgtacctgggcgcctcgggcgccatgtacctgtggaccgaccacatctactctgactcgttgacctttgtggccgagagcatcactgaatttctcaacatcggtttgcgacgctgcaacttcatcaccgtcccagaggagctgccgcacaccgcctcgcttagagcgctggccggctgcatgcacatccacgcgttcgcgcagtggcgtgctacgtatcgcggccgactcatggtcatgggtgattacagcgtcattcgcgtctccacgattcggctgtacgactggagcgagattaacgactggagggtcatggtcggcagtaaccacgtggaacctttaggctggttggtgagcccctacgacgtgatcaacctcttcgtggacgactgtatgcgcgtctttgctgccaacaatcagcacgtttgcatcgtggccgacagtttgatggagtttgtgactcgcggcatgacacgctgccacgaaaatggcatttattacggaaccaggagcatgcggaagctaaataagcctacctgtccttacggagtggaccaccaactttttgacgacgcgtgaacccgcgtctcccacggaccgtgtgccttttttttccccgttcctgtaaataaaaagctgttttttatttttcatacgaaccgctcgagtcgcgtgtgttttgacggggctgggtggagagggaaggtcgcgccgccgcagcatcccgcatagcctctacaaactagcattctggtgagatacatgttcataaactctcacgggaaggctagttagacaggctatgggaagaaaccgtgtttcgcgtgccgaatacaaaagaaaaaagaccggaggcggggtgtttttagagcaaaaccttacagctttttaataaaaaacaaggtagtcaacataatcgttaacccttggggtctgctgttactgaatcttcttttcattttctttggcttgattttctttgtgttcatcagtcttttgtggttgctgatgttcgctgccatctccgtctgtaatcaaaacgtcatactccccggagtaatcttcgtctccgtcggtggtggaccccccctgactgagagttacgttcttgctgggggtggtattactaccatcagcgctggtactgggttgttccaccgtcacgctgcaaaaacacgataaccgcgttcacaatcacgttattttttgtatttcttacctgtgttgaattccccagattccgtttacctgcgcttcgatttctgagaaggtgccgccaaagccaccgtcaaggtcacggctagtaagctcaagatccatagcctccgagccatgctgaggtcttgtcggcgtcgctgctgacgaacgcgtctggctgtgtgccgttaaataccttgggtgacgacatctcgaggtcatgtggccgcttctgaaaaacaacgtagtccggacgggtcgcagatacgcggtttttcaacctcgacggtttacgcctcgcccccaacatgacgcgttcgggacgaaagacgacgtcaggggattcacggtatttagccatgcagcgtgcggcgcctctctcatggatccactgtcaccgtcgcgatgggaggtagccctgttccccagctcaccaccgtcactcaaggactcatgccatctgtgcgcatggactttcgggctcgccggcccttgcgccgcttggctttctacgcgccgcgagctcgtcggaggcttttccaaaatcatatacatccagaacagcgccgagtgctggtcggtgagggagacgaagagatgttgccggatctgccgatggagatcgacatcgtcatcgaccgacctccgcagcaacccctacccaatccgctggtgctactgctggacgatgttcccccccatgtacccggttttgctccttaccgcgtcccccgtccccaccccatgattcccgaagaacattgggaccagttttaaataaaaacattttatttacatctgtacaaggatcatataaaagtctgtatattcagtccattgtcagtatttttgtgctcaagttcagtgtagatttatggaaaatatgtagtccgtaccgcttggggctcaaagttcaaagtccgtcatgctggcatgcagaccaccatgtgcatgggcccaggcgacggcggaggagacggcgggaattctattaagtggggaggtcgtggaggcagcgggggtggtagtacccacattttgctctcccggatccaagggacgagcagccgccgcgtgcggataggcacctggacttcaatgtccttgtacgttaacaatttttctttttcctcctcttcctcagtgaattctggcaagagttcaaagccgcgtgggcatatcagaagccggccacagcgatagtaacagatgaggatgagcagcgatagggagacgagtataatagatacggtacctgtgattcccgcgcaggacacggaaaacaaatacatgtatctacgacccttgtcgagtatataagcttcctgcagtccgcatgtaagcactgccaagggggtcaggataacatagtccataaattcttctggtacgtcaccttcagatttgttgtaccattccaccgtggcgttgagggtatactgtctagggagcagcatgcagcgtatttcatttcccaacgactgaattctgacagtgtcgtgagaagcattagtaacccaatctttccatagctggcacatgccgaagaagagatatcccgaaactgtatttttacaagtgtcaattgtatggttataggcatttccagagtaccaataagtattgttgtcagcgcagttcagaagccagatggtagttagataggactcaccgcggttgatgcaactctccgttaggttagtcacgctccaattaccctccgtggaagagttagttgttgtgtttgctggagtgaatctgaatgcctcggttaagttggtgtagtttgaatgcagacccccgatggctgtgcgagtaactccgttggccccggtaaggagagatacaaagatggtatcggtattgttgcttcgagtgtcattgtttgttatcaactgtatccagtagtaatccagcatcaccagcatagcccgtatcccgagcatcttgccggacactgaacataacggcgtttgtatatataaagaccgttccaacgcaacattgaggtgtcattgacgtctttattgacgtggttttaccgcaacttcctcttttcgcaggttgaatgaggaacccgcgtagatccccaacgccggtttcatcataaaccaccgtgagaaccggcgcgggtttcaacacgaaaccgcgtcactcacggacgtaggttatttcgaaaacctacgttaatcctgaacgcgttttgtgtcacgcgtccccgcgactcacatctagctcgtcttctgacgctacccacgaatttcgtaaccgaatccgcttcagcgtttccattaaactggcgcaatccacttctgactgactcggtcgctcgatgcgcacggacccgtgatctaacacgaacatagtgtagtgggaattcgtggcgatggacgtcaaccgaccgcagaacccatcacgagtgcgtcgcgtgagaaacatgaccgtgttgacgggggcacgcggtaacctacgtcgaaacagctcatacagggcgttgctggtcatgacgaccggaccttgcgatagcgccacgcaaaggccaggttacgtaggtattgtttcaaggtggtaaagtagtgcaggaacgcgaatagcaaagcgcataaaagcagggctaggaggacactgctgatggtcatggtgttatagcgtttgttagctgtcgggtgatcagggacctcccccgaggaactgtcgtcaggtgaggtaacgctgatggggatttccaccgtccaattaccgtgtgtaacgcggcaggtgtagttttgattgcaaaagatggctacgtaacatccctgatggaaagtcccatccaaggtgggaagtagcggattgcattgaggctcgctatcctcgggcaccttatcaccgtaatgaataaaagtaatattaatttcccctggaaagaacccgtaagatgtacagaatgcttcagctctgttgtcattctggtttcggacaccgccctttaccactgggtgggtgacggggggttgaaacccgctataaatgacggaccattgagtgcaattacccttgagatagttcctttgtattgtagtatccccctcgctgatgtttttaattttaccgtcgatgtacgttttgttttgcttcaaccaactaatttcgtaattggggcccgtccatagtgtcaggttatccttgagctccattaaagtttccccgtcccacccaaatccctcgtaaccggctacaaaactaccgttttccgtggtattacactcgtgcgtccacgtcagcacgctctgtgaccggtaacccaacgcaatttccagctctaacaggttttgctcggtttggttaaaaataaggtcacctttggctctttccccgtccaggtaggtggggtaggccgccgagacgttagccatccaagaaatggtaccgttggcccgacttgacgctttatcgctggaattaacgtgataggtaaaaaagtgttgcccgtcaaaaatccccacaacggtcaacgtcatatgcgatgtatcatcgaaaatccccgtgtacccgtaacgcaacacgtgcattcccaccactctcaacatccacagcacaaacaacgtcagacaccacattgtcatcatggcgttttattaacagttcctcggacatgatcggcgttatatactttcagtccgcgttttgacccctcctatcttctttgatgatgtatcctcttagccgtgtgttgtttactcctcctcttcgggagaccgtgccggatccgacatcagtggctctgagtcctcccgaggaaagaaaagtcgtcgaaacagccagcacaaatcgtgccaaaatagaaggacggccgccttttttcttcttttgggaatctcggcgggcctctgggggccgcacggagcgcgacgtcgaggtagatgtttgcggcgcctgtggtaaaccgtggtgtcccaggatctcttagacacctgttcgtccagaatcaacatttccaaccgacagtgacggggtcggccgacgaagtgtgtgaagagcgcgtgatccatgctcgtggcaacggcgtgccgcgctcgtgtcaaagagacccgtccacgggggacatggccttcttatagcagcgtgaacgttgcacgtggcctttgcggttatccgttcagtcctcggtgcgtaaccgctggtatcgatgcggcaggcgaatgcgcagccgctgacacagtcgctgggggatccgtagggccaacaagaagaagaacagagtgatggctgagaccaacacgatgtctctcgccaaggtcgcggacagttcctcgtcggcgcttacggaggggtgtttggcgagcccggatccgggcggtctcggatatagcgagcccaatcggacgtagaggcgctcgattattttcgtcgtaccgttctcgcagcgtaaacagtcatagcggcccacggtaagattagtgaccatgcggctggtgtacagtttagtcacagggacggttcgcattttcagtccgtcttgcaagatgttagtggtgatgtcgctgaaattgcggatcaccgtgtcgttctggtacaaccacaggtcaaccacagactcgttatgctgccaagtaaaagccacgccgatgatctcgtcctcggtcacattctcgtagtagcagatagaaatacacatcccgtgtaacgtccacgtttccccaggatggatcgaggccaactccgtcacattcaagcggcaggtcgagttggaggacttgctacccaggtcaacagcacacgaggaagaggcagataagcaaagaacaaaaaacacccatcccagcggtaccgtacctcggcgacgctccatgccggcgcctaacggtcctttgtgcgcgctcctcataagtacccaggcttttgaccccagtcggtacctacgtcagcatggagcccggtgtccgaggaagaaggaggagaggacaacgaggtccccggtaagattaagggtaaacatccgaaacaggtttatccccgccaatattcccaataaaatacaaaacacgcgttccttgacatcgattcaaaatttattgtgcgcgataccgcatcgccaaccacgaacacagtccaaaaaccagaaacatgaaccacagcccaatgtccgccttctggtgatcggtccgcgtacaggcggacgtttcattcgccgaaccgcgtctggtaccgctactgtgggcgatgggaccgacgtcggagtcgcggcgttcgttggcgccgctgccgcgtcgggtaccgctgccgcagatgggcgcaccgacggcggagccgcgtcgctcgccggcgctcgtcatctgacattccgttttcctgccgtgactgcgaatcatccgcttcatggctctcctcgtttactcccgccgctgctcttcctcagagacggccgccgccgctaccgcagaggcttctcccgcggcagtttcctccgccgcctcgctttcctcctcggtgttcagacgccggtacgattcggaacaccagtagcacagcaggtggcagagggaggtcagggccaccgatcccgcggccagcaacccgatcttcggatccgtcagccagtaatccctccgtagatgatagcgccgcctagcgccgtcaactcgatgccggcggctgcagttgttgtccgcaatgctctggctgatgaagggcacgcacagttcgcgctcgtcctcctcgcacgagggcagcaaacccgaggtgccggggatgtagtggactacgcggtgccgttcaccctcccaaccgcagtttatactgcgcaacctggagggatcgggcgtccacaggtaccgcgtctgtgagcgcgatccgaaagccaggtcgcaggagcggtccgagtggcgcaggtcgtgcacgtcggccaccagcgccgtggtctcggtcgccaggctgtgggtctcgttgcccagcacgcaggtgtaggtgcccgcggtctcggtgatgagccgaaacgagaggctcagccgctgcgccgcgccgccgtcctcgaagcgccagcgcccgccggcgatgtaacagctggcgtcgttgtgtaacacctgaccgctgcgtgcgtccaccaccagcgaacgcacgatctcgggccagtagcagaggtggactcggatagagacctctggccagtcgtgcgcggggaagatgcaggccacctccagacggtcgccgtaaggcagcaactgcggtgagcccgggttccgctcgcggttgcggtcgcgcaccggctgcagacagggcgaacgcaccaccggaggcgcatcgaggcagcagttgccccactcgctccaggcgatcagtagcggcagccacagcggcggcagccgaccaccgcccatacctgtctgtgtttcagagctccttaaaaagaccacacgcgaccacatattatatataaggtgcgattggcagattatctttattggtagtgtttaacacgcataagcgaccggggatggggggaaataaaggaatggctcggtgtattctaaatcgtcatgggccgtcgaaccaggtagctcgagacccacagtcctaagcatagacgaaacagggcacgatgcgggggttctcggggcggacaggccacggtcagcgtatttgtcgtcattggcggcgattcacacggtccaccttcctcgttctcctcctgtgacctcctattcagttctccttgtcccgctggataagtgacctgcggctcttgaacctcatgatcatcatcatatcttcccgcattattccttctctcgtcgtttccacttgctcggctcccatcattcccttctctcgcgccctctctcgaaacgtcctccacttcttcacgttgagtgtgcgttgaatttcttgtctcctctcccgtaagctgttgacgtggttcctcgttctgccggagcaccgtgggtgccggcggtatgacggccagttcttgcgcttcggccgccgggttctgtctcggaacccacgtgcgacgccaaaacgtggttctttccacgaaccacgtacgtactcgcgtggccgtctggctcacgacgttgctttcctcccagcgggttctgatctggctagagacctgctgtgtccaaccgtggcaccgtaggcggaacagctgccagcggaccgtcagttgttggcgtagttgacggagtcccgcaccgccgggtcgcggtccgccggtgttgggaccgcttcccgcgggatgtctcagacgcccgcgtccgaaacaccgttggttggagaagcgtattcgcgtcaggagcagcgagtcccggctgcggaccgtcagagcgttatagcgccgtctttcgtgccgtcgccgcactgcgttctcactcgcgtcgtgcctgacggtgctttctgcactatgtggtgattcggtacgttctgcgtccgcgtctcgtgcatcctctgccggctgcgatggtggatccggaggggggaacgagggtctcggaatcgcattgcgcgactgatttcgccgccgttgttcttccaccagatactgcagctcttggtactgccaacgtatcccgtctcgcgacggcagttcgggtgatacggcgtgatgctgtgatgacggcggtctcaacggccgcggggaacgcacatcgtagacgggcaaatgcgggagcgatcccgaccaaagcggcggtcggtccaggtcaacggcgtttcgccgcgtcatgaccgacgctgctctgacttggaatccggcgtgctgcatggcttggcgcactatggacagctggtacgtcgctccttgtatctcccgtagccactcgtcctcctcgacaatgtccaagccgtgggcccactgcggccgctggaaaaggagtaagaatggcagtctacacagcagcagcgggagcagatgataacgcaagaagcgaccgcagtgggcccacagcatgctcttggtctttctagggccggtcaacagctttatgaagggaatcagggacgtcggctttggaaagccccctcggatcctttcggtatcgagagcgcgcctggcttcaaatacgtcaaaggcctgtccgccgcgccagctggcacggagttggcgtttcacagtgatttcatgcaatcatttcctacgcgacttgctcacagatcggtttgagggatgagcacgatgccgtgcttgtcatgctgccagagcagccacagcttttgcggtattcgaaagtagaaaatgataatgatgataataacgattacgaccgctaaaacccagagggcgtgtgtagccacgtgttggtactgtgggcttggttgtaacggtgtttccgctgctgtggctcctaaaccgacgtgaagttctacgtgggttttaggggtggtggattctttgggattggagtgtcgatgatgggtagtgcttgtcgtcgtcttcttggtggtagtggtggtcgttgtcgtgctcgtggtggttgttttctttgttgtggtggtagttgtcgttctcgtggtcgtagtgggttttttggtggtggtagtgggaagtgttccgttttgggtaacgtatacataataacatgtgtctaaagtccatttgttgccgtggttgtgccaattatgggactgatgtacgaatgtggtcatggtgcgatagtaatcagtatattcttccgttacattgatgagaaggagactgtgatttgtaagacatgaaaaacttcgattggtgtttttgtgaatttcgtctagccttggtgtatagcgacacattaatctattagctccacctccaccaaaagaccagtacacatagtcaccgtcatgcacatgtaccgcgttcaatgtgacgttagtacctactttagcaggtaccagaatgcatgcgtcgtggaaactgatgtagataccaaagaagcatgcgatcgctaggtaaagtaccttttcacgatgaaaggtaatgtacctgagcagcattctaccacaggtgatttccacatgttctcaggttccgtagggactgtccctatattcaaacagtgggtttgaaaccggagatatccgtccgctcacgataagtagtccgtagtgggcaggccgtcggttcctttgtaaaggtatcctctggtgtcccatttctctctgagtctttgaggaatcttgaagaaaaataaaatgacgactatgataatgatgatgacaatgaggatccatgcgctgtgtgcggcatctttggctctatgtgcctctacgttaccggtaaacgagtccgcaaagcctttcggcagacccgttacattgtaatctctaggtgacgttcttcgcgtggatcttttgtgctgcgtatgtttatttggcgtggtttttaatcgcgacaacgtagttttttgtccgggttttctggtggttgtcgttctggaaatcagtgataacgtaaaacatgtgggaaattcacagttaccgtttggtggacattttcgcctgcaatagtttttgggatctgagacgtttacatgaagaatgcttaatgtggaattgtgacactcgtacaacagtggtgatggtaacggagtggttttcattgtctttcgtctaccaggtttaggagggtcgtaggtgcagataggatgcgtattttcgccgttgctaatgccgacgcatgactggttataccagtgtactttttgtcctggatgataaccatgtccactaccgagggtaactggatcacctactctgacagtgacctccatacaggtttcggaatacctgtaaaatatcattgcggtcatgacggaccatcggaaaagatcatggttcacgatatggttaatcagtcgccgcataacacaaacacctgttgtataatcacgtatatgtacgtcattatgtttacggtattcaaacagtgagctgaaaaataaacgtacatggccattctttttacgttttagttttctcgacggtgattctttaagcggcggtgagcatactgttgtatcggtattgtgtgaatttattccaagctttctggggaaatttgaaacaaattaaaacgataattgttgtaacgataactaagggtatgatccacattgtatgtggggtggcagtatcgtgttgtgcttcaacgttaccggcggcatagtggaccgcggtatgtgttaagttggttgaggtaaatgatgatatagttaatgaattatatgtggacgtaggcggatagagcaatatagttgtgtggatgtgtgtttgatatatggaatatacagtgacattgtaacatagaggtgtccgtaatacccaaccatatgtgtatagagaatcgaagtagtaaatcccgctatagtgacttgttaaattaataagaaacaatgtatgattcaaaaaacatcgtcgtatagtatctggcttgctatctatttcttcaagtttttcagtataataacataacatgttaagggctttaagtgaatctttataccatgaaaaagtatagtctttagatgataatgcattactaggaggcagactgaggttttgaccttcatatcccgttttctgaatgcatgacgttgtatctggtttccaccattgatagaactgttgtatacgaagcaatattgttatccaccaaagcagccacgtgtatctatacattgtagttcatcacagctccgtgtccgtcataaatacttgtccgtactgtttattgtctttccagcgatcgtagactttttgaggtgctcgcagacagatgataataaaaatgatgagaattatggcaataattagcatccaagaataatgtgttttcgttctttgatattgtacttccccagctgggtattccacaggttgtggagtaaccgtagtcgcgttgctagggttaaccgcagtctccgtgcttctcaacagcgacgcactggttcctaacgttacccagtcactgctatttgtacgtgctgtattggcggcttccgtaagttcataatttccgttataattttccgatgcatatagcccagggttagtcattgttggcacaaaaccttctccctgataaaaagcacatcactataactttggtttactacataacaacttccaccatcccataatacaaacaactattagagctataaatacgataacacctaccaaggccaggtgcgtgttgttttcccgaggcgtctgatttaagaatccagcgacggcacgtagttgtggtgctaaactggcgttccccgtaacgttacttttcgtgccgatcaccgttggtgtcgtcgtgacgatggttgttacgttactagctgtagtagtttccaaaggtttcggtttcacggtcaaattataccacaggaacgtttcattttcgccgcttctcgtaaaaccttctgctccgtaacgaccggagtcgtttaacgtgaggttgaagatagtgatctggttagccgcacaacttaggcttaaacccacatagggcgtagaaagaccctctccacgtttgtaaaagcaaatgagatgactatcgttgccgtcccagcgaaaccaccgtgcgctgatgtttgaagtgaagttggataccagggtaacgttccctccctgtggcccagacacgtagatgatggattccagaatcacgggggtaaacaacgccaaaatcaacagtttattgtacatatgatgtattgtccaacgggattgtgtaaccgttagaagatgggagctcacgtcggaagccatgatttatttaccacgttacggtttggaaacagtcatgctcaaacagtgccttttatttcctacattaacaaaccacgttcttcatcgtccacgtggcttcgccagcgtcgccaagccgattgaggcaaacccaaatcaacgagcaccatcacggcggcgaacagcagcatcgcgacgccccagctgccgtaggtgaatgccaagttagttatgttcttggataacgtcccgtttccgacacgctgttgccgttgataactagcgtgtctaaacgcgctggaatttgtcgtcagtctcgacgcaacaagtgacacactgaatgtggagtttgtaaccaccgtgggtgtcattacggtggttgtgctttgaaccgctcgaggaaccaccgttaggttgaaacaagatagtgttatatgtttgtcggtgcagttgtaacctttttgataataagtgccaccactactttcagaaacgttataaataaaaaatgttttccaagaacagccaaacgctacacggtgtcctaatgagactcgcgtgcgtgatccccataaagtgcaccataatacgggtgtgcttccattctcgtaacgtccccactgggtcacattacagcttaacggtgccggaccgtgcaattcagcgtcttgacccgctgttgtagttatcgtgctacagttaggcagtcgattggatgtcacggcccagctcgtagagctttcagaggcacaaaccatcaaaatcagaaccagcgcgtatctggaaacccagactttattaaaaaggcagctcggcacgccccggggcgtgcgggcaaaagctaacatgttgagtgctacatatgtgcgtgagcgcgtattcaaacagtgagttaccaagcgcaccccagcccacccgttcatcttagcatgcattacccgtaaaagtccctcccaccccgtttcagactctctgactgaaaacaaatatgcaaaagcaaaacacaacaaactatacacagctggctaactagctacacggtagcgacgagacgttgatagcggtatttcagaggacgggcgatgtcccggagacggtctatgcagaaacgacagatggattgcggtacgcgaaacaggctggcgaaaagcgtcaaaagtcctagtaagacgaagccggtgacccaggtggtgtggaaaatcaggcctccgtagaactgcttagtgatgatgagacgactccacggaacgagttcttcctcccgcgacaacagcatcgatcgatcaggaggaggcgcgatcgccagggacggtgtacgggtgctcacgctggaggtgaatgctgctttgtcccttgatatagccttgttactctccgcctcggtgatgtcgtaacagcaggactcgaacgcggcacaatcatggagacgcaaaccgaccaaccacacaaaagacaacacgagctttaagcgtgatctagatacacgatacacagcaaggccgggatctacacagtcagagtagcctagaaacatgttagcgccgtagggacgcttaacatttcaaaagcaacgtaaacacaatagctacagccacgcggctctgtggaacttcacgtgcgttctttaggacacggtcaggttgtaacaagagtaataaaaggtgaaattcgcatcttcccttttaaaatagtactttccgctgttttccgtcgtcagatttagcaacgtcaagcggttataggtgcagttatacgtcaggttcgctacttcatatctgtaatgttgttcgttatagttgccctggagtttcgggaagaacgaacagatggacttatgaccccaccctaacaaccagtgcaaaaagtcttccgttttgttctgaagacctcgaaatgtaacgttgccgttgatggtccctgagtagttagcgcaagtaatattcttaggaatctgacggtcgggagacttccattccacgggagcagtcgtcgtgccgattgaacaagtcccaaaaacacaataacagtacgcggcaagtagtaccattggtaataatctccacgttctaagcatcataaccatactcagcctcacgatcaaaatattgcactgtcagtggcgataagcgatacaaaaacaaaaaaaagggacgtgctacaatccgagtcactttcaccgtacccggacaacggtgctttatggactcatcgcttaaggtgggatgtatttgcaagccaacagagacgacaatttcttcgccgagagaaccagcggctgcatcacgaggctggcatctgattccctgtgcctatttcactcttcatttatacatatccagacctcatgtgatacgaggatcatcttacggggaaaaacccttctcttatccagtcattgggtcccgtatcccttgagaattcctcactatcccccgagctggagcagaacaattccaaaccggatacgctacataccagccacacagggtgacgtttaccatggccgaagactcggtcgcgatccttatagtcgaagatgacaacgacgcatatccgtcgttcggcaccctacccgcctcgcacgctcagtacggctttcgactactgcgcggcatatttttgattacgctcgtcatctggaccgtagtgtggctcaagctgcttcgagacgctcttttataaaacacgcagaaaatctgtgtgttctgtgataacacgtcgatagtaatgtatacttcccctgaatgacgttatcataaactgtaccgtccaggggtacgctatgtgtcacgcgtgttctcatgcagcacattgtatgccgatacacgggggtaacgagggaaattccactcgcagatccgctttgtctggagacggagtaagaacacaacgacgtttaaagtaaatacaaatgaggcacatgatgcaaataaagatgatacatagcagtattctattgcgatccttcatgatggagtagaaaagcgggaccttacagtttttgagaaccgcacggagtaatcaaattttatcttggataaattagtgtcgatactttgtaatcacgctatgcgatttacgttgtttctagttcgtagtttgtgtctcagagttgccggaacgttaaagtggatcaaaacgtagatcataattaccgtcaccacggcggctgcccaaccagcgtgagtggatacgtgggaatttgtttgtttagaatgacgtgaagacaccacggtgataatatgcttggtgctatttatggtgtagttacagttatcgaagtaattgagtatttcatattcgttataagtagtaatgttacatgaaagatcacattcgtaaacgtgttcagtataagcacctgaatcgtttaatgttacattatataactgcagacctttagtttcgtttatgcacatgaattgcggggaacacgatgtgtttgtgtagtaatgtgtaacattgcgtagatatccgttccatccacaaagttcgcaattaccgtggtaccaaaagctggaataattacagggattattgctagcatctaggtagactgtgtctccctgcgttactgtaatgggtgcttctacatgttgactttgcagaaaaagtcgccagtaaaacgcctttttttgttcatgtaaaagtatgggcactagagtaccaattaggatgattacaaccggtattagtgcgactggcaataacaatttagtgttgcattgcatgcccatgtttttttgtttagtaatgattgaatataccgctttatatcataggttgttaacaaaaaaaaacagagacatgttattggttaaaaaaagtttattgatgtgcatgttaagccttagtccaaaattcatctggatcatatttgggaagtttggtgtaatgcggttttttgggaatgcgatggctacccatgtacaacgctataagcgccactgataccactacgcctgcccatacagcatgaattcccaggggaatgttagctttctcaatggtttttatgatgttacttccaatggtgttttcagtgttcctagattctttatatcttacagggcatgtgccaagagtggataacgttgtgtctccaattaacaccgttacgtagtaattttcttcttgaccgttatcacggtgatgcctggtatattttccagcgtttcttgtggttaagttgtagatagttagggaggtgtcgttgcagtcaaaacatatgtcgtgccgtggtgttgtttggtgatagttgcctaattcgcacattttatgcgtggggtactcataatgaatccagtctacattgtgccatttctcagtctgattgcattttttagagttatgttgccaccaacgtatcctgttacgttgattacctcgtaactgcggtcgcatcttttatggactgtataattgaaaccatcacaagtaacggtcgtggtggtgttggtacatgtggtagtctcaacgtttgtatttgtcgttgtggatatctgtgtggttgttttcgacggttttgtagaaacggtggttgctggtgcagttgcagtagagcaatttatagattctgaagtgcttttattgctgataactgttgtactgtatgttgatgtggctgtctcagtactagtggaatagttaacggtagtactacagggacattgacaggaacaggtttgattgcagctttctgataacgcggatattagtatcgtccacataaccgtaaatcgccagtccattgcaatattagttctcgctcaatgggcattaatattcctttgaacgctgagccttacagaatgttttagtttattgttcagcttcataagatgtctgcccggaaacgtagctcaatcttcatgttctgtgtgatatcgaacaatgaattctgattcactgacggtgtcttgcaacatatggtactttttgttaaaggctcgtcgtgcaaaaaacagaactatgcaggccatacaaaccaacacgatggtccatacggtgcggcttctttgcgagctatgatagagattacgtttgtggtgatgtgtattgttagtatgttgacttcctttctctctatcttcattttcgatatcggtgttgtatctagggcaaacgaaagtagcattaatagcttcagtatgattttttggtgttactaataggtagaaattttcatcttcgtgatgtcctgtgaagtaattttctttaaaacaacgtctgctgtacctgccggaattggtgatatttagatcgtacagatgtagttctgtgttgttgcacgaacgacataagtcatggtacagtgaaggtctttcatgttgagaatgacatacagtatgagaggtaaggatgcgtaaccaataccaagattgggtatgtgcgttcttacgatgacctagatgatgtccgtgtgtggatcgattgtaatgtcgtatccaggcgactgaaagacaatcccacgtagaattaccttttatggtgacattactcccttctattcctgttgtattagtttctttgaaacgtatgattgttgtctctgtgtgacaagcgttggaagagttagtacggttgtacgtggtgtacgttgtggcgctgcaatttgtaagccatggcgtgcttataagtgcagtattagtggatacgttgtgcgaagtttcatctgacgtgatagttacggtgattgttgtgttataagatgatgtagcgtttgctgttacgttggtaaaagataatatagtgttggtatttgttgaaatcaattctgtagtggcagccgtattggatatattagcatatgatgtattgaatgtagaatatacggttgtgaaagtactcaagtcggaggtaacgttggtgatgttgccaatggttgacgcttgtgaggtgacagatgtgtgtggcgtcgttgatgtgttgttattcggagtagaaaatacgctggtcacaaaggtggtagaagcagtgttgggtgatgtgatggatgcagtattggtagtagtactgttgcatgtaactctatgcagaatatagaatattatgattgtatacgccgtatgcctgtacgtgagatggtgaggtcttcggcaggcgacacgcatcttttactgtaaatccccgtccaccgtcaacaacaaaggttccgtatctaggtccgtccgcagatgttcagcgtcctgttccccgattcgttgcgatcgcaggaagcagatgaccagcgcgccaacaaagatcatcattcccgaaacccaggcgcaatggagtgagaggccggaccactggcgttttaaatccgagataattgcccggtctgcctcttgggaatccgtaaccacaactctccctggtcccggataaaagcatcgacgcgtttccaaggctcggcagaagctacgtgggtggatgatgaggtagaaagcctcgacatcgccggtatactgatcctgcaggaggtagactcccgtatctttaaccgtgagattgtacagcgtcagattttggcgcgtgcacgcgaacgccgcaccgccctgacgcgtggtttctttataggcgtctgtaatgatacaaagtggcggcatacgacgcatgtatctgctgtagatatcataacgctgccagactacgctgtgatggctagtgttaagcctggtaaccagcgtgcgtgtacggtcctcgcaggtggcacggtagttggcgagctttaggggttttttggttggttcgacggcgttcgatgaacttccctgagttgtgaacaaaaacagcgacgtgactatgacaagcgtgaggggggtgctgtaggtctgcatggtgcaaaacacgttctcgccttccttatcagacgttgtcgtcctcgtcctcttcgtcgtctgtgcccgtcggttcgatcaacggggagttatctttctgtctggagggtcggtatggaatccgttcgtagatgttctgctttttagccgcgtgttgttccagctttttgcgtgtcaggctccgataggccagacattgatctacctcggtgcccgtgttgtttttctcctcctcgcgcgcgtaaattacaaagaagaccaccagcaggactatcagcgtagccacgaacgagcccgcgccccaggccgagtatgcgcctagcatggtaatgggttctgtgatccggcatttgcacatcgcgtggcacttgctgccattgccggtattagatgatgtgttattcggactgcacttgcacgtcaaatgggtatcttctgatttcacgagacagttggtggcgactttggtttcggcgcagacggccacatagcttaccaagctgagtgccagaaagcacaccgcgtgcattacacgcggatacatattaaaacaccgtgttccacaagcaccgcacacgtcaatcctccccgcacggtcttcagcccgcccatgacatgatctccctcacgttacccttcaacaccctgtagtactctgtctcggcttccggtccccatgtcctaattataacaaaacaccgtgacactgtccatctccctgtctttttgcgccgccggtcccccccaaatcatgtctctagatgccgccggccaccaaccggaggcacggcggctattggattcggcattggtgcgccgcgtcttggcctgcatgatcatcgtcatcatgattgccattagcatctggatcctgacctacgtgctgtttctctaataagaaccccggcccctgacggtaattttcctttcttctccgtttctcctcagctgccgtacgtgatgcctcacggccatctccgacaggccctctccccgacctcctggacatgtgagggcttgttgctcctcctgggattgctggtgctcttctttcaccaccacaaccagtcggccgtggagaggcgtcgccgcgtctcgttcgtcgaggccgatcgactgccgcatgagagcgggtggtattcttccgatgacgacggagaccgggacggtgatgaggaaactggagagagccacaacagaaacagcgtgggactgtccgctgtttttagctgactggcgtgcgacctgtaaaccgttactcgggtctcaagatggtttggaagttgtgactcatcttcctgtgggtgatacccaaccggacgcgagtgttccataaaagccgggcgctccggcgagaccatgccatcctcgccttcggacgccccgctcctcttctctctcctctcctccccgctgccgcggccattgccgccgccgcccataccatcggcatgtcggccgacaaatcgcagctgtcttcgccgccgcagctgtagcagttaacgtcgccggcctccaggaggagatggcgctgtgcgtcgtctcttcgtcccgtctccctctgtggtcgtgggtggtgcgagagtacacgatgggtggctctcgtctcgggggaccacagggggaggggggtaatttattattcgtattactgtaattttgtatcgcttaatttgtttagagccgcacgcttgacaacgccttgtatagccttatttatcccgatgacttttttctccgtacaagaaatggacgtcacttgagcagacacagtttcatcgaccacgacagtctcatgatctgactacctctgacccgccaacgagaaaaccgaaaagtaaaagatgaccgcgccctcggagtccttttttccttttcaatcatgaaagcaagaggcagccgagagaatgccagtaagagacgaccatcgcagacacagtacgatactcatcttagaacgaaccagcgaataaccatcacacgtacagcagaatctcatgaactagtcaaccaacgtcataaaatcttcacacaatcgtttttgcgaacttttaggaaccagcaagtcaacaaaagactaacaaagaaaaaccatcttggaattaaaaaaagtagcatcgttaccttatgaaccagcagcattcagtatatacaccagatataatatatttattaatgtatcctctctttctcctgatgtaattttgtttttgtaaattcaattgttgaaagtctctccctgggggaattgcatatcttattgatgaagaagaaatccctgccatatgtgttgtcaaactatcattatttctctatatgggtattttttttctaagaagcaaaagactagcagcagccaaaataaacctgatgaaatctttaactgaactcccagtggtctgtgtgtatatttctgttggtggtcggttgtctgaacccgggtgggttgttcggaaacggcgggacggggaaacggatggaaacagcgtcgctatatacgtgacttttgatctaaacggacgtcgctaggctgacagtttacgaattgctaaacaagataggaacaaaacaagcggggctttgcctggtaggatttcctgtggaaacaataaccggatgtgattgtggctggtacataagctggttctggctgcaagcgcttttcactgcattaggtttggcgtttgcttttgcctgggaacgctatggctataacgggaaagaaccggtttggcaacattccattgtggggggggggtacttatagcgtgcctagctatgacgttgatatatgtggatgcggataatactcgtaatgagctaaaagcgacgactggtagtaattttaccattacgcataggaaagatccgttgacaactaagtggaaaaccgtttttggtaacaatggtgatcagtggttgtgcaacgttacgggtataggtaatgctactgtgaatagtaacgcaactatttgtgtgtcgagctgtggtcataatacgttggatttatgtaatttaaagtcgggagattctggcttcttcgatctgtctcgttggttcggtgaaaacatggatgaatacagtggtgatgtgtggcacttggaagtcagctaaatgttgtatcgcttagtgaattggtgttcttacagttttcatgtaataaactacgtgtaattcgttaaatttgtgtgtttttttgttagtattctgcgtaacggtggaataaaattgcgttgacctagttagatttcctgtgtagaacaatgaccggacgtgcttggactggtacatacgcaggggctggacgtggttaccggtcactggactcggtttcgctgtagctgtggttcaacctgaacatggctcccagagctgctaggaaccggtccagtcacattttttggtgggtggggggtactaaaaaagtgtttaatattggggtttaatgataaaatccaggttatggatatgaggaaactgaatacctcgcagggtcgaaatcttaccacagttgatgatagaagacggttttccatcgggtgggaaacatgggataacggtggtgactaataatggtacaacggtcgtcaatacaacagcctgtgtttcaagttgttcgcatacgtcgcttgtgctttgcaatatgacgcagcagactgattcgttgtacggagtgggtcatcggttgaatgacgaagaagatggtgaactgtggagagtttcggtttcttaataatcccatacgacatgtgttcatttatatctgaattttaggatgatgactatagtataactctggggaacaaatatcatacgttaatcactttaagttacgccgttaggaaaagaaaatcagtccgaatgaagcatagtcagccgaatgatacagcaatagcttgtttacaacgtgttcttttttacattatgaacgtgccttgctttttatacacacatggagacagaggtccctcagcccttgtcacgacaactccctttttctaaaccgtatgtgctccaaaccgtatctcctcatcgtcacgtgaaataccatgggaccccttttcgtcacacacgtctttccgcttacccaacgcgtcagcccgcgctcggcagagctaccatataaaaacgcaggggtttagcagcttccccagatcgctgctgccccggcgttctccagaagccccggcgggcgaatcggccggctggtcggtcggcgctcggacggatggggagaacggcggtgacttagccgcccgtggccgggagaagacggaggagccgagatgacaacagcagtcgtggaagggtcgccaagccccggtccttctcttctgtctggtcgaatcttgttttcttttttcaaccgctctttttgtcacctttttatgtgagtttctcttccgcgtctcccggccgtaccatccacccatgcagcatgcacgcgtgtatgtatgcatcgcctctcctccgtcccgactaccatcagcagtaccactgccgccacccccagcgccaccaccgctgccgtcgccaccgcgttatccgttcctcgtaggctggtcctggggaacgggtcggcggccggtcggcttctgttttattatttttttttattttttatcttctcctttccttaatctcggattatcatttccctctcctacctaccacgaatcgcagatgataaacaagagggtaaaaagaaaaaagctacagacatttgggtacctcagctttccgataactcgaagaattcaaagtcgacgattcccaacaagagaaaacagaacaaaaacaaggtcatttttatttatcctcatcgtcaacaacaactaccgacaacaacgaaacaccaccaagaatgtcaatccgcaagggtgttcctgccccctcgacgcgcctgtcgcgatcctcatggcgaggaccgcgatctccgtataggtagatgaaattatcccgtgtccggtcctgattccccgcatgccctgcacatcctgacgcgtcggtcagcagccaaacaatcataggaaatgaaccagaagaacaaaaagatcatctctctcggtgtatagcaacaccaacaacaaccgcatcgcaacatcttcatccgcaagacggaaagaaaacaacaataatgagaatgaaatcaccacaaccaagccagatttcacgtccatgagtttttattatattattatcaaaacgaaaaacagaaaaactgtcatagataaatataaaaaaaaatagaaaccacaaacgactactagtactccaatcttagatgtatatgctcctagataagatttagtattaccataatcatcgaagaatgaaagacgacgatgattccttaccgctcctgccacccggtctgtatgtagagagagaagagagaaaacggtgaatccaacatccccgggtcggcgtcggcatgccgctgatcgcagtggccccacctcggcatgccggcgccgggcgaggaattgctcatgaaaaaaagtatctttctgtaaaaaaagaaaacaatacatgattaaccgaaaagaaaccaacaaaaagaacccgagatcagtcgatttcgatcactacgataaacacatggaagatttcttgaaaaaagaaaagagaaagagaccaccttcccggcggcggacacgctcctctccgtcgccgttctgcaccatgattcgatcaataacaacatcatcatcggagaccatcttttaatcaatcagcgttgcagtagtcgactccctggacacgaaggagtcatccatttttatcctcgcacttcttcgctctcaaagccgcctttaaagttgaaatgaaaggatggaaacatggaatacggttttaattgcacgtatcaccattttactacaaaaagaaaaaaaaacaacttacacatagtattaccttaggtttacggataagtagagtgtaggcgtttttgaaacagttcagccgatgcaatcttgtctcggcataatcactctttctgcatataatagtagtagtagatttattcacatcaacacagcgaaaaactccagcatcaaagtacacctagagacagcccttaaaatatagtttgcagcttttagatgtacttacaccaaagaagattaccgtccttacgagaaaacagatactcggatataggaatcaagacagctctgcactgaaaacacactctcctgtcacgacaccgcgccacaccagaggcgtacgcgtgacttcatcgcaacgatccatcgtgatgtccctcgcagaacctaaaaagaccaaaaaaaaatcttggaccacagttgtcgatacttgaagacaatattctcgtgagaactttgagattcgcacttgaaacctcttaggatccacaaaaacaacaacctctgtatggaaaatgcgctgttttatctcagcttttctcccaaacctcggtttcttcctattcttatgttttccctagtatatttgcctccttataagaaaagaagcacaagctcggtcgcacggattattccttctgctaatctattattttgttccttttttttttctttgccttcaccctcttcactccctgtagcaacacagagtagtagacacaataaatgagaagtttgcatgcatttgtcgtgtccgtggtttgttatggcgtgtggagtgctcgggatgggtggacgtggggacggattcttgaggctacaaagatacgcggagacgtcgtggcgaggggatgggtttattggatatcggtgaagcagcgtggcggcgaaagacgcgatccctgggctggtagatccccctaccccgtctaccggggacgtttatcctttggacacgtaaatgtctcggccggcatccacgcgccacgttcaccgcgttgtgcccagcgccatgtgcgggtcgtttcggcgtgaagttggacggcgtagtttcggggattgtgaaccgtggctgagggtgtagatgggacaggaaaaagcgtgtgatctcaccgaggcgaagcatgtgggtggtgcgatgcggtggatgtggcggggtgcggcggtttccgacgtggagatgtggacatgggggtgatccggatgcgtggcaagaggcctcgagcttgggcttctcccgcggatggacgttctaactgtacacggcggccgtggcctccgagtaaaaaaaccaggtgctgacgccagacagagacgccgtcctcggaatcgtgtgcgcgaaagcctgtgccgcggcagcgtacgacgttccagtcagcgaggccgtcgcgttggcgcgccaacagtaaggtgacgacaggttggcggcccatggttccgaagcgtccccacatgcgccagcagtcggcgtcaaagtcgcttgcgctgtcggcccagtcgccaccgccgcggcggatttccgcgcgggggacggggtagccgagtgctgcgccctcgccaatgttgtgaagtggatgcgtgagttgatgttgattctctgtgggaaaatgagcgctgtcctgtgggttggtgttggggtatgcgagtagtaggggttgtgtttgatcgtagaggtgttggcgggcctgtgcgcgagcagcgtagtctgcggcgtcgagctccatctgtgtgcggtgttcttcgtcggcgtgtttgtccgaggttcggacatgcggttgtctgttgctgtggtgtaagggtgacgtgtgttgggcgtctgggtgaagcggcgtggtgtgggtgctgtttgtgtctgtggctggcatgattgtgcggcatgtgtgtgttgtagtgggtggaggttaaataggtgaggtgggttccctggtccgcgccgcaaactgtccccgtacccaacgtaacctcccctacgcggcgcgaacagccccggacccagcgcaacccccgtccccggccccgacaccgtcccgcacaccccccgtctccgcaacaccccggcatcgccggcggccagaacgctcgaaaacccccgacaagcgcagcgccgaaacgacacaggcaaggaccgtggaacgcaccggcagcgcgccgaaacaccgtcccgaagcccggtgccgacaacaaataccgtgggacgacacgcaccggcagtgcgcaggcagcgtcggacacaacacgcttacggccctcaacactccctcgaggacccaccacgcggccccgcacgtcggtgttttgggtgtgtcggggcgcggccggaaacgacacaggcaaggaccgtggaacgcaccggcagcgcgccgaaacaccgtcccgaagcccggtgccgacaacaaataccgtgggacgacacgcaccggcagtgcgcaggcagcgtcggacacagcacgcttacggccctcaacactccctcgaggacccaccacgcggccccgcacgtcggtgttttgggtgtgtcggggcgcggccggaaacgacacaggcaaggaccgtggaacgcaccggcagcgcgccgaaacaccgtcccgaagcccggtgccgacaacaaataccgtgggacgacacgcaccggcagtgcgcaggcagcgtcggacacaacacgcttacggccctcaacactccctcgaggacccaccacgcggcccggaatggacccaccacgcggcccggaatggacccaccacgcggcccggaatggacccaccacgcggcccggaatgggcggcccggaatggaccggcggtgttttgggtgtgtcggggcgcggccgggtgggtgtgtgccgggtgtgtcgcgggcgtgtgttgggtgtgtcgggggtgtgttggcagggtgtgtcagggtgtgtcgcgggcgtgtgccgggtgtgtcgtgccgggtgtgtcgcgggcgtgtggcgggtgtgccggcggggtgtggtggcggggtgtgtcggcggtgtgcgcggcctcggggtgtgcggcttcgcgggaacgagtgtgtggcctcgcggccgttatttcccccgcggtccccggggccgtcgtccctcgcccccgggcgttgcttttcgtgtgtccccagggacccatgctgccgtcccccgggaacttcctcttttccccggggaatcacacagacacacacacgcgtcttcttttcgccgtgcgcgccgcacgtcgcttttattcgccgtcgccgtcctccgcaccacacgcaactagtcgccgtccacacacgcaactccaagtttcacccccccgctaaaaacacccccccgcccctcgaggacccaccacgcggcccggaatggatgtcgggcgtccacctagatgggtgcgcgcccgggaggcggctgtgcgctccagtggtacgcgcctgccgcgcgtcttccttcgggtagctgcctttcccagtccacggccttccagactgcgtggcgccaaggcggcgccagcacgcgccgtgcacgtcgctgcctataaaagccagctgcgtgtcgcccgcggcacacgggcgacgaaggcgtccgcgtgtctaaaccgcgtgctcgctgacgcgggtctgcttcctatatagtggacgtcggaggtgtccggcgcccatggcccagcgcaacggcatgtcgccgcgccccccgcccctcggtcgcggccgcggggccggagggccttcgggggttggttcctctcctccttcttcttgtgtgccgatgggagcgccgtccacagcgggcactggtgcgagtgctgcggctacgacgacgccgggccacggcgtccaccgggtagaaccccgcgggccgccgggcgcccctccgagtagcggcaacaatggcaacttttggcacggcccggagcgcctgttgctgtctcagattccggtggagcgccaggcgctgacggagctggaataccaggccatgggcgccgtgtggcgcgcggcgtttttggccaacagcacgggccgcgccatgcgcaagtggtcgcagcgcgacgcgggcacgctgctgccgctcggacggccgtacggattctacgcgcgggtgacgccgcgcagccagatgaacggcgtgggcgcgacggacctgcgtcaactgtcgccgcgggacgcgtggatcgtaccggtggctaccgtggtgcacgaggtggaccccgcagccgacccgacggtgggcgacaaggccggccatcccgagggtctgtgcgcgcaggacggactgtacctggcgctgggcgccgggttccgcgtgttcgtgtacgacctggcaaacaacacgctgatcctagcggcgcgcgacgcggacgagtggtttcggcacggcgcgggcgaggtggtgcggctgtaccgctgcaaccggctgggcgtgggcaccccgcgcgcgacgctgctgcctcagccggcgctccgacagacgttgctgcgcgccgaggaggcgacggcgctcggacgggagctgcgccggcggtgggccggcacgacggtggcgctgcagacgccgggcaggcgactgcagccgatggtactgctgggcgcgtggcaggagctggcgcagtacgagccgttcgcgtcggcgccgcaccccgcgtcgctgctgacggccgtgcgtcggcacctgaaccagcgtctgtgctgcggctggctggcgctgggcgcggtgctgcccgcgcggtggctgggctgcgcggcggggccggcgacggggacggcggcggggacgacgtcgccgccagcggcgagcggcacggagacggaggccgccggcggggacgcgccgtgcgcgatagcgggagccgtggggtccgctgtacctgtgcctccgcagccgtacggcgccgccggcgggggcgcgatttgcgtgcctaacgcggacgcgcacgcggtggtcggggcggacgcggcagcagcagcggcgccgacggtgatggtgggttcgacagcgatggcgggtccggcggcgtcggggaccgtgccgcgcgccatgctggtggtgctgctggacgagctgggcgccgtgttcgggtactgcccgctggacgggcacgtgtacccgctggcggcggagctgtcgcactttctgcgcgcgggcgtgctgggcgcgctggcgctgggacgcgagtcggcgcccgccgccgaggccgcgcggcggctgctgcccgagctggaccgcgagcagtgggagcggccgcgctgggacgcgctgcacctgcacccgcgcgccgcgctgtgggcgcgcgagccgcacgggcagttggcttttttgctacgtccgggtcgcggcgaggctgaggtcctcaccctagccaccaaacacccggccatctgtgcaaatgtggaagactacctgcaagacgcccgacgccgcgccgacgctcaagctctgggactggacttggccacggtggttatggaggccggcggccagatgatacacaaaaagaccaaaaagcctaaaggcaaggaggatgaatcgctcatgaagggaaaacactcgcgctacacccgacccacagaaccaccgttgactcctcaagccagtttgggacgtgctttgagacgagacgacgaggattggaaaccgtcgcgtctccccggagaagattcctggtacgacttggacgagactttctgggttcttgggagtaaccgtaaaaacgacgtctatcaacgacgttggaagaaaacggtgttacgctgtggtttggagattgatcgtcccatgccaacggtccccaagggctgtcgcccgcagacttttactcatgagggcattcagttgatgggtggtgctactcaggaaccgctggatactggactgtatgctccttctcacgttacttctgcttttgttccatctgtgtacatgcctcccaccgtaccctaccccgaccccgctgccagattgtgccgcgacatgcgacgcgtcacgttttctaatatagccacacactaccattacaatgctcaataaactggttttcttttgcagctgtcgttatgtttcgaaaacttgttttacaatgttataacgacgccagtgataagtaccagacatccaattacaccgatgtggaactgttgcgacaatacgcgtaagatacagcggctatctgtactgcaagacgcatgattagcaatattattccccccccccccccccatacacgttgctttcgcgtcttttttctcgttgtacgcattacacaggtgttgttagactagcacagagacaccaattgctttaatactcgcgacgcttcatattagtatactaaactctgtgatgaacgacacatgcacaatacgataattgctacgtcacaataacacgcaccacggcttgcaaaactactaatacagatacgcaatgcatctaacaaccgtcgacaacatcccccccccccccatacttttacgaataaccactgttttattcttggcgccgattcagcgtgtgaaactcgtacagcgctcaacctgtttctatcaatgtccctctgcgtcccaccgtactttatacaccctacagtcacacccttcccaataggaacatcgacacatgaccgcacatattatagccagaaatacaaacgtagcgtacgcccaacggcaaacgcaactatttgcccccccccccccacacacgggactttcatactgaagtaccgttgtacgcattacacgggtttcgttcggataacaacactgcgtatctgcatatgtttcatcctcacacctcgccaccctttatgcgatacatacatccaaaaatgaaaaaccaggacacgcataatatgatactacatattttttttattgaaacatatcgctctggggctgggacgtttttagtcacacatcggcatcttcgtcaataaaacacacgccgccgtgacccataccgcagctcggacccatcgccccaagtcacggaaaagactgccgacgccgtgcgcggtttttccgtaatcgttcttcataccgccgaaggtgcgcatcacgctcttgtttcacgcgttgcacagcgacggtgaacaaaacgacgtagacgatgaaccgtacgaatcgcggcacaacgactggacgacgtcgtttacgaaattttaagaggaatttcagcataccccgggctctccatcgggagcggtaccgttttcccatgacgctccgtgaaaatcaccgacattgaagcgagacaaaaaagtggcattagcgacaccaacctcagccagacaagcatttttcggcgttgacagtggcccatggcagcgattcaagaggaggaacacctcttcttcgggacgatacaggccggcgggtaaggcgtcggagccccgatacatgctgccgacaggtaagatgcggctagtattaaggcctgaacgccaagcgaaggtccctctggctcggtccgcctgctctctccaggtccggactgagcgattccccgccaccactggtcccagaaggtccagctgcagatacccgtagaaatcatgaagctcacgataaacgagtccggagccatgcggaccaacgcggctgacagcacgagcggcaatccagacgagcagaccaaggacgttgatgagttgctctaagttcatcgccgtcgcatcgccccgaggcgctgctctgaagccaagtgccgacggcgctttggctttatgtttcaacgttcagccaagtcacggtggtttgacgtggtattgacgttcgtcccaagcgggttcgtcatgggccatgttgcaattatcagcgtcaccactgacgtgctaggaccgcggcacgtaaaacggaaaagtgaacggcaacaccagcgggtacatcatgagttgcctcatgataaaccgcgtcaatcccaacgagtcatgcacccgcacgcgtttggcatgcgggcggtatcccagtttctcgtaacccaccctctcggggaacctgaggctcatggtgcttttgcgccagagactcctgtgggaacccgctcaccactccgttcttatgcgattctctgactcgcgtaacatcctgcacgtcagtgaccaacccacgtcaattgtgacgctgatgatggggacatgtttcccgaacgtcaatcacacacatcacacggggatttacgctatgttgtttattgtcacgccgtgttcttacacgtaagtttcccggtgacggcgagggggtactccccctaactggaacaccacgcggtccggctcagcccgcgtgcgaagatcgtcctctcgccgttcccgtcgactgcaaaaccgccagccctcggaggcgtgctcgtatcccggcaagttgcgcggtgggggcgtgccccgcagaccccggttaatgcggtggtggtaggcccgcgagaaggcccgcacggtcttccaagcggggacctgttgctctggcgcttcgcccgaggaagacgccgacgactcgtcgtcggattctttgccgtcccactcggcgtataacgcgtgacacttccagtcctgacaaaaacaccacaaacggtgtaaccgccgcatctgtcgccgccaattggcggccctccgttcggctcgggtcgtgggtcgtcgctgaaaatggctgtcgtacacacaatagaggtgctctcgccagtcgccgcagtcgcaccacaggccgtgcgagtcgtggattacacgacgccagtcgcgttcggattcggatgtgtacatagccatggcgacggaagatgataaaaggacggtttggtctaagccggatgacaacgggtcgtctttttaaatccccgcagatatccggttgatgtagccagtcgcctacacgcgacttatcgattagtgttgttcaccccgtgtgtacacgccgtgggtgcgtagactgcagttactctcgtcaccgctactctggccgctgctagtgctactttccccacagttagacggagtgtatcgagctcgccggcggcgaaacaaccagcgccgggtactgtggcgcagtcgtttccaccaggtgaacttgctctccgcgacgaaaccggaggaagaggccgaggaacccgaggaatacgccgtaccccaacggccgcgcaaggcgtgatcacgccaggcgttgcagagacaccagcgatcgtgagaatcgcgaacccgggcctgccactggaccgccacgtattccagccagtgtgcgggctccggctgctcgcagtttggctcctcgtcctgaatctcaacgtggctctgccagttaccgcacgtacaccacaggttgtgcgagtagtcgactacgcgacgccaactctcttcgcgctccaagagcgacatgagatcgaacttgtcgggcggcggcctcgtctcaccgacgagacaccgaccgcactcgagagtaaagacaaatgagacgctgaaggccgcgatcagcctcccgtctctttatttttatacaggcggaaacacagacgaatactcggggggctgcgagggaaccgcaggaggagctgacgctacaggagggggcagcacaatcagctgatgtgtggacggaaagggtcgcgcctcaacgttccagaccagagcagactgtcgtttcttctcttcctgcagtttgccttcagaaacggcgtgcagccgccgagcccgtcgacgttgccgaagtaacatgtcgcgttgacactggagcgccgcggttcgcgatgcgtgatgtttgtcccggtgagacagtgctaacctcagccaacgctcgccaagtccgagagcgtccaccgccagaagcacgatgccggtccaccagatgatattgaggccggatccgatccacactacaaaagcgctgaggacgctgtatgtagaagacgtgcgggtcgcgggaggcacttcggcgttctttcccaacggcgtggacggtctccggtgacgttcgcaactgaaatcagaatccaacagctgttgtgtatttttttccccaggatacattaaccgtatactcaaatgctggttacgaataccgtacttggcgtcgccggtttgtatatatagagcccagcgaattccaccgttgacgtcgctttcattgtcttttcttatattttcctttgtaggacacccgagtccgctgagatggaaccgaagtcgctgccgttcgccagtaatatcgatatcttcgtagtccaactccacgacgacgggcccactgaagttaccttcgatgtctcccttggagaacgtcgcaccgtttcgaaggcggcactgttctccaatggatacgtttcgtccaacatcgacggtgcacccgttactcggaggtgtcaacaaccccagtatcggcagcacactgggaaaccacatccaggctatggtgaaccgcatctccatggtcttggccttcagagaccgcgccgtcgttgttgacgatgccgcaattcggggcggtaagaacggtacattcctgaaccgtagccgtcgatcgagcgggctccgggggttccccataagtagcgtgcgccacacacgttgtttctgaagctgtgtcaccgatgtcggatgacgtatataacagcagcgtgggtaccgtcactagtgacgtggcgtgacgaagctggtacggtggcggcggactgtcaggtatccgcgtggacggaaacggcggtagtgaccaggtggtcagtggcggcgacaaggccgcctgagccggtggctccttcttttccccaggtggtgcgactgacggtggcggcggcagacccagcatgcgccgaagacacagcttgacggcgcgatccaccttggaagtggacggcgataacgccacgcgtcgccagaaaagcagcgggtgacgcacggcttccatgggaacgagctccaacagcagcagagctaataaaaggacgcacaccagaagatccacacacagaccatgtagctcgttctccaagtcatgccggtggggccgggacggggtgggacgagagccggtaggacagcggcgcatacccacgccgccgtgggcggtgataaccagttgctcaggacactgcagaccgtagaaatacacttggtagggatcgcaacggctagggtctgtgcggccatcgtgcagttccaagcgccgagggtaggtgcgtttcggcgccgtgcagttgccgcgcccaaaattcacgcgtaaagcgttgccgtagctggcggtcccgtaaccgctcacgagtatcacgtacgcacgattacccccgcccaccatacaacaacccccgtagtaggcaacctcgcccataggtctccgaacaggtgtccagcgctgcaccccgttgagtttcacgaaactagggtagtgctcacactgagagaaaaaaaagttggtgctccattgggtgcccgtcacgcaggcgctggcgttcccgtagcgggtgcgcagccaacgtcgaccgtcccaacggtcgtacgtgggccgtcgaaattgacggtccactgaggtggcaggggacacggaagaatggaaagaggtgctgctgaagtaagacgtgtcattgttgtctcgtcgggttttcgacggcggagccggctcagagcggaccacggttgattgtgcccggaccgtgggcgcgacgaaacccaccgtcacggtccgagcacatccaaacgtgagccaccaccacccactgtagagccaccatcggaaacaccgcatgtttttctacatgatcctttcctacgtctttttccccataaacttttccggttcgctaatcgcacggaaatggtcgtgggtttaatatcgtgtatatcgggcacggggaaaagaggggcggacacggggtttgtacgaaaagaccgaggtagcgcttttttattacggtataatttgtgagacgcgacacacctcgtcggacagcgtgtcggaagatgtctctcttcggctcggcgagctccgacgcgaaaagcataacttcgtataatgtatgctatacgaagttattaattaagatccagacatgataagatacattgatgagtttggacaaaccacaactagaatgcagtgaaaaaaatgctttatttgtgaaatttgtgatgctattgctttatttgtaaccattataagctgcaataaacaagttaacgggcccgctagcttgccaaacctacaggtggggtctttcattcccccctttttctggagactaaataaaatcttttattttatcgatgcatggggtcgtgcgctcctttcggtcgggcgctgcgggtcgtggggcgggcgtcaggcaccgggcttgcgggtcatgcaccaggtgcgcggtccttcgggcacctcgacgtcggcggtgacggtgaagccgagccgctcgtagaaggggaggttgcggggcgcggaggtctccaggaaggcgggcaccccggcgcgctcggccgcctccactccggggagcacgacggcgctgcccagacccttgccctggtggtcgggcgagacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtaagcttaccggtcttaagctgcaggaattatcccgggttgtggcaagcttatcatcgtgtttttcaaaggaaaaccacgtccccgtggttcggggggcctagacgtttttttaacctcgactaaacacatgtaaagcatgtgcaccgaggccccagatcagatcccatacaatggggtaccttctgggcatccttcagccccttgttgaatacgcttgaggagagccatttgactctttccacaactatccaactcacaacgtggcactggggttgtgccgcctttgcaggtgtatcttatacacgtggcttttggccgcagaggcacctgtcgccaggtggggggttccgctgcctgcaaagggtcgctacagacgttgtttgtcttcaagaagcttccagaggaactgcttccttcacgacattcaacagaccttgcattcctttggcgagaggggaaagacccctaggaatgctcgtcaagaagacagggccaggtttccgggccctcacattgccaaaagacggcaatatggtggaaaataacatatagacaaacgcacaccggccttattccaagcggcttcggccagtaacgttaggggggggggagggagaggggggggggggagaggggcggaattggccgccctagatgcatgctcgacctgcaggcggccgctttacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggtggcgaccggtggatcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagaaggtacctaaccaagttcctctttcagaggttatttcaggccatggtgctgcgccgaattgttaattaaggcgcgcc

SEQ ID NO: 10 - DNA, 9623 bp, Simian cytomegalovirus
tggatgggatatattactctgaaagaagagaaaagatcctgaatttgtatgccttgaacgagtggggaataatagatgattggcaagcttactcaccaggcccggggataaggtacccgagagtctttggcttctgctttaagctagtcccagtggacctgcatgaggaggcacgcaactgtgagagacactgtctgatgcatccagcacagatgggggaagatcctgatggaatagatcatggagaagtcttggtctggaagtttgacccgaagttggcggtggagtaccgcccggacatgtttaaggacatgcacgaacatgcaaagcgctagtgtcagcactttgcggttgggactttccgccagggactttccacagtgggtggatcggaggcggtacaggggcggtactgggagtggctttcccctcagagctgcataaaagcagatgctcgctggcttgtaactcagtctcttactaggagaccagctagagcctgggtgttcgctggttagcctaacccggttggccaccgggggtaaggactccttggcttcatatagctcaataaacctgctcgcttagtcgctatattggagtcaagtgctcattgctgcgccgagcctctagaggtgaacctctcttactgggttctcctgtacccaggtgggagaaactccagcagtggcgcccgaacagggacttgagaagaggcatcggcaccgaccgctgagttgctgagcgtcggagagggacgactcaggtagggtgagagcctacgagttttttgctacctagtcagcgagaaaggctaggccgcgacaggggcgcgggtcccattagtggcaaccaacccagttggacgaagggttggtaggggacgggtcggagcaatgggcgggggtcactcagcactgtcagggagaagcctcgacacgttcgagaagattaggctacgtccgaacgggaaaaagaagtaccaaattaaacatttaatatgggcaggaaaagaaatggaacgatttgggttacatgagaaacttttagaaacaaaagaaggctgtcaaaaaatcatagaagttttaaccccgttggaaccgacaggctccgaggggctaaaagctctgtttaatttgtgctgcgtcatttggtgcattcacgcagaacagaaagtgaaagacacagaggaagctgtagtaacagttaagcaacactaccatctagtggacaaaaatgagaaagcagctaaaaagaaaaatgagacaacagcgccacctggtggcgaatcaagaaattacccagtagtaaatcagaataatgcctgggtacaccagcctttgtctccgcgcacgttaaatgcgtgggtcaaatgcgtggaggaaaaaaggtggggagcagaagtagtccccatgttccaagcactctcagagggatgtctctcctatgatgtaaatcagatgctcaatgtaataggagaccatcagggggcattacaaattcttaaggaagtcattaatgaagaagcagcagagtgggacaggacacacagaccaccagctggcccgttaccagcagggcagctaagagacccgacagggtcagatatagcaggaactaccagctcaattcaggaacaaatagagtggaccttcaatgccaatccaagaatagacgtaggggcacaatacagaaaatgggttattttgggcttacaaaaggtagtgcagatgtacaatccccaaaaggtcctagacattcgacagggacctaaagaacccttccaggactatgtagacagattctataaagccctgagagcagaacaagcaccacaggatgttaaaaattggatgacacaaactttgcttatccagaatgccaatccggattgtaaattgattctgaaaggattgggaatgaatccaaccttggaggaaatgctaatagcttgccagggagtaggagggccacaacataaggctaagctaatggtagaaatgatgagtaatggacagaatatggtccaagtgggacctcagaaaaagggcccccgagggccgctaaaatgctttaattgtggcaaatttggacatatgcaaagggaatgcaaggcaccaagacagatcaaatgctttaagtgcggcaaaattggccatatggcaaaagactgcaagaatggacaggcaaattttttagggtatggccattggggaggagcgaaaccaagaaattttgtgcaatacagaggagacacagttggtctggaaccaacagcccccccaatggaaacagcttacgatccagcaaagaagctcctccagcagtatgcagagaagggacagcgcctgagagaggagagagaacagacaaggaaacagaaggagaaagaagtggaggatgtttccttgagctccctctttggaggagaccaatgaaacgagtcatcatagaaggaacgccagtgcaagccttgttagatacaggagcagatgacactataattcaagaaaaggacttgcactttcccccacataaaccatggcgttccaaggtagtaggaggtataggaggagggattcatgtcaaagaatatcagggggtacaagtacaattggaggataaaatcatcaccggctcaattctaataggaagtacaccaatcaatattataggaagaaatattttagctcaggcaggcatgaaattagttatgggagttctatctagtcagattgaggaaacaaaagtacaactaaaagaagggaaagatggacctaaattgaaacaatggcccttatcaagagaaaaaattgaagctttaacagaaatatgcaaacaaatggaagaggagggaaaattatctaggataggaggagaaaatccttataatacaccagtgtttgccataaagaaaaaggataaaacacaatggagaatgcttgtagatttcagggaactaaacaaagctactcaagacttttttgaggttcagctgggaattcctcacccagcgggccttcagaaaaagaagcaaatcacagtaatagacataggggatgcctattattcaataccattatgcaaggaattcagaaaatatacagcatttaccatcccctcagtaaataatacagggccagggataaggtatcagttcaattgtctgcctcagggatggaaaggatctcctacaattttccagaatacggcagcaaacattttagaggagatcaaaaggcacactcctgggttagaaattgtccaatacatggacgatttgtggttggcgtcagaccatgatgagactagacataatcaacaggtagacatagtaagaaagatgctgctagaaaaaggtctagaaaccccagacaagaaagtccaaagagaaccgccatgggaatggatggggtataaattgcatccgaataaatggaccattaacaaaatagaattaccccccttagaaggagaatggacagtaaacaaaatacagaaggtagtaggagttctaaattgggcaagtcaaatttatccaggaattaaaaccaaacatacctgtgccatgttgagagggaaaaagaacctcctagaagaaatagtatggacagaagaggcagaggcagaatataagaacaatcaagggatagtgcaggaaacacaagaaggaacatactatgaccctctcaaagaattaatagcaacagttcaaaagcaaggagaagggcaatggacataccaattcacccaagaaggggcagtattaaaggtgggaagatatgccaagcaaagagaaactcatactaatgatctaaggactctagcacaccttgtccaaaaaatctgtaaggaagcacttaccatttggggaagacttccacgagtacaactcccagtagacaagaaaacatgggatatgtggtggcaggactattggcaagtatcctggataccagaatgggagtttgttagcacaccactcctagtaaaactgtggtattccttagtaaaagaaccaatcaaaggagaagatgtttattatgtggatggggcagcatccaaagtgaccaaattaggtaaggcaggatatctgtcagagagaggaaaaagtagaattagggaattagaaaacaccactaaccaacaagcagaattaacagcagttaagatggcattggaggacagtggagaaaatgtaaatatagtcacagattctcaatatgtaatgaacatcttgacagcatgtccacaggaaagtaactcacccttagtggaacagataatacaagccctaatgaaaaagaggcaggtctacttacaatgggtaccagctcataaggggataggaggcaatacagaaatagataaattagtaagcaaaggaataagacagatcctcttcttagatagaatagaagaagcacaagatgaccatgcaaagtaccataacaattggagaagtatggtacaggaatttggattacctaatatagtagcaaaagagatagtagcggcatgtcccaaatgccaaataagaggagaacctaagcatggacaggtagacgcctccattgaaacttggcagatggactgcacccatttagaaggaaaagttataatagtagcagtacatgtagccagtggattcatagaagcagaggtgatcccaagagaaactgggaaggagacagcacactttctgctgaaactgttagcaagatggccagtgaaacatctacacactgataatggcccaaactttacctctcagaatgtggcagcggtgtgctggtggggtaatatagagcacaccactggaataccttataacccacagtcacagggtagtgtagaaagcatgaacagacagctcaaggaaatcatctctcaaataagagatgattgtgagagattggagacagcagtgcaaatggctacgcatatccacaattttaaaagaaagggaggaatagggggtatctctagtgcagaaagattggttaatatgctaacaacacaactagaactaaatactctacaaaaccaaatccaaaaaattttgaattttaaggtctactacagagaaggtagagatccagtgtggaaaggaccagcgcgactcatctggaaaggagaaggcgcggtggtaattaaagagggggaagacatcaaggtagtccccaggagaaaggctaagattatcaaagattatggagagagaaaaacaatggatagtgagggtagtatggagggtgtcagagaggcaaataagcagatggagggggatagtgacttacaagatcaggaataaacaattgccttgggaatacagacatcattggcaggtgcaatggcagttttggacctacagccagttcattatccccttatcaaaagatgattacatagaagtgaatatttatcacaacctcaccccagaaagaggatggctctcaagtcatggagtagggttatcctattaccatcaaaagggatataagacagaagtagatccaggaacagcagacagaatgatacacctatattattttaactgttttacagatagagccatccaacaggctatcagaggggagaagtatacgtggtgcacattcaaggaaggacataaaggtcaggtacaatcactgcaacttttggcactagttgcatatacaaatggcatcaggaagagatccaagagaacctttaccaggatggctggaaatctgggatctagacagggagccatgggacgaatggctacaagacatgctcagggatctaaacgaagaagccagaaggcactttggaatgaacatgctaatccgagtatggaattactgtgtagaggagggaaggagacataataccccatggaatgagataggctacaagtactatagaattgttcaaaagtctatgtttgtacatttcagatgtggttgtagaaggagaggacctttttccccttacgaagagaggagaaatggacaaggaggaggagccccaccccctcctccaggacttgcataggccattacaaccatgtactaataaatgctattgcaaaaaatgctgttatcactgtgagctttgcttcctgcagaagggcttaggagtgcgttatcatgtctctaggaaaagaagaaaaacaagcactcaagataatcaagaccctatacggcagcagtaagtatggggagattgcttataaaaatactaataatagcaatagggataagtataggaataggtaacctgtatgtgacagtgttttatggaatcccagtatggaaaaattcaacagttcaggcattttgcatgacgcccaataccaatatgtgggcaaccaccaactgcataccagatgatcatgataatacagaggtgcctctaaacattacagaagctttcgaggcttgggataatccgctggtaaaacaagcagagagtaatatacatctactctttgaacaaacgatgaggccttgtgttaagctctcccccatatgtattaaaatgtcctgtgtagagctgaatggtacagccacgacaaaggccaccactactgcaactacaacaatgactaccccctgtcagaattgcagtacagagcagatagaaggagaaatggcagaggaaccagcatccaactgcacttttgcaattgcaggatatcaaagagatgtaaaaaagaattatagcatgacctggtatgatcaggagttagtctgcaataataaaacaggaagtgaaaagggaagtaaggattgttacatgatacattgtaatgattcagtgataaaagaagcttgtgataaaacatattgggatactttaagagtaagatactgtgcaccagcagggtatgctttgctaaaatgtaatgataaggattatagaggctttgctccaaagtgcaagaatgtttcagtagtgcattgtactagattaatcaatactactataactacagggataggattaaatggtagtagatcagaaaatagaacagagatatggcagaaaggaggaaatgataatgatacagttataataaagttgaataagttttacaacttgacagtgagatgccgaagacctggtaataaaacagtgttgccagtaacaatcatggcagggttagtatttcactctcagaaatataataccaggttaaaacaagcgtggtgccacttccaaggagattggaaaggggcatggaaagaagtcagagaagaagtaaagaaagtgaaaaatcttacagaagtaagcatagaaaatatacatctgagaaggatatggggagatccagaatcagcgaatttttggttcaattgtcaaggtgaatttttctattgtaagatggactggtttatcaattatctaaacaatcgaacagaagatgcagaaggtactaataggacctgtgacaaagggaagccaggaccaggaccatgtgttcagagaacttatgttgcctgccatatacgacaagtagtaaatgattggtacactgtctctaaaaaggtatatgctccaccaagggaaggtcatttggagtgtaactcatcagtcacggcactatacgtggcaatagattataacaacaagtctggcccaataaatgtgaccctaagtcctcaggtacgcagcatatgggcgtacgaactgggagactataaattagtagagataacaccaattggctttgctcctacagatgtaagaagatatactggccccacaagagaaaaaagggtgccattcgtgctagggtttctaggcttcttgggagctgctggaactgcaatgggcgcagcggcaacaacgctgacagtccagtctcggcatttgcttgctgggatattgcagcagcagaagaacttgctggcggctgtggaacagcaacaacagttgttgaagctgaccatttggggtgtgaaaaacctcaatgcccgcgtcacagctctcgagaagtacctagaggatcaggcacggctaaattcatggggatgtgcgtggaaacaagtatgtcacaccacagtgccatggaagtataataacactcctaagtgggacaatatgacttggttggagtgggagagacaaattaatgccttggaaggcaacataactcaactattggaagaagcacaaaatcaggaatcaaagaatctggatctgtaccagaaattggatgattggtcagggttctggtcatggttctcactgtcaacttggttaggctatgttaaaataggatttttagtgatagtgattattctaggattaagatttgcatgggtattatggggatgtatcagaaatattaggcagggatataatcctctcccccagatccatatccacagttcagcggaacggccagacaacggaggagggcaagacagaggtggagaaagcagcagcagcaaattgataagattgcaggaagagtcctcaacaccttcgaggatcaacaactggtggctcaacttcaagagctgcagcttgagaataaggacttggtgttacaacatctgcctgaccctcctcatattcatcaggacagcagtgggatacctgcagtatgggctccagcaactccaagaggcagcaacagggcttgctcaagctctggcgagggctgcgagggaagcctggggcagactgggtgctattgtccgatccgcttatcgggcagtcatcaacagtccaagaagagtgcggcaaggccttgaaaaagtcctggggtaaaggtaaaatgactccagacggccgccgcctgcaagaaggagacacctttgatgagtgggatgatgatgaagaagaagtaggcttccctgtgcaacctcgagtccccttaagacagatgacctataaattagcagtggacttttcccactttttaaaatcaaaggggggactggatgggatatattactctgaaagaagagaaaagatcctgaatttgtatgccttgaacgagtggggaataatagatgattggcaagcttactcaccaggcccggggataaggtacccgagagtctttggcttctgctttaagctagtcccagtggacctgcatgaggaggcacgcaactgtgagagacactgtctgatgcatccagcacagatgggggaagatcctgatggaatagatcatggagaagtcttggtctggaagtttgacccgaagttggcggtggagtaccgcccggacatgtttaaggacatgcacgaacatgcaaagcgctagtgtcagcactttgcggttgggactttccgccagggactttccacagtgggtggatcggaggcggtacaggggcggtactgggagtggctttcccctcagagctgcataaaagcagatgctcgctggcttgtaactcagtctcttactaggagaccagctagagcctgggtgttcgctggttagcctaacccggttggccaccgggggtaaggactccttggcttcatatagctcaataaacctgctcgcttagtcgctatattggagtcaagtgctcattgctgcgccgagcctctagaggtgaacctctcttactgggttctcctgtacccaggtgggagaaactccagca

SEQ ID NO: 11 - protein, 1472 aa, Simian immunodeficiency virus
MGGGHSALSGRSLDTFEKIRLRPNGKKKYQIKHLIWAGKEMERFGLHEKLLETKEGCQKIIEVLTPLEPTGSEGLKALFNLCCVIWCIHAEQKVKDTEEAVVTVKQHYHLVDKNEKAAKKKNETTAPPGGESRNYPVVNQNNAWVHQPLSPRTLNAWVKCVEEKRWGAEVVPMFQALSEGCLSYDVNQMLNVIGDHQGALQILKEVINEEAAEWDRTHRPPAGPLPAGQLRDPTGSDIAGTTSSIQEQIEWTFNANPRIDVGAQYRKWVILGLQKVVQMYNPQKVLDIRQGPKEPFQDYVDRFYKALRAEQAPQDVKNWMTQTLLIQNANPDCKLILKGLGMNPTLEEMLIACQGVGGPQHKAKLMVEMMSNGQNMVQVGPQKKGPRGPLKCFNCGKFGHMQRECKAPRQIKCFKCGKIGHMAKDCKNGQANFFRVWPLGRSETKKFCAIQRRHSWSGTNSPPNGNSLRSSKEAPPAVCREGTAPERGERTDKETEGERSGGCFLELPLWRRPMKRVIIEGTPVQALLDTGADDTIIQEKDLHFPPHKPWRSKVVGGIGGGIHVKEYQGVQVQLEDKIITGSILIGSTPINIIGRNILAQAGMKLVMGVLSSQIEETKVQLKEGKDGPKLKQWPLSREKIEALTEICKQMEEEGKLSRIGGENPYNTPVFAIKKKDKTQWRMLVDFRELNKATQDFFEVQLGIPHPAGLQKKKQITVIDIGDAYYSIPLCKEFRKYTAFTIPSVNNTGPGIRYQFNCLPQGWKGSPTIFQNTAANILEEIKRHTPGLEIVQYMDDLWLASDHDETRHNQQVDIVRKMLLEKGLETPDKKVQREPPWEWMGYKLHPNKWTINKIELPPLEGEWTVNKIQKVVGVLNWASQIYPGIKTKHTCAMLRGKKNLLEEIVWTEEAEAEYKNNQGIVQETQEGTYYDPLKELIATVQKQGEGQWTYQFTQEGAVLKVGRYAKQRETHTNDLRTLAHLVQKICKEALTIWGRLPRVQLPVDKKTWDMWWQDYWQVSWIPEWEFVSTPLLVKLWYSLVKEPIKGEDVYYVDGAASKVTKLGKAGYLSERGKSRIRELENTTNQQAELTAVKMALEDSGENVNIVTDSQYVMNILTACPQESNSPLVEQIIQALMKKRQVYLQWVPAHKGIGGNTEIDKLVSKGIRQILFLDRIEEAQDDHAKYHNNWRSMVQEFGLPNIVAKEIVAACPKCQIRGEPKHGQVDASIETWQMDCTHLEGKVIIVAVHVASGFIEAEVIPRETGKETAHFLLKLLARWPVKHLHTDNGPNFTSQNVAAVCWWGNIEHTTGIPYNPQSQGSVESMNRQLKEIISQIRDDCERLETAVQMATHIHNFKRKGGIGGISSAERLVNMLTTQLELNTLQNQIQKILNFKVYYREGRDPVWKGPARLIWKGEGAVVIKEGEDIKVVPRRKAKIIKDYGERKTMDSEGSMEGVREANKQMEGDSDLQDQE

SEQ ID NO: 12 - protein, 513 aa, Simian immunodeficiency virus
MGGGHSALSGRSLDTFEKIRLRPNGKKKYQIKHLIWAGKEMERFGLHEKLLETKEGCQKIIEVLTPLEPTGSEGLKALFNLCCVIWCIHAEQKVKDTEEAVVTVKQHYHLVDKNEKAAKKKNETTAPPGGESRNYPVVNQNNAWVHQPLSPRTLNAWVKCVEEKRWGAEVVPMFQALSEGCLSYDVNQMLNVIGDHQGALQILKEVINEEAAEWDRTHRPPAGPLPAGQLRDPTGSDIAGTTSSIQEQIEWTFNANPRIDVGAQYRKWVILGLQKVVQMYNPQKVLDIRQGPKEPFQDYVDRFYKALRAEQAPQDVKNWMTQTLLIQNANPDCKLILKGLGMNPTLEEMLIACQGVGGPQHKAKLMVEMMSNGQNMVQVGPQKKGPRGPLKCFNCGKFGHMQRECKAPRQIKCFKCGKIGHMAKDCKNGQANFLGYGHWGGAKPRNFVQYRGDTVGLEPTAPPMETAYDPAKKLLQQYAEKGQRLREEREQTRKQKEKEVEDVSLSSLFGGDQ

SEQ ID NO: 13 - RNA, 20 nt, Mus sp.
  Exemplary miR-124 sequence conserved across mouse, RM, and human
uaaggcacgcggugaaugcc

SEQ ID NO: 14 - RNA, 23 nt, Mus sp.
  Exemplary miR-143-3P sequence conserved across mouse, RM, and human
uguaguguuuccuacuuuaugga

SEQ ID NO: 15 - protein, 11 aa, Zaire ebolavirus
VYQVNNLEEIC

SEQ ID NO: 16 - protein, 16 aa, Zaire ebolavirus
RKKIQVYQVNNLEEIC

What is claimed is:

1. A recombinant viral vector comprising a nucleic acid sequence encoding a human cytomegalovirus (HCMV) backbone vector and at least one human immunodeficiency virus (HIV)-derived antigen,
wherein the recombinant viral vector: (a) comprises a deletion in gene UL82 that eliminates expression of a functional pp71 protein, (b) is deficient in host to host spread, (c) infects a HCMV seropositive host upon administration of said recombinant viral vector, and (d) induces and maintains a long-term effector memory T cell response to the at least one HIV-derived antigen in said seropositive host.

2. The recombinant viral vector of claim 1, further comprising a deletion in a HCMV gene region non-essential for growth in vivo.

3. The recombinant viral vector of claim 2, wherein the non-essential HCMV gene region is selected from the group consisting of: the RL11 family, the pp65 family, the US12 family, and the US28 family.

4. The recombinant viral vector of claim 2, wherein the non-essential HCMV gene region is selected from the group consisting of: RL11, UL6, UL7, UL9, UL11, UL78, UL83, US12, US13, US14, US17, US18, US19, US20, US21, and UL28.

5. The recombinant viral vector of claim 1, further comprising at least one deletion in a HCMV gene required for optimal growth in certain cell types.

6. The recombinant viral vector of claim 5, wherein the at least one deletion in a HCMV gene required for optimal growth in certain cell types comprises a deletion in UL64 or US29, or a combination thereof.

7. The recombinant viral vector of claim 5, wherein the recombinant viral vector has a deficient tropism for epithelial cells, the central nervous system (CNS), macrophages, or a combination thereof.

8. The recombinant viral vector of claim 1, further comprising a deletion in at least one immune modulatory gene selected from the group consisting of: US2, US3, US4, US5, US6, US7, US8, US9, US10, US11, UL118, UL119, UL36, UL37, UL111a, UL146, and UL147.

9. The recombinant viral vector of claim 1, wherein the HCMV backbone vector comprises a nucleic acid sequence that is at least 90%, at least 95%, at least 99%, or 100% identical to the nucleic acid sequence of SEQ ID NO: 2, SEQ ID NO: 3, SEQ ID NO: 4, SEQ ID NO: 5, SEQ ID NO: 6, SEQ ID NO: 7, SEQ ID NO: 8, or SEQ ID NO: 9.

10. The recombinant viral vector of claim 1, wherein the at least one HIV-derived antigen is selected from the group consisting of: Gag, Pol, Env, Rev, Tat, and Nef, or an epitope or antigenic fragment thereof.

11. A recombinant viral vector comprising a nucleic acid sequence encoding a rhesus cytomegalovirus (RhCMV) backbone vector and at least one simian immunodeficiency virus (SIV)-derived antigen,
wherein the recombinant viral vector: (a) comprises a deletion in gene Rh110 that eliminates expression of a functional pp71 protein, (b) is deficient in host to host spread, (c) infects a RhCMV seropositive host upon administration of said recombinant viral vector, and (d) induces and maintains a long-term effector memory T cell response to the at least one SIV-derived antigen in said seropositive host.

12. The recombinant viral vector of claim 11, further comprising a deletion in a RhCMV gene region non-essential for growth in viva.

13. The recombinant viral vector of claim 12, wherein the non-essential RhCMV gene region is selected from the group consisting of: the RL11 family, the pp65 family, the US12 family, and the US28 family.

14. The recombinant viral vector of claim 11, further comprising a deletion in at least one immune modulatory gene selected from the group consisting of: Rh158, Rh159, Rh160, Rh161, Rh162, Rh163, Rh164, Rh165, Rh166, Rh182, Rh183, Rh184, Rh185, Rh186, Rh187, Rh188, and Rh189.

15. The recombinant viral vector of claim 11, wherein the RhCMV backbone vector comprises a nucleic acid sequence that is at least 90%, at least 95%, at least 99%, or 100% identical to the nucleic acid sequence of SEQ ID NO: 1.

16. The recombinant viral vector of claim 11, wherein the at least one SIV-derived antigen is selected from the group consisting of: Gag, Pol, Env, Rev, Tat, and Nef, or an epitope or antigenic fragment thereof.

17. A recombinant viral vector comprising a nucleic acid sequence encoding a HCMV backbone vector and at least one HIV Gag epitope, wherein the recombinant viral vector: (a) comprises a deletion in gene UL82 that eliminates expression of a functional pp71 protein, (b) is deficient in host to host spread, (c) infects a HCMV seropositive host upon administration of said recombinant viral vector, and (d) induces and maintains a long-term effector memory T cell response to HIV Gag.

18. The recombinant viral vector of claim 12, wherein the non-essential RhCMV gene region is selected from the group consisting of: Rh13-Rh29, Rh111-Rh112, Rh191-Rh202, Rh214-Rh220, Rh13.1, Rh19, Rh20, Rh23, Rh24, Rh112, Rh190, Rh192, Rh196, Rh198, Rh199, Rh200, Rh201, Rh202, and Rh220.

19. The recombinant viral vector of claim 11, further comprising at least one deletion in an RhCMV gene required for optimal growth in certain cell types.

20. The recombinant viral vector of claim 19, wherein the recombinant vector has a deficient tropism for epithelial cells, the central nervous system (CNS), macrophages, or a combination thereof.

21. The recombinant viral vector of claim 17, further comprising at least one HIV-derived antigen selected from the group consisting of: Pol, Env, Rev, Tat, and Nef, or an epitope or antigenic fragment thereof.

22. The recombinant viral vector of claim 17, further comprising a deletion in a HCMV gene region non-essential for growth in vivo.

23. The recombinant viral vector of claim 17, further comprising at least one deletion in a HCMV gene required for optimal growth in certain cell types.

24. The recombinant viral vector of claim 23, wherein the recombinant vector has a deficient tropism for epithelial cells, the central nervous system (CNS), macrophages, or a combination thereof.

* * * * *